(12) United States Patent
Bruggemann et al.

(10) Patent No.: US 9,475,859 B2
(45) Date of Patent: Oct. 25, 2016

(54) POLYNUCLEOTIDES ENCODING RODENT ANTIBODIES WITH HUMAN IDIOTYPES AND ANIMALS COMPRISING SAME

(71) Applicant: OMT, Inc., Palo Alto, CA (US)

(72) Inventors: Marianne Bruggemann, Cambridge (GB); Roland Buelow, Palo Alto, CA (US); Michael J. Osborn, Suffolk (GB); Biao Ma, Cambridge (GB)

(73) Assignee: OMT, Inc., San Diego, CA (US)

( * ) Notice: Subject to any disclaimer, the term of this patent is extended or adjusted under 35 U.S.C. 154(b) by 123 days.

(21) Appl. No.: 14/517,755

(22) Filed: Oct. 17, 2014

(65) Prior Publication Data

US 2015/0113668 A1    Apr. 23, 2015

Related U.S. Application Data

(63) Continuation of application No. PCT/US2013/075157, filed on Dec. 13, 2013.

(60) Provisional application No. 61/737,371, filed on Dec. 14, 2012.

(51) Int. Cl.
*A01K 67/027* (2006.01)
*C07K 16/00* (2006.01)

(52) U.S. Cl.
CPC ........... *C07K 16/00* (2013.01); *A01K 67/0275* (2013.01); *A01K 67/0278* (2013.01); *A01K 2227/105* (2013.01); *A01K 2267/01* (2013.01); *C07K 2317/24* (2013.01); *C07K 2317/52* (2013.01); *C07K 2317/56* (2013.01); *C07K 2317/64* (2013.01); *C07K 2317/92* (2013.01)

(58) Field of Classification Search
CPC ............... A01K 2227/105; A01K 2267/01; A01K 67/0275; A01K 67/0278; C07K 16/00; C07K 2317/24; C07K 2317/52; C07K 2317/56; C07K 2317/64; C07K 2317/92
USPC ............................................. 800/14, 18, 4, 6
See application file for complete search history.

(56) References Cited

U.S. PATENT DOCUMENTS 7,501,552 B2 † 3/2009 Lonberg

FOREIGN PATENT DOCUMENTS

| WO | WO 2008/151081    | † | 12/2008 |
| WO | WO2008/151081 A1 | * | 12/2008 |
| WO | WO 2011/004192    | † | 1/2011  |
| WO | WO 2011/158009 A1 |   | 12/2011 |

OTHER PUBLICATIONS

Cronkhite et al., "Male and female germline specific expression of an EGFP reporter gene in a unique strain of transgenic rats." Dev. Biol. vol. 284(1), pp. 171-183 (2005).
Davis et al., "Transgenic mice as a source of fully human antibodies for the treatment of cancer." Cancer Metastasis Rev, vol. 18, p. 421-425 (1999).
Hochi et al., "Successful production of transgenic rats." Animal Biotech vol. 1, pp. 175-184 (1990).
IgG heavy chain 2a gene segment (Rat Genome Database ID: 1359626) (4 pages) 2005.
IgM heavy chain constant gene segment (Rat Genome Database ID: 1359202) (4 pages) 2005.
Lonberg et al., "Antigen-specific human antibodies from mice comprising four distinct genetic modifications." Nature, vol. 368, pp. 856-859 (1994).
Ma et al., "Human antibody expression in transgenic rats: comparison of chimeric IgH loci with human VH, D and Jhbut bearing different rat C-gene regions." J. Immunol. Meth., vol. 400, pp. 78-86 (2013).
Mundt et al., "Novel control motif cluster in the IgH delta-gamma 3 interval exhibits B cell-specific enhancer function in early development." J. Immunol., vol. 166, pp. 3315 (2001).
Nicholson et al., "Antibody repertoires of four- and five-feature translocus mice carrying human immunoglobulin heavy chain and kappa and lambda light chain yeast artificial chromosomes." J. Immunol., vol. 163, p. 6898 (1999).
Osborn et al., "High-affinity IgG antibodies develop naturally in Ig-knockout rats carrying germline human IgH/Ig/Ig loci bearing the rat CH region." J. Immunology, vol. 190, No. 4, pp. 1481-1490 (2013).
Pettersson et al., "A second B cell-specific enhancer 3' of the immunoglobulin heavy-chain locus." Nature, vol. 344, pp. 165 168 (1990).
Pruzina et al., "Human monoclonal antibodies to HIV-1 gp140 from mice bearing YAC-based human immunoglobulin transloci." Protein Engineering, Design and Selection, vol. 1, pp. 791-799 (2011).
Vincent-Fabert et al., "Genomic deletion of the whole IgH 3' regulatory region (hs3a, hs1,2, hs3b, and hs4) dramatically affects class switch recombination and Ig secretion to all isotypes." Blood, vol. 116, pp. 1895-1898 (2010).

\* cited by examiner
† cited by third party

*Primary Examiner* — Janet Epps-Smith
(74) *Attorney, Agent, or Firm* — Todd A. Lorenz; Arnold & Porter LLP

(57) ABSTRACT

The invention relates to polynucleotides, particularly chimeric polynucleotides useful for optimal production of functional immunoglobulins with human idiotypes in rodents. The invention further relates to rodents comprising such polynucleotides.

17 Claims, 7 Drawing Sheets

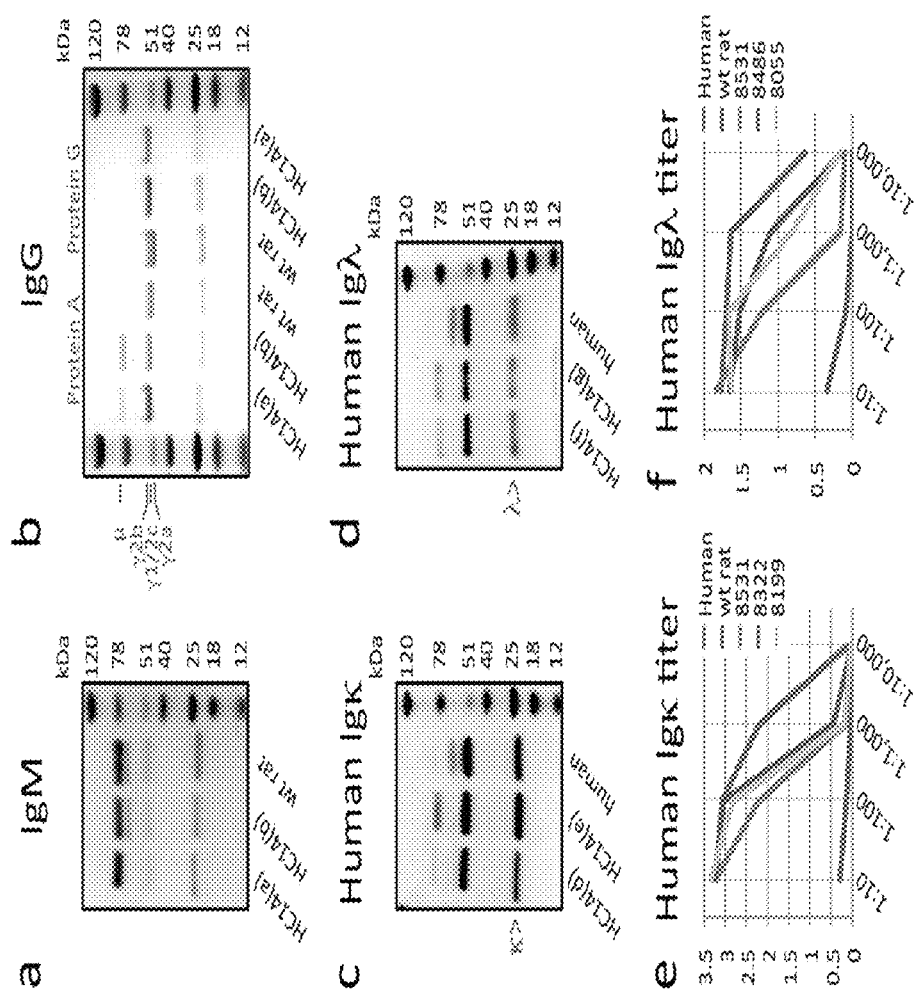

POLYNUCLEOTIDES ENCODING RODENT ANTIBODIES WITH HUMAN IDIOTYPES AND ANIMALS COMPRISING SAME

CROSS-REFERENCE TO RELATED APPLICATION

This application is a continuation of International Application No. PCT/US2013/075157 filed Dec. 13, 2013, which claims priority to U.S. provisional patent U.S. application Ser. No. 61/737,371 filed 14 Dec. 2012. The applications are expressly incorporated herein in their entirety by reference.

FIELD OF INVENTION

The invention relates to polynucleotides, particularly chimeric polynucleotides useful for the production of immunoglobulins with human idiotypes in rodents. The invention further relates to rodent cells comprising such polynucleotides.

REFERENCE TO A SEQUENCE LISTING

A Sequence Listing is provided in this patent document as a txt file entitled "189314-US_ST25.txt" and created Dec. 12, 2012 (size 3 MB). The contents of this file is incorporated herein by reference in its entirety.

BACKGROUND OF THE INVENTION

Human monoclonal antibodies have proven to be invaluable in therapeutic applications, either as IgG of conventional size, single chains or domain modules[1, 2]. Despite the successes there are still major shortcomings in their production, which relies either on specificity selection of available human material and subsequent modification of individual products, or the immunization of the limited availability of transgenic animals, mainly mice[3]. Target antigen restrictions are widely in place for the use of transgenic mice, as well as large transgenic animals such as cattle, and the development of new specificities is company controlled[4-7].

DNA rearrangement and expression of human immunoglobulin (Ig) genes in transgenic mice was pioneered over 20 years ago by stably inserting heavy-chain genes in germline configuration[8]. Although human antibody repertoires were obtained in these early animals, major improvements, resulting in higher expression levels and exclusive production of human Ig, combined two new strategies: gene knock-out in embryonic stem (ES) cells[9] and locus extension on artificial chromosomes[10].

Silencing of the endogenous Ig genes by gene targeting in ES cells produced several inactive mouse lines without the ability to rearrange their IgH and IgK locus or without producing fully functional IgH, IgK or IgX products (summarized in[3]). More recently zinc finger nucleases (ZFNs) were designed to generate site-specific double-strand breaks in Ig genes, which allowed gene disruption by deletion and non-homologous DNA repair. Injection of ZFN plasmids into fertilized eggs produced Ig silenced rats and rabbits with IgH and IgL disruptions[11-13].

Efficient expression of antibodies requires functional regulatory elements in various locations in immunoglobulin loci. Enhancer sequences have been identified near many active genes by nuclease digest and hypersensitivity to degradation. Hypersensitive sites may precede promoter sequences and the strength of their activity was correlated with the DNA sequence. Linkage to reporter genes showed elevated transcription if enhancer function was present (Mundt et al., J. Immunol., 166, 3315[2001]. In the IgH locus two important transcription or expression regulators have been identified, Eμ and the 3'E at the end of the locus (Pettersson et al., Nature, 344, 165 [1990]). In the mouse the removal of the entire 3' regulatory region (containing hs3a, hs1,2, hs3b and hs4) allows normal early B-cell development but abrogates class-switch recombination (Vincent-Fabert et al., Blood, 116, 1895 [2010]) and possibly prevents the optimization of somatic hypermutation (Pruzina et al., Protein Engineering, Design and Selection, 1, [2011]).

The regulatory function to achieve optimal isotype expression is particularly desirable when transgenic human IgH genes are being used. However, in a number of laboratories, transgene constructs with an incomplete 3'E region, typically providing only the hs1,2 element, led to disappointing expression levels in transgenic mice even when the endogenous IgH locus was knocked-out. This may be one reason why the generation of antigen-specific fully human IgGs from genetically engineered mice has been inefficient thus far. (Lonberg et al., Nature 368, 856 [1994]; Nicholson et al., J. Immunol., 163, 6898 [1999]; Davis et al., Cancer Metastasis Rev. 18, 421 [1999]; Pruzina et al., Protein Engineering, Design and Selection, 1, [2011].

In the rat, the 3'E region has only been poorly analyzed. A comparison of mouse and rat sequences does not allow identification of hs4, the crucial 4th E element with additional important regulatory sequences further downstream (Chatterjee et al., J. Biol. Chem., 286, 29303 [2011]). This could mean the region is not present in the rat, and perhaps not as important as in the mouse, or it could be absent in the analyzed rat genome sequences.

Still needed are methods and materials for the optimal production of immunoglobulins or antibodies having human idiotypes using transgenic animals, which are useful for treating humans in a broad range of disease areas.

SUMMARY OF INVENTION

Disclosed herein are novel polynucleotides comprising nucleic acid sequences encoding chimeric immunoglobulin chains, particularly chimeric heavy chains for use in creating transgenic animals. The polynucleotides of the present invention advantageously provide optimal expression due, at least in part, to the inclusion of a 3' enhancer since transloci lacking this 3' enhancer result in impaired isotype switching and low IgG expression. Accordingly, in preferred embodiments the invention provides chimeric polynucleotides comprising a rat 3' enhancer sequence, an Ig constant region gene and at least one human immunoglubulin (Ig) joining (J) region gene. In a preferred embodiment, the rat 3' enhancer sequence comprises the sequence set forth as SEQ ID NO:1, or a portion thereof.

The chimeric polynucleotides set forth herein may further comprise at least one human variable (V) gene, at least one a diversity (D) gene, or a combination thereof. In one embodiment, the constant region gene of the chimeric polynucleotide is selected from the group consisting of a human constant region gene and a rat constant region gene. In a preferred embodiment, the constant region gene is a rat constant region gene. In another preferred embodiment, the constant region gene is selected from the group consisting of Cμ and Cγ.

In one embodiment, the chimeric polynucleotide comprises a nucleic acid sequence substantially homologous to the bacterial artificial chromosome (BAC) Annabel disclosed herein (e.g., SEQ ID NO:10), or a portion thereof, and may optionally further comprise at least one human variable Ig gene isolatable from BAC6-$V_H$3-11 and BAC3. In a preferred embodiment, the chimeric polynucleotides contemplated herein comprise nucleic acid sequences (a) and (b) in 5' to 3' order: (a) a human Ig variable region comprising human V genes in natural configuration isolatable from BAC6-$V_H$3-11 and/or BAC3, and (b) a human Ig joining region comprising human J genes in natural configuration isolatable from the BAC Annabel. In another embodiment, each of the human Ig variable region, human Ig diversity region, human Ig joining region, the Ig constant region and the rat 3' enhancer region of a chimeric polynucleotide as disclosed herein are in the relative positions as shown in FIG. 1a. In another embodiment, a chimeric polynucleotide as disclosed has a sequence comprising or substantially homologous to the sequence set forth as SEQ ID NO:2 or a portion thereof. In another embodiment, a chimeric polynucleotide as disclosed has a sequence comprising or substantially homologous to the sequence set forth as SEQ ID NO:11, or a portion thereof. In a further embodiment, a chimeric polynucleotoide as disclosed herein comprises a rearranged V-D-J regions, wherein said rearranged V-D-J regions encode a heavy chain variable domain exon.

Also disclosed herein are polynucleotides encoding human kappa light chain genes. In one embodiment, a polynucleotide as disclosed herein has a nucleic acid sequence comprising or substantially homologous to a nucleic acid sequence selected from the group consisting of RP11-1156D9 (set forth as SEQ ID NO:3) and RP11-1134E24 (set forth as SEQ ID NO:4). In another embodiment, the isolated polynucleotide comprises nucleic acid sequences (a) and (b) in 5' to 3' order: (a) a human Ig variable region comprising human V genes in natural configuration isolatable from bacterial artificial chromosomes (BAC) RP11-156D9 and/or RP11-1134E24; (b) a human Ig joining region comprising human J genes in natural configuration isolatable from the bacterial artificial chromosomes (BAC) RP11-1134E24 and/or RP11-344F17 (set forth as SEQ ID NO:5). In a preferred embodiment, each of the human Ig variable region, the human Ig joining region, and the human Ig constant region are in relative position as shown in FIG. 1b. In another embodiment, a chimeric polynucleotide as disclosed has a sequence comprising or substantially homologous to the sequence set forth as SEQ ID NO:6 or a portion thereof.

Also provided herein is a rodent cell comprising one or more polynucleotides of the invention. For example, provided herein is a rodent cell comprising a polynucleotide as disclosed herein, preferably comprising a nucleic acid sequence encoding for a chimeric heavy chain, e.g., a nucleic acid sequence encoding a rat 3' enhancer sequence, an Ig constant region gene and at least one human J region gene, and optionally, comprising a nucleic acid sequence substantially homologous to the nucleic acid sequence selected from the group consisting of RP11-1156D9, RP11-1134E24 and portions thereof. The rodent cell contemplated herein may further comprise a polynucleotide encoding a functional light chain, e.g., having a nucleic acid sequence comprising or substantially homologous to a nucleic acid sequence selected from the group consisting of the sequence shown in FIG. 1b (set forth as SEQ ID NO:6), the sequence shown in FIG. 1c (set forth as SEQ ID NO:7), and portions thereof. In one embodiment, one or more of the polynucleotides are integrated into the rodent cell genome.

BRIEF DESCRIPTION OF THE DRAWINGS

In FIG. 2a, A refers to pro/pre B-cells (CD45R$^+$IgM$^-$) and B refers to immature B-cells (CD45R$^+$IgM$^+$). In FIG. 2c, A refers to transitional B cells (CD45R$^+$IgM$^-$), B to follicular B cells (CD45R$^+$IgM$^+$) and C to marginal zone B cells (CD45R$^{low}$IgM$^+$).

FIG. 4: Purification of rat Ig with human idiotypes and comparison to human and normal rat Ig levels. OmniRat serum and human or rat wt control serum, 100 µl each, was used for IgM/G purification. (a) IgM was captured with anti-IgM matrix, which identified 14 µg in wt rat, and 30 µg and 10 µg in OmniRats [HC14(a) and HC14(c)]. (b) IgG was purified on protein A and protein G columns, with a yield of up to ~3 mg/ml for OmniRats (Protein A: HC14(a) 1000 µg/ml; HC14(b) 350 µg/ml; wt rat 350 µg/ml; Protein G: HC14(a) 2970 µg/ml; HC14(b) 280 µg/ml; wt rat 1010 µg/ml). (c) Human IgK and (d) human IgX was purified on anti-IgK and anti-IgX matrix, respectively. No purification product was obtained using wt rat serum (not shown). Purified Ig, ~3 µg (concentration determined by nano drop), was separated on 4-15% SDS-PAGE under reducing conditions. Comparison by ELISA titration of (e) human IgK and (f) human IgX levels in individual OmniRats (8531, 8322, 8199, 8486, 8055), human and wt rat serum. Serum dilution (1:10, 1:100, 1:1,000, 1:10,000) was plotted against binding measured by adsorption at 492 nm. Matching name/numbers refer to samples from the same rat.

DETAILED DESCRIPTION

Figure 1:
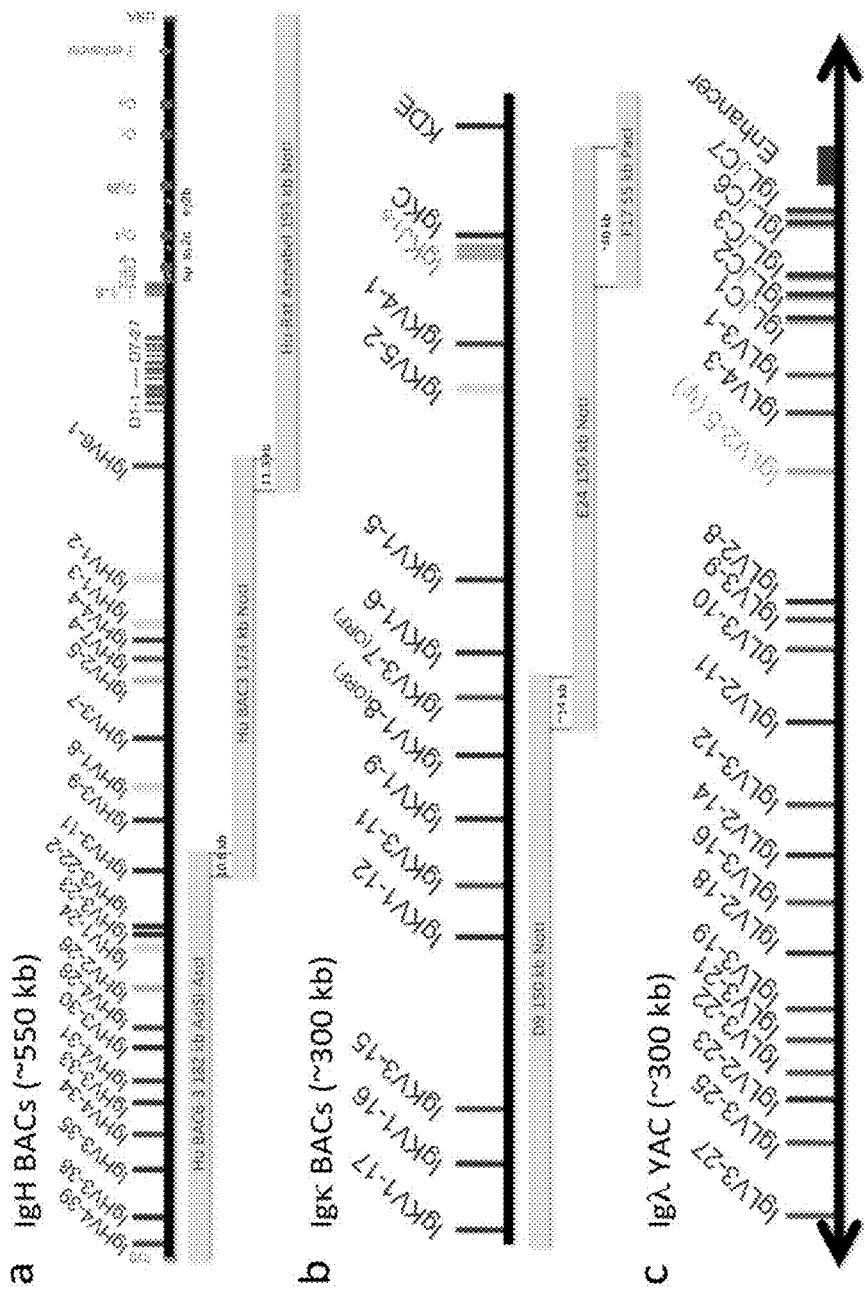
FIG. 1: Integrated human Ig loci. (a) The chimeric human-rat IgH region contains 3 overlapping BACs with 22 different and potentially functional human $V_H$ segments. BAC6-3 has been extended with $V_H$3-11 to provide a 10.6 kb overlap to BAC3, which overlaps 11.3 kb via $V_H$6-1 with the C region BAC Hu-Rat Annabel. The latter is chimeric and contains all human D and $J_H$ segments followed by the rat C region with full enhancer sequences. (b) The human Igκ BACs with 12 Vκs and all Jκs provide a ~14 kb overlap in the Vκ region and ~40 kb in Cκ to include the KDE. (c) The human Igl region with 17 Vls and all J-Cls, including the 3' enhancer, is from a YAC[33].
Figure 2A:
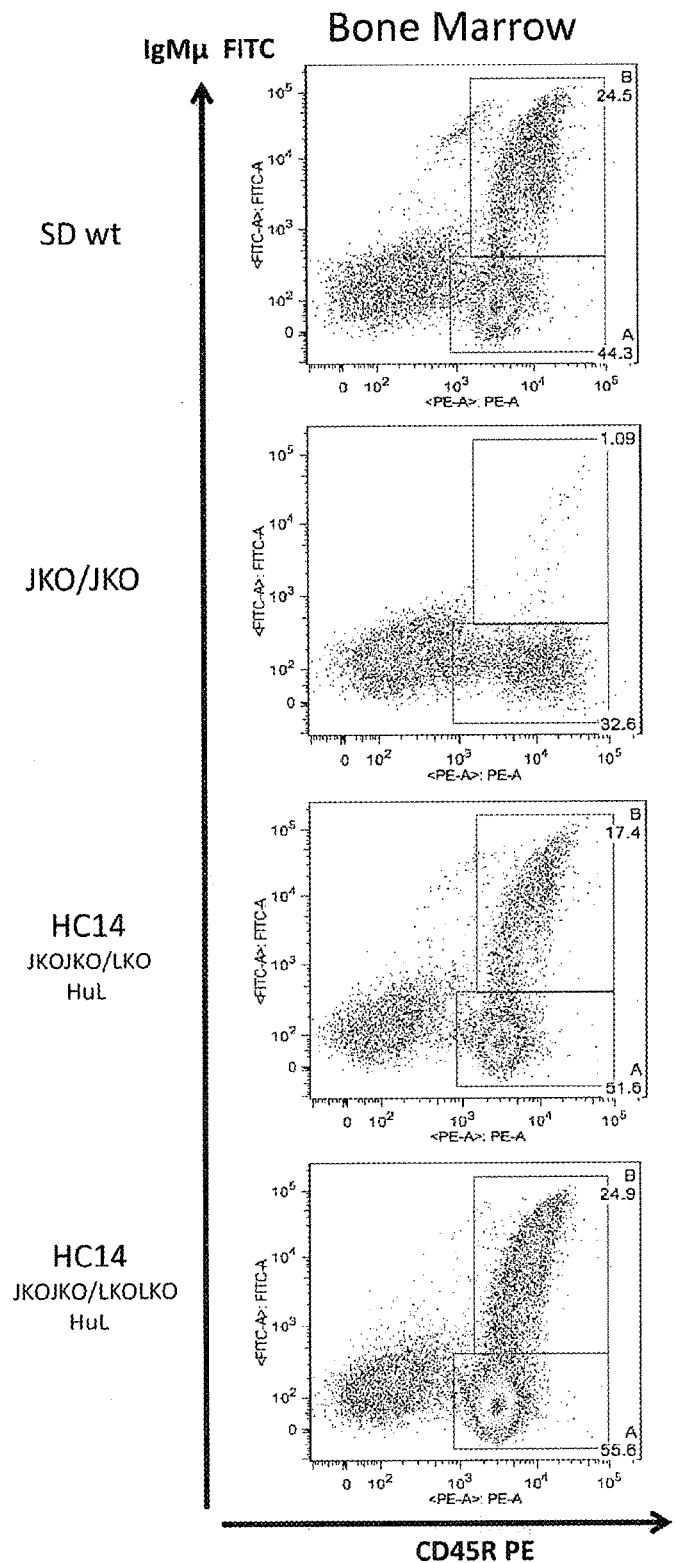
FIG. 2a-d: Flow cytometry analysis of lymphocyte-gated bone marrow and spleen cells from 3 months old rats. Surface staining for IgM and CD45R (B220) revealed a similar number of immature and mature B-cells in bone marrow and spleen of HC14 and wt rats, while JKO/JKO animals showed no B-cell development. Plotting forward (FSC) against site (SSC) scatter showed comparable numbers of lymphocyte (gated) populations, concerning size and shape. Surface staining of spleen cells with anti-IgG (G1, G2a, G2b, G2c isotype) plotted against cell count (×102) revealed near normal numbers of IgG+ expressers in HC14 rats compared to wt.
Figure 2B:
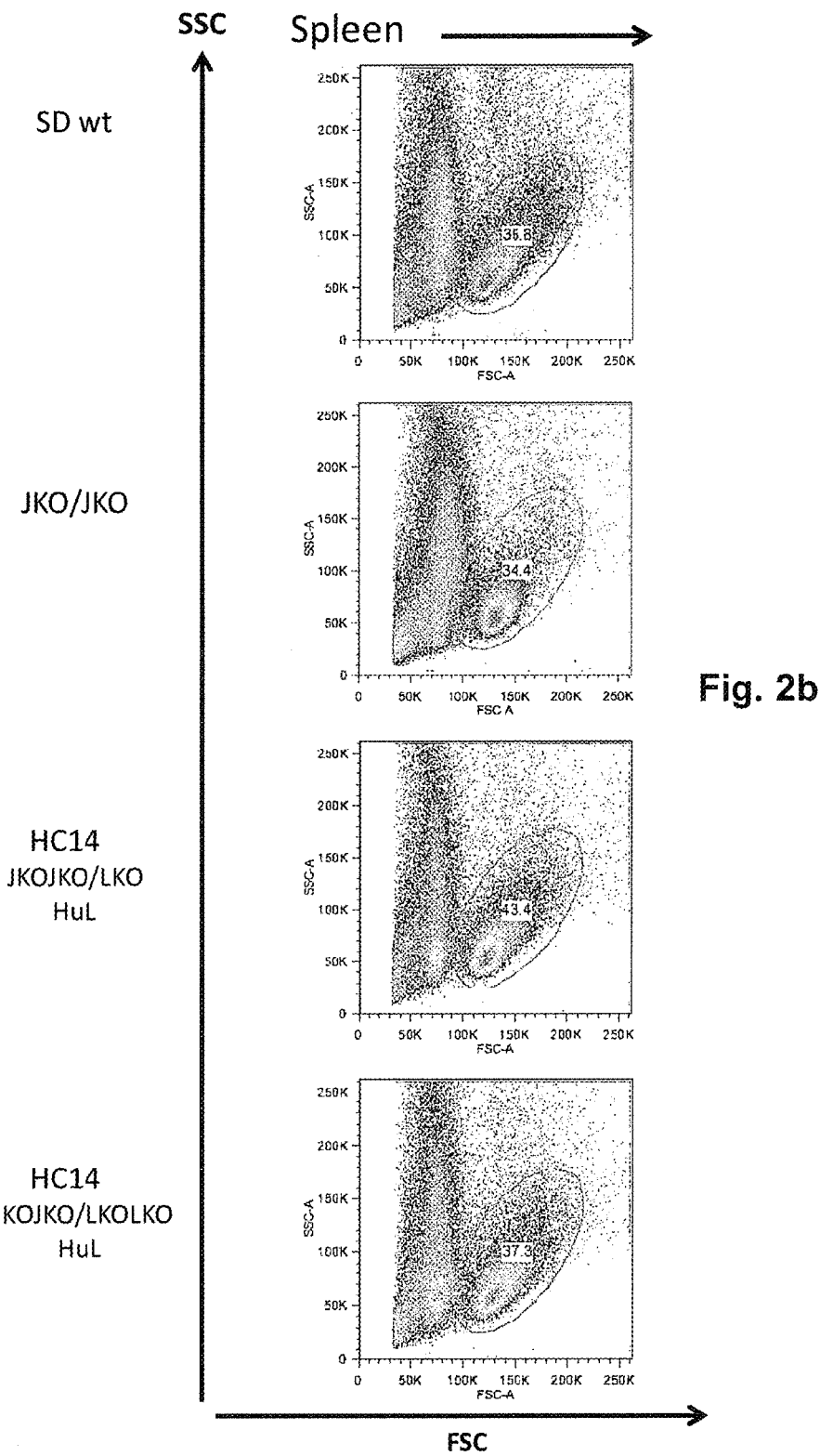
Figure 2C:
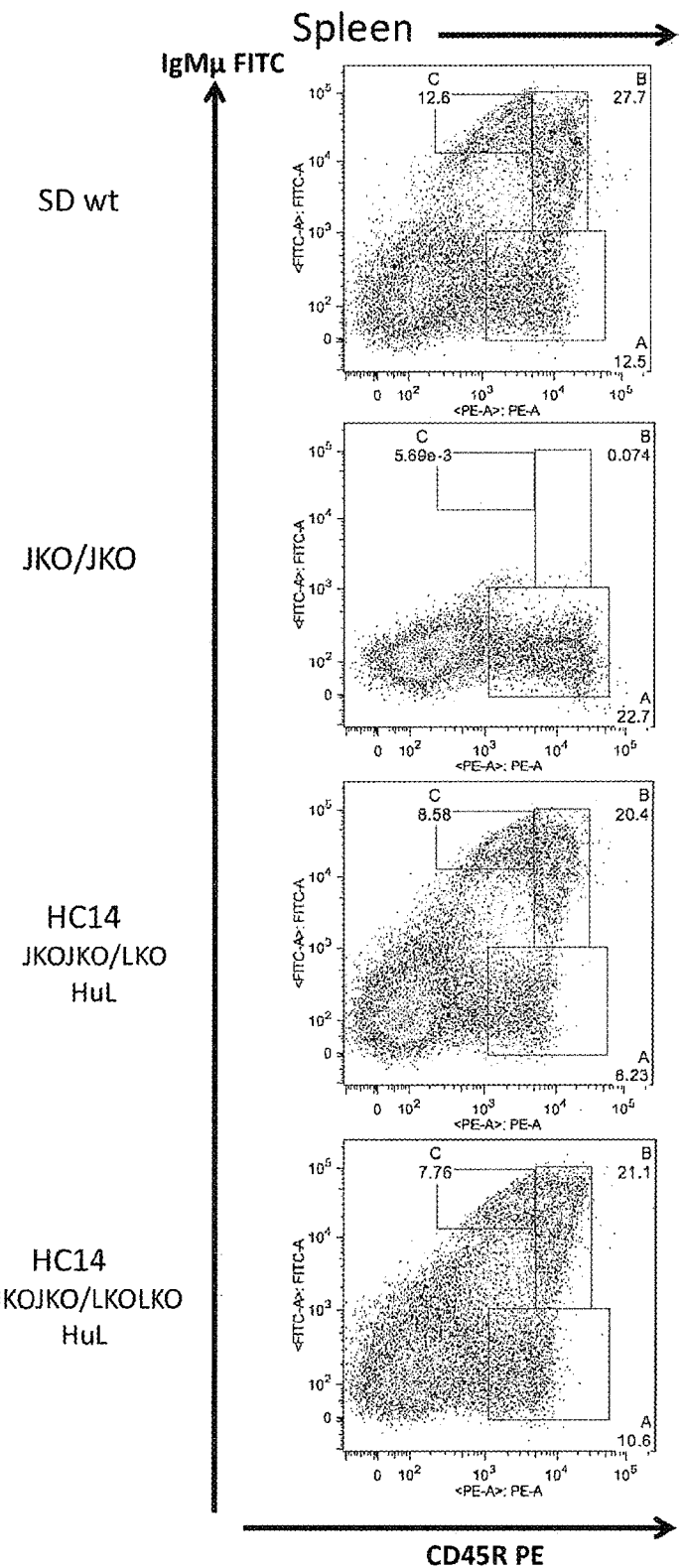
Figure 2D:
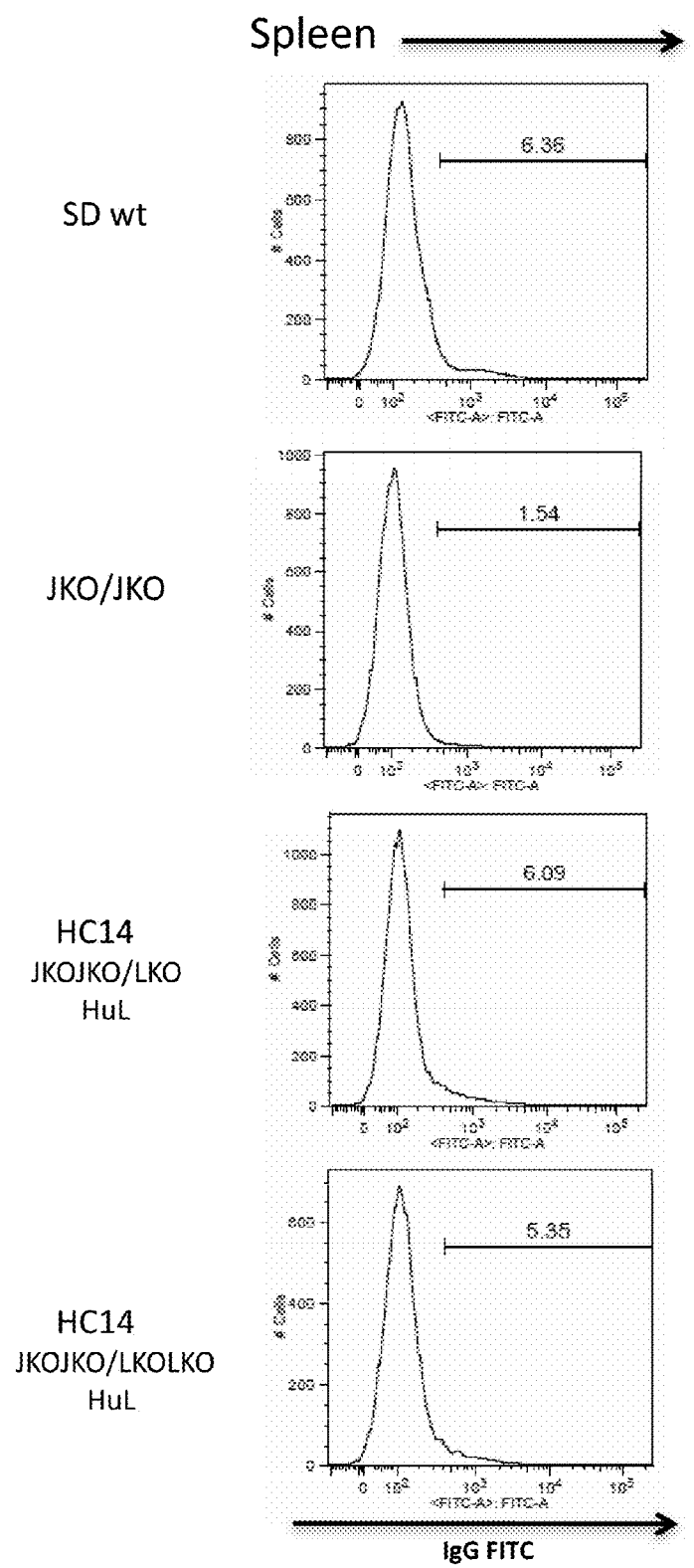

Provided herein are chimeric polynucleotides encoding a recombinant or artificial immunoglobulin chain or loci. As described above, the chimeric polynucleotides disclosed herein are useful for the transformation of rodents to include human Ig genes and for the production of immunoglobulins or antibodies having human idiotypes using such rodents.

Polynucleotides

Immunoglobulin refers to a protein consisting of one or more polypeptides substantially encoded by immunoglobulin genes. The recognized human immunoglobulin genes include the kappa, lambda, alpha (IgA1 and IgA2), gamma (IgG1, IgG2, IgG3, IgG4), delta, epsilon and mu constant region genes, as well as the myriad immunoglobulin variable region genes. Full-length immunoglobulin "light chains" (about 25 Kd, or 214 amino acids) generally comprise a variable domain encoded by an exon comprising one or more variable region gene(s) and one or more joining region gene(s) at the $NH_2$-terminus (about 110 amino acids) and constant domain encoded by a kappa or lambda constant region gene at the COOH-terminus. Full-length immunoglobulin "heavy chains" (about 50 Kd, or 446 amino acids), similarly comprise (1) a variable domain (about 116 amino acids) encoded by an exon comprising one or more variable region genes, one or more diversity region genes and one or more joining region genes, and (2) one of the aforementioned constant domains comprising one or more constant region genes, e.g., alpha, gamma, delta, epsilon or mu (encoding about 330 amino acids). The immunoglobulin heavy chain constant region genes encode for the antibody class, i.e., isotype (e.g., IgM or IgG1).

As used herein, the term "antibody" refers to a protein comprising at least one, and preferably two, heavy (H) chain variable domains (abbreviated herein as VH), and at least one and preferably two light (L) chain variable domains (abbreviated herein as VL). An ordinarily skilled artisan will recognize that the variable domain of an immunological chain is encoded in gene segments that must first undergo somatic recombination to form a complete exon encoding the variable domain. There are three types of regions or gene segments that undergo rearrangement to form the variable domain: the variable region comprising variable genes, the diversity region comprising diversity genes (in the case of an immunoglobulin heavy chain), and the joining region comprising joining genes. The VH and VL domains can be further subdivided into regions of hypervariability, termed "complementarity determining regions" ("CDRs") interspersed with regions that are more conserved, termed "framework regions" ("FRs"). The extent of the FRs and CDRs has been precisely defined (see, Kabat et al. (1991) Sequences of Proteins of Immunological Interest, Fifth Edition, U.S. Department of Health and Human Services, NIH Publication No. 91-3242; and Chothia et al. (1987) J. Mol. Biol. 196:901-17, which are hereby incorporated by reference). Each VH and VL domain is generally composed of three CDRs and four FRs, arranged from amino-terminus to carboxy-terminus in the following order: FR1, CDR1, FR2, CDR2, FR3, CDR3, FR4. The antigen binding fragment of an antibody (or simply "antibody portion," or "fragment"), as used herein, refers to one or more fragments of a full-length antibody that retain the ability to specifically bind to an antigen (e.g., CD3).

Examples of binding fragments encompassed within the term "antigen binding fragment" of an antibody include (i) an Fab fragment, a monovalent fragment consisting of the VL, VH, CL and CH1 domains; (ii) an $F(ab)_2$ fragment, a bivalent fragment comprising two Fab fragments linked by a disulfide bridge at the hinge region; (iii) an Fd fragment consisting of the VH and CH1 domains; (iv) an Fv fragment consisting of the VL and VH domains of a single arm of an antibody, (v) a dAb fragment (Ward et al. (1989) Nature 341:544-46), which consists of a VH domain; and (vi) an isolated complementarity determining region (CDR). Furthermore, although the two domains of the Fv fragment, VL and VH, are coded for by separate genes, they may be joined, using recombinant methods, by a synthetic linker that enables them to be made as a single protein chain in which the VL and VH regions pair to form monovalent molecules (known as single chain Fv (scFv); see, e.g., Bird et al. (1988) Science 242:423-26; and Huston et al. (1988) Proc. Natl. Acad. Sci. USA 85:5879-83). Such single chain antibodies are also intended to be encompassed within the term "antigen binding fragment" of an antibody. These antibody fragments are obtained using conventional techniques known to those skilled in the art, and the fragments are screened for utility in the same manner as are intact antibodies.

An antibody may further include a heavy and/or light chain constant domain to thereby form a heavy and light immunoglobulin chain, respectively. In one embodiment, the antibody is a tetramer of two heavy immunoglobulin chains and two light immunoglobulin chains, wherein the heavy and light immunoglobulin chains are interconnected, e.g., by disulfide bonds. The heavy chain constant domain is comprised of three gene segments, CH1, CH2 and CH3. The light chain constant domain is comprised of one gene, CL. The variable domains of the heavy and/or light chains contain a binding domain that interacts with an antigen. The constant domains of the antibodies typically mediate the binding of the antibody to host tissues or factors, including various cells of the immune system (e.g., effector cells) and the first component (C1q) of the classical complement system.

By polynucleotide encoding an artificial immunoglobulin locus or artificial immunoglobulin chain is meant an recombinant polynucleotide comprising multiple immunoglobulin regions, e.g., a variable (V) region or gene segment comprising V genes, a joining (J) gene region or gene segment comprising J genes, a diversity (D) region or gene segment comprising D genes in the case of a heavy chain locus and/or at least one constant (C) region comprising at least one C gene. Preferably, each region of the variable domain, e.g., V, D, or J region, comprises or spans at least two genes of the same type. For example a variable region as used herein comprises at least two variable genes, a joining region comprises at least two joining genes and a diversity region comprises two diversity genes. A constant region may comprise only one constant gene, e.g. a κ gene or λ gene, or multiple genes, e.g., CH1, CH2, and CH3.

"Enhancer sequences" or "enhancer" as used herein refers to sequences that have been identified near many active genes by nuclease digest and hypersensitivity to degradation. Hypersensitive sites may precede promoter sequences and the strength of their activity was correlated with the DNA sequence. Linkage to reporter genes showed elevated transcription if enhancer function was present (Mundt et al., J. Immunol., 166, 3315[2001]). In the IgH locus two important transcription or expression regulators have been identified, Eμ and the 3'E at the end of the locus (Pettersson et al., Nature, 344, 165 [1990]). In the mouse the removal of the whole 3' regulatory region (containing hs3a, hs1,2, hs3b and hs4) allows normal early B-cell development but abrogates class-switch recombination (Vincent-Fabert et al., Blood, 116, 1895 [2010]) and possibly prevents the optimization of somatic hypermutation (Pruzina et al., Protein Engineering, Design and Selection, 1, [2011]). The regulatory function to achieve optimal isotype expression is particularly desirable when transgenic human IgH genes are being used. Transgene constructs with incomplete 3'E region, usually only providing the hs1,2 element, led to disappointing expression levels in transgenic mice even when the endogenous IgH locus was knocked-out. As a consequence, only few antigen-specific fully human IgGs have been isolated from constructs produced in the last 20 years (Lonberg et al., Nature 368, 856 [1994]; Nicholson et al., J. Immunol., 163, 6898 [1999]; Davis et al., Cancer Metastasis Rev. 18, 421 [1999]; Pruzina et al., Protein Engineering, Design and Selection, 1, [2011]). In the rat IgH locus, the 3'E region has only been poorly analyzed. A comparison of mouse and rat sequences did not allow identification of hs4, the crucial 4th element with additional important regulatory sequences further downstream (Chatterjee et al., J. Biol. Chem., 286, 29303 [2011]). The polynucleotides of the present invention advantageously provide optimal expression due, at least in part, to the inclusion of a rat 3' enhancer since chimeric polynucleotides lacking this 3' enhancer result in impaired isotype switching and low IgG expression. In one embodiment, the rat 3' enhancer has a sequence comprising or substantially homologous to the sequence set forth as SEQ ID NO:1 or a portion thereof.

As used herein, a polynucleotide having a sequence comprising or substantially homologous to a portion, e.g., less than the entirety, of second sequence (e.g., SEQ ID NO:1, SEQ ID NO:2, etc.) preferably retains the biological activity of the second sequence (e.g., retains the biological activity of a 3' enhancer to provide optimal expression and/or isotype switching of immunoglobulins, is capable of rearrangement to provide a humanized chimeric heavy chain, etc.). In one embodiment, a nucleic acid comprising a sequence comprising or substantially homologous to a portion of SEQ ID NO:1 comprise at least 8 kB, preferably at least 10 kB of continuous nucleic acids that are substantially homologous to SEQ ID NO:1.

"Artificial Ig locus" as used herein may refer to polynucleotides that (e.g., a sequence comprising V-, D-, and/or J regions in the case of heavy chain, or V- and/or J regions in the case of light chain, and optionally a constant region for either or both a heavy and light chgin) that are unrearranged, partially rearranged, or rearranged. Artificial Ig loci include artificial Ig light chain loci and artificial Ig heavy chain loci. In one embodiment, an artificial immunoglobulin locus of the invention is functional and capable of rearrangement and producing a repertoire of immunoglobulin chains. In a preferred embodiment, the variable domain or portion thereof of a polynucleotide disclosed herein comprises genes in natural configuration, i.e., naturally occurring sequences of an human Ig gene segment, degenerate forms of naturally occurring sequences of a human Ig gene segment, as well as synthetic sequences that encode a polypeptide sequence substantially identical to the polypeptide encoded by a naturally occurring sequence of a human Ig gene segment. In another preferred embodiment, the polynucleotide comprises a variable domain or portion thereof in a natural configuration found in humans. For example, a polynucleotide encoding an artificial Ig heavy chain as disclosed herein may comprise in natural configuration at least two human V genes, at least two D genes, at least two J genes or a combination thereof.

In a preferred embodiment, an artificial Ig locus comprises a non-human C region gene and is capable of producing a repertoire of immunoglobulins including chimeric immunoglobulins having a non-human C region. In one embodiment, an artificial Ig locus comprises a human C region gene and is capable of producing a repertoire of immunoglobulins including immunoglobulins having a human C region. In one embodiment, an artificial Ig locus comprises an "artificial constant region gene", by which is meant a constant region gene comprising nucleotide sequences derived from human and non-human constant regions genes. For example, an exemplary artificial C constant region gene is a constant region gene encoding a human IgG CH1 domain and rat IgG CH2 and CH3 domain.

In a preferred embodiment, an artificial Ig locus comprises 3' enhancer sequences, including hs1,2, hs3a, hs3b and sequences (500-2500 nt) downstream of hs3b. In transgenic animals, artificial loci comprising the full ~30 kb 3'E region from Calpha to 3' hs3b result in high level IgG expression, extensive hypermutation and large numbers of antigen-specific hybridomas of high (pM) affinity. However, shorter enhancer sequences reduce Ig expression.

In a preferred embodiment, an artificial Ig locus comprises the 3' enhancer sequence shown in FIG. 1a. This sequence is derived from the rat Ig heavy chain locus and contains about 30 kb of the 3' region from Calapha to 3' hs3b. The sequence of the rat 3' enhancer sequence is set forth as SEQ ID NO:1. In another embodiment, the artificial Ig locus comprises a sequence comprising or substantially homologous to the sequence set forth as SEQ ID NO:1, or a portion thereof.

In some embodiments, an artificial Ig heavy chain locus lacks CH1, or an equivalent sequence that allows the resultant immunoglobulin to circumvent the typical immunoglobulin: chaperone association. Such artificial loci provide for the production of heavy chain-only antibodies in transgenic animals which lack a functional Ig light chain locus and hence do not express functional Ig light chain. Such artificial Ig heavy chain loci are used in methods contemplated herein to produce transgenic animals lacking a functional Ig light chain locus, and comprising an artificial Ig heavy chain locus, which animals are capable of producing heavy chain-only antibodies. Alternatively, an artificial Ig locus may be manipulated in situ to disrupt CH1 or an equivalent region and generate an artificial Ig heavy chain locus that provides for the production of heavy chain-only antibodies. Regarding the production of heavy chain-only antibodies in light chain-deficient mice, see for example Zou et al., JEM, 204:3271-3283, 2007.

By "human idiotype" is meant a polypeptide sequence present on a human antibody encoded by an immunoglobulin V-gene segment. The term "human idiotype" as used herein includes both naturally occurring sequences of a human antibody, as well as synthetic sequences substantially identical to the polypeptide found in naturally occurring human antibodies. By "substantially" is meant that the degree of amino acid sequence identity is at least about 85%-95%. Preferably, the degree of amino acid sequence identity is greater than 90%, more preferably greater than 95%.

By a "chimeric antibody" or a "chimeric immunoglobulin" is meant an immunoglobulin molecule comprising a portion of a human immunoglobulin polypeptide sequence (or a polypeptide sequence encoded by a human Ig gene segment) and a portion of a non-human immunoglobulin polypeptide sequence. The chimeric immunoglobulin molecules of the present invention are immunoglobulins with non-human Fc-regions or artificial Fc-regions, and human idiotypes. Such immunoglobulins can be isolated from animals of the invention that have been engineered to produce chimeric immunoglobulin molecules.

By "artificial Fc-region" is meant an Fc-region encoded by an artificial constant region gene.

The term "Ig gene segment" as used herein refers to regions of DNA encoding various portions of an Ig molecule, which are present in the germline of non-human animals and humans, and which are brought together in B cells to form rearranged Ig genes. Thus, Ig gene segments as used herein include V gene segments, D gene segments, J gene segments and C gene segments.

The term "human Ig gene segment" as used herein includes both naturally occurring sequences of a human Ig gene segment, degenerate forms of naturally occurring sequences of a human Ig gene segment, as well as synthetic sequences that encode a polypeptide sequence substantially identical to the polypeptide encoded by a naturally occurring sequence of a human Ig gene segment. By "substantially" is meant that the degree of amino acid sequence identity is at least about 85%-95%. Preferably, the degree of amino acid sequence identity is greater than 90%, more preferably greater than 95%

Polynucleotides related to the present invention may comprise DNA or RNA and may be wholly or partially synthetic. Reference to a nucleotide sequence as set out herein encompasses a DNA molecule with the specified sequence, and encompasses an RNA molecule with the specified sequence in which U is substituted for T, unless context requires otherwise.

Calculations of "homology" or "sequence identity" between two sequences (the terms are used interchangeably herein) are performed as follows. The sequences are aligned for optimal comparison purposes (e.g., gaps can be introduced in one or both of a first and a second amino acid or nucleic acid sequence for optimal alignment and non-homologous sequences can be disregarded for comparison purposes). In a preferred embodiment, the length of a reference sequence aligned for comparison purposes is at least 30%, preferably at least 40%, more preferably at least 50%, even more preferably at least 60%, and even more preferably at least 70%, 80%, 90%, 100% of the length of the reference sequence. The amino acid residues or nucleotides at corresponding amino acid positions or nucleotide positions are then compared. When a position in the first sequence is occupied by the same amino acid residue or nucleotide as the corresponding position in the second sequence, then the molecules are identical at that position (as used herein amino acid or nucleic acid "identity" is equivalent to amino acid or nucleic acid "homology"). The percent identity between the two sequences is a function of the number of identical positions shared by the sequences, taking into account the number of gaps, and the length of each gap, which need to be introduced for optimal alignment of the two sequences.

The comparison of sequences and determination of percent sequence identity between two sequences may be accomplished using a mathematical algorithm. In a preferred embodiment, the percent identity between two amino acid sequences is determined using the Needleman and Wunsch ((1970) J. Mol. Biol. 48:444-53) algorithm, which has been incorporated into the GAP program in the GCG software package (available online at gcg.com), using either a Blossum 62 matrix or a PAM250 matrix, and a gap weight of 16, 14, 12, 10, 8, 6, or 4 and a length weight of 1, 2, 3, 4, 5, or 6. In yet another preferred embodiment, the percent identity between two nucleotide sequences is determined using the GAP program in the GCG software package (available at www.gcg.com), using a NWSgapdna.CMP matrix and a gap weight of 40, 50, 60, 70, or 80 and a length weight of 1, 2, 3, 4, 5, or 6. A particularly preferred set of parameters (and the one that should be used if the practitioner is uncertain about what parameters should be applied to determine if a molecule is within a sequence identity or homology limitation of the invention) is a Blossum 62 scoring matrix with a gap penalty of 12, a gap extend penalty of 4, and a frameshift gap penalty of 5. The percent identity between two amino acid or nucleotide sequences can also be determined using the algorithm of Meyers and Miller ((1989) CABIOS 4:11-17), which has been incorporated into the ALIGN program (version 2.0), using a PAM120 weight residue table, a gap length penalty of 12 and a gap penalty of 4.

Artificial Ig Loci

The present invention is further directed to artificial Ig loci and their use in making transgenic animals capable of producing immunoglobulins having a human idiotype. Each artificial Ig locus comprises multiple immunoglobulin gene segments, which include at least one V region gene segment, one or more J gene segments, one or more D gene segments in the case of a heavy chain locus, and one or more constant region genes. In the present invention, at least one of the V gene segments encodes a germline or hypermutated human V-region amino acid sequence. Accordingly, such transgenic animals have the capacity to produce a diversified repertoire of immunoglobulin molecules, which include antibodies having a human idiotype. In heavy chain loci human or non-human-derived D-gene segments may be included in the artificial Ig loci. The gene segments in such loci are juxtaposed with respect to each other in an unrearranged configuration (or "the germline configuration"), or in a partially or fully rearranged configuration. The artificial Ig loci have the capacity to undergo gene rearrangement (if the gene segments are not fully rearranged) in the subject animal thereby producing a diversified repertoire of immunoglobulins having human idiotypes.

Regulatory elements like promoters, enhancers, switch regions, recombination signals, and the like may be of human or non-human origin. What is required is that the elements be operable in the animal species concerned, in order to render the artificial loci functional. Preferred regulatory elements are described in more detail herein.

In one aspect, the invention provides transgenic constructs containing an artificial heavy chain locus capable of undergoing gene rearrangement in the host animal thereby producing a diversified repertoire of heavy chains having human idiotypes. An artificial heavy chain locus of the transgene contains a V-region with at least one human V gene segment. Preferably, the V-region includes at least about 5-100 human heavy chain V (or "VH") gene segments. As described above, a human VH segment encompasses naturally occurring sequences of a human VH gene segment, degenerate forms of naturally occurring sequences of a human VH gene segment, as well as synthetic sequences that encode a polypeptide sequence substantially (i.e., at least about 85%-95%) identical to a human heavy chain V domain polypeptide.

In a preferred embodiment, the artificial heavy chain locus contains at least one or several rat constant region genes, e.g., Cδ, Cμ and Cγ (including any of the Cγ subclasses).

In another preferred embodiment, the artificial heavy chain locus contains artificial constant region genes. In a preferred embodiment, such artificial constant region genes encode a human CH1 domain and rat CH2 CH3 domains, or a human CH1 and rat CH2, CH3 and CH4 domains. A hybrid heavy chain with a human CH1 domain pairs effectively with a fully human light chain.

In a preferred embodiment, an artificial Ig locus comprises 3' enhancer sequences, including hs1,2, hs3a, hs3b and sequences between rat Calpha and 3'hs3b.

In another preferred embodiment, the artificial heavy chain locus contains artificial constant region genes lacking CH1 domains In a preferred embodiment, such artificial constant region genes encode truncated IgM and/or IgG lacking the CH1 domain but comprising CH2, and CH3, or CH1, CH2, CH3 and CH4 domains. Heavy chains lacking CH1 domains cannot pair effectively with Ig light chains and form heavy chain only antibodies.

In another aspect, the invention provides transgenic constructs containing an artificial light chain locus capable of undergoing gene rearrangement in the host animal thereby producing a diversified repertoire of light chains having human idiotypes. An artificial light chain locus of the transgene contains a V-region with at least one human V gene segment, e.g., a V-region having at least one human VL gene and/or at least one rearranged human VJ segment. Preferably, the V-region includes at least about 5-100 human light chain V (or "VL") gene segments. Consistently, a human VL segment encompasses naturally occurring sequences of a human VL gene segment, degenerate forms of naturally occurring sequences of a human VL gene segment, as well as synthetic sequences that encode a polypeptide sequence substantially (i.e., at least about 85%-95%) identical to a human light chain V domain polypeptide. In one embodiment, the artificial light chain Ig locus has a C-region having at least one rat C gene (e.g., rat Cλ or Cκ).

Another aspect of the present invention is directed to methods of making a transgenic vector containing an artificial Ig locus. Such methods involve isolating Ig loci or fragments thereof, and combining the same, with one or several DNA fragments comprising sequences encoding human V region elements. The Ig gene segment(s) are inserted into the artificial Ig locus or a portion thereof by ligation or homologous recombination in such a way as to retain the capacity of the locus to undergo effective gene rearrangement in the subject animal.

Preferably, a non-human Ig locus is isolated by screening a library of plasmids, cosmids, YACs or BACs, and the like, prepared from the genomic DNA of the same. YAC clones can carry DNA fragments of up to 2 megabases, thus an entire animal heavy chain locus or a large portion thereof can be isolated in one YAC clone, or reconstructed to be contained in one YAC clone. BAC clones are capable of carrying DNA fragments of smaller sizes (about 50-500 kb). However, multiple BAC clones containing overlapping fragments of an Ig locus can be separately altered and subsequently injected together into an animal recipient cell, wherein the overlapping fragments recombine in the recipient animal cell to generate a continuous Ig locus.

Human Ig gene segments can be integrated into the Ig locus on a vector (e.g., a BAC clone) by a variety of methods, including ligation of DNA fragments, or insertion of DNA fragments by homologous recombination. Integration of the human Ig gene segments is done in such a way that the human Ig gene segment is operably linked to the host animal sequence in the transgene to produce a functional humanized Ig locus, i.e., an Ig locus capable of gene rearrangement which lead to the production of a diversified repertoire of antibodies with human idiotypes. Homologous recombination can be performed in bacteria, yeast and other cells with a high frequency of homologous recombination events. Engineered YACs and BACs can be readily isolated from the cells and used in making transgenic animals Rodent Oocytes and Transgenic Animals Comprising Artificial Ig Loci and Capable of Producing Antibodies Having Human Idiotypes In one aspect, the invention provides transgenic animals capable of producing immunoglobulins having human idiotypes, as well as methods of making the same.

The transgenic animals used are selected from rodents (e.g., rats, hamsters, mice and guinea pigs).

The transgenic animals used for humanized antibody production in the invention carry germline mutations in endogenous Ig loci. In a preferred embodiment, the transgenic animals are homozygous for mutated endogenous Ig heavy chain and/or endogenous Ig light chain genes. Further, these animals carry at least one artificial Ig locus that is functional and capable of producing a repertoire of immunoglobulin molecules in the transgenic animal. The artificial Ig loci used in the invention include at least one human V gene segment.

In a preferred embodiment, the transgenic animals carry at least one artificial Ig heavy chain locus and at least one artificial Ig light chain locus that are each functional and capable of producing a repertoire of immunoglobulin molecules in the transgenic animal, which repertoire of immunoglobulin molecules includes antibodies having a human idiotype. In one embodiment, artificial loci including at least one non-human C gene are used, and animals capable of producing chimeric antibodies having a human idiotype and non-human constant region are provided. In one embodiment, artificial loci including at least one human C gene are used, and animals capable of producing antibodies having a human idiotype and human constant region are provided.

In another preferred embodiment, the transgenic animals carry at least one artificial Ig heavy chain locus, and lack a functional Ig light chain locus. Such animals find use in the production of heavy chain-only antibodies.

Production of such transgenic animals involves the integration of one or more artificial heavy chain Ig loci and one or more artificial light chain Ig loci into the genome of a transgenic animal having at least one endogenous Ig locus that has been or will be inactivated by the action of one or more meganucleases. Preferably, the transgenic animals are nullizygous for endogenous Ig heavy chain and/or endogenous Ig light chain and, accordingly, incapable of producing endogenous immunoglobulins. Regardless of the chromosomal location, an artificial Ig locus of the present invention has the capacity to undergo gene rearrangement and thereby produce a diversified repertoire of immunoglobulin molecules. An Ig locus having the capacity to undergo gene rearrangement is also referred to herein as a "functional" Ig locus, and the antibodies with a diversity generated by a functional Ig locus are also referred to herein as "functional" antibodies or a "functional" repertoire of antibodies.

The artificial loci used to generate such transgenic animals each include multiple immunoglobulin gene segments, which include at least one V region gene segment, one or more J gene segments, one or more D gene segments in the case of a heavy chain locus, and one or more constant region genes. In the present invention, at least one of the V gene segments encodes a germline or hypermutated human V-region amino acid sequence. Accordingly, such transgenic animals have the capacity to produce a diversified repertoire of immunoglobulin molecules, which include antibodies having a human idiotype.

In one embodiment, the artificial loci used comprise at least one non-human C region gene segment. Accordingly, such transgenic animals have the capacity to produce a diversified repertoire of immunoglobulin molecules, which include chimeric antibodies having a human idiotype.

In one embodiment, the artificial loci used comprise at least one human C region gene segment. Accordingly, such transgenic animals have the capacity to produce a diversified repertoire of immunoglobulin molecules, which include antibodies having a human idiotype and a human constant region.

In one embodiment, the artificial loci used comprise at least one artificial constant region gene. For example, an exemplary artificial C constant region gene is a constant region gene encoding a human IgG CH1 domain and rat IgG CH2 and CH3 domain. Accordingly, such transgenic animals have the capacity to produce a diversified repertoire of immunoglobulin molecules, which include antibodies having a human idiotype and an artificial constant region comprising both human and non-human components.

The transgenic vector containing an artificial Ig locus is introduced into the recipient cell or cells and then integrated into the genome of the recipient cell or cells by random integration or by targeted integration.

For random integration, a transgenic vector containing an artificial Ig locus can be introduced into a recipient cell by standard transgenic technology. For example, a transgenic vector can be directly injected into the pronucleus of a fertilized oocyte. A transgenic vector can also be introduced by co-incubation of sperm with the transgenic vector before fertilization of the oocyte. Transgenic animals can be developed from fertilized oocytes. Another way to introduce a transgenic vector is by transfecting embryonic stem cells or other pluripotent cells (for example primordial germ cells) and subsequently injecting the genetically modified cells into developing embryos. Alternatively, a transgenic vector (naked or in combination with facilitating reagents) can be directly injected into a developing embryo. Ultimately, chimeric transgenic animals are produced from the embryos which contain the artificial Ig transgene integrated in the genome of at least some somatic cells of the transgenic animal. In another embodiment, the transgenic vector is introduced into the genome of a cell and an animal is derived from the transfected cell by nuclear transfer cloning.

In a preferred embodiment, a transgene containing an artificial Ig locus is randomly integrated into the genome of recipient cells (such as fertilized oocyte or developing embryos). In a preferred embodiment, offspring that are nullizygous for endogenous Ig heavy chain and/or Ig light chain and, accordingly, incapable of producing endogenous immunoglobulins and capable of producing transgenic immunoglobulins are obtained.

For targeted integration, a transgenic vector can be introduced into appropriate recipient cells such as embryonic stem cells, other pluripotent cells or already differentiated somatic cells. Afterwards, cells in which the transgene has integrated into the animal genome can be selected by standard methods. The selected cells may then be fused with enucleated nuclear transfer unit cells, e.g. oocytes or embryonic stem cells, cells which are totipotent and capable of forming a functional neonate. Fusion is performed in accordance with conventional techniques which are well established. See, for example, Cibelli et al., Science (1998) 280:1256; Zhou et al. Science (2003) 301: 1179. Enucleation of oocytes and nuclear transfer can also be performed by microsurgery using injection pipettes. (See, for example, Wakayama et al., Nature (1998) 394:369.) The resulting cells are then cultivated in an appropriate medium, and transferred into synchronized recipients for generating transgenic animals. Alternatively, the selected genetically modified cells can be injected into developing embryos which are subsequently developed into chimeric animals.

In one embodiment, a meganuclease is used to increase the frequency of homologous recombination at a target site through double-strand DNA cleavage. For integration into a specific site, a site specific meganuclease may be used. In one embodiment, a meganuclease targeting an endogenous Ig locus is used to increase the frequency of homologous recombination and replacement of an endogenous Ig locus, or parts thereof with an artificial Ig locus, or parts thereof. In one embodiment, the transgenic animal lacks a functional Ig light chain locus and comprises an artificial Ig heavy chain locus.

Immunoglobulins Having a Human Idiotype

Once a transgenic animal capable of producing immunoglobulins having a human idiotype is made, immunoglobulins and antibody preparations against an antigen can be readily obtained by immunizing the animal with the antigen. "Polyclonal antisera composition" as used herein includes affinity purified polyclonal antibody preparations.

A variety of antigens can be used to immunize a transgenic animal. Such antigens include but are not limited to, microorganisms, e.g. viruses and unicellular organisms (such as bacteria and fungi), alive, attenuated or dead, fragments of the microorganisms, or antigenic molecules isolated from the microorganisms.

Preferred bacterial antigens for use in immunizing an animal include purified antigens from *Staphylococcus aureus* such as capsular polysaccharides type 5 and 8, recombinant versions of virulence factors such as alpha-toxin, adhesin binding proteins, collagen binding proteins, and fibronectin binding proteins. Preferred bacterial antigens also include an attenuated version of *S. aureus, Pseudomonas aeruginosa, enterococcus, enterobacter*, and *Klebsiella pneumoniae*, or culture supernatant from these bacteria cells. Other bacterial antigens which can be used in immunization include purified lipopolysaccharide (LPS), capsular antigens, capsular polysaccharides and/or recombinant versions of the outer membrane proteins, fibronectin binding proteins, endotoxin, and exotoxin from *Pseudomonas aeruginosa, enterococcus, enterobacter*, and *Klebsiella pneumoniae*.

Preferred antigens for the generation of antibodies against fungi include attenuated version of fungi or outer membrane proteins thereof, which fungi include, but are not limited to, *Candida albicans, Candida parapsilosis, Candida tropicalis*, and *Cryptococcus neoformans*.

Preferred antigens for use in immunization in order to generate antibodies against viruses include the envelop proteins and attenuated versions of viruses which include, but are not limited to respiratory synctial virus (RSV) (particularly the F-Protein), Hepatitis C virus (HCV), Hepatits B virus (HBV), cytomegalovirus (CMV), EBV, and HSV.

Antibodies specific for cancer can be generated by immunizing transgenic animals with isolated tumor cells or tumor cell lines as well as tumor-associated antigens which include, but are not limited to, Her-2-neu antigen (antibodies against which are useful for the treatment of breast cancer); CD20, CD22 and CD53 antigens (antibodies against which are useful for the treatment of B cell lymphomas), prostate specific membrane antigen (PMSA) (antibodies against which are useful for the treatment of prostate cancer), and 17-1A molecule (antibodies against which are useful for the treatment of colon cancer).

The antigens can be administered to a transgenic animal in any convenient manner, with or without an adjuvant, and can be administered in accordance with a predetermined schedule.

For making a monoclonal antibody, spleen cells are isolated from the immunized transgenic animal and used either in cell fusion with transformed cell lines for the production of hybridomas, or cDNAs encoding antibodies are cloned by standard molecular biology techniques and expressed in transfected cells. The procedures for making monoclonal antibodies are well established in the art. See, e.g., European Patent Application 0 583 980 A1 ("Method For Generating Monoclonal Antibodies From Rabbits"), U.S. Pat. No. 4,977,081 ("Stable Rabbit-Mouse Hybridomas And Secretion Products Thereof"), WO 97/16537 ("Stable Chicken B-cell Line And Method of Use Thereof"), and EP 0 491 057 B1 ("Hybridoma Which Produces Avian Specific Immunoglobulin G"), the disclosures of which are incorporated herein by reference. In vitro production of monoclonal antibodies from cloned cDNA molecules has been described by Andris-Widhopf et al., "Methods for the generation of chicken monoclonal antibody fragments by phage display", J Immunol Methods 242:159 (2000), and by Burton, D. R., "Phage display", Immunotechnology 1:87 (1995).

Once chimeric monoclonal antibodies with human idiotypes have been generated, such chimeric antibodies can be easily converted into fully human antibodies using standard molecular biology techniques. Fully human monoclonal antibodies are not immunogenic in humans and are appropriate for use in the therapeutic treatment of human subjects.

Antibodies of the Invention Include Heavy Chain-Only Antibodies

In one embodiment, transgenic animals which lack a functional Ig light chain locus, and comprising an artificial heavy chain locus, are immunized with antigen to produce heavy chain-only antibodies that specifically bind to antigen.

In one embodiment, the invention provides monoclonal antibody producing cells derived from such animals, as well as nucleic acids derived therefrom. Also provided are hybridomas derived therefrom. Also provided are fully human heavy chain-only antibodies, as well as encoding nucleic acids, derived therefrom.

Teachings on heavy chain-only antibodies are found in the art. For example, see PCT publications WO02085944, WO02085945, WO2006008548, and WO2007096779. See also U.S. Pat. No. 5,840,526; U.S. Pat. No. 5,874,541; U.S. Pat. No. 6,005,079; U.S. Pat. No. 6,765,087; U.S. Pat. No. 5,800,988; EP 1589107; WO 9734103; and U.S. Pat. No. 6,015,695.

Pharmaceutical Compositions

In a further embodiment of the present invention, purified monoclonal or polyclonal antibodies are admixed with an appropriate pharmaceutical carrier suitable for administration to patients, to provide pharmaceutical compositions.

Patients treated with the pharmaceutical compositions of the invention are preferably mammals, more preferably humans, though veterinary uses are also contemplated.

Pharmaceutically acceptable carriers which can be employed in the present pharmaceutical compositions can be any and all solvents, dispersion media, isotonic agents and the like. Except insofar as any conventional media, agent, diluent or carrier is detrimental to the recipient or to the therapeutic effectiveness of the antibodies contained therein, its use in the pharmaceutical compositions of the present invention is appropriate.

The carrier can be liquid, semi-solid, e.g. pastes, or solid carriers. Examples of carriers include oils, water, saline solutions, alcohol, sugar, gel, lipids, liposomes, resins, porous matrices, binders, fillers, coatings, preservatives and the like, or combinations thereof.

Methods of Treatment

In a further aspect of the present invention, methods are provided for treating a disease in a vertebrate, preferably a mammal, preferably a primate, with human subjects being an especially preferred embodiment, by administering a purified antibody composition of the invention desirable for treating such disease.

The antibody compositions can be used to bind and neutralize or modulate an antigenic entity in human body tissues that causes or contributes to disease or that elicits undesired or abnormal immune responses. An "antigenic entity" is herein defined to encompass any soluble or cell surface bound molecules including proteins, as well as cells or infectious disease-causing organisms or agents that are at least capable of binding to an antibody and preferably are also capable of stimulating an immune response.

Administration of an antibody composition against an infectious agent as a monotherapy or in combination with chemotherapy results in elimination of infectious particles. A single administration of antibodies decreases the number of infectious particles generally 10 to 100 fold, more commonly more than 1000-fold. Similarly, antibody therapy in patients with a malignant disease employed as a monotherapy or in combination with chemotherapy reduces the number of malignant cells generally 10 to 100 fold, or more than 1000-fold. Therapy may be repeated over an extended amount of time to assure the complete elimination of infectious particles, malignant cells, etc. In some instances, therapy with antibody preparations will be continued for extended periods of time in the absence of detectable amounts of infectious particles or undesirable cells.

Similarly, the use of antibody therapy for the modulation of immune responses may consist of single or multiple administrations of therapeutic antibodies. Therapy may be continued for extended periods of time in the absence of any disease symptoms.

The subject treatment may be employed in conjunction with chemotherapy at dosages sufficient to inhibit infectious disease or malignancies. In autoimmune disease patients or transplant recipients, antibody therapy may be employed in conjunction with immunosuppressive therapy at dosages sufficient to inhibit immune reactions.

Examples

In mice transgenic for human immunoglobulin (Ig) loci, suboptimal efficacy in delivery of fully human antibodies has been attributed to imperfect interaction between the constant regions of human membrane IgH chains and the mouse cellular signaling machinery. To obviate this problem, we here describe a humanized rat strain (OmniRat™) carrying a chimeric human/rat IgH locus [comprising 22 human $V_H$s, all human D and $J_H$ segments in natural configuration but linked to the rat $C_H$ locus] together with fully human light-chain loci [12 Vκs linked to Jκ-CK and 16 Vλs linked to Jλ-Cλ]. The endogenous rat Ig loci were silenced by designer zinc finger nucleases. Following immunization, OmniRats perform as efficiently as normal rats in yielding high affinity serum IgG. Monoclonal antibodies, comprising fully human variable regions with sub-nanomolar antigen affinity and carrying extensive somatic mutations, are readily obtainable—similarly to the yield of conventional antibodies from normal rats.

Materials and Methods

Construction of Modified Human Ig Loci on YACs and BACs a) IgH Loci

The human IgH V genes were covered by 2 BACs: BAC6-VH3-11 containing the authentic region spanning from VH4-39 to VH3-23 followed by VH3-11 (modified from a commercially available BAC clone 3054M17 CITB) and BAC3 containing the authentic region spanning from VH3-11 to VH6-1 (811L16 RPCI-11). A BAC termed Annabel was constructed by joining rat CH region genes immediately downstream of the human VH6-1-Ds-JHs region (FIG. 1). All BAC clones containing part of the human or rat IgH locus were purchased from Invitrogen.

Both BAC6-VH3-11 and Annabel were initially constructed in S. cerevisiae as circular YACs (cYACs) and further checked and maintained in E. coli as BACs. Construction details can be found at www.ratltd.net.

Unlike YACs, BAC plasmid preps yield large quantities of the desired DNA. To convert a linear YAC into a cYAC or to assemble DNA fragments with overlapping ends into a single cYAC in S. cerevisiae, which can also be maintained as a BAC in E. coli, two self-replicating S. cerevisiae/E. coli shuttle vectors, pBelo-CEN-URA, and pBelo-CEN-HYG were constructed. Briefly, S. cerevisiae CEN4 was cut out as an AvrII fragment from pYAC-RC[39] and ligated to SpeI— linearised pAP599[40]. The resulting plasmid contains CEN4 cloned in between S. cerevisiae URA3 and a hygromycin-resistance expression cassette (HygR). From this plasmid, an ApaLI-BamHI fragment containing URA3 followed by CEN4 or a PmlI-SphI fragment containing CEN4 followed by HygR was cut out, and ligated to ApaLI and BamHI or HpaI and SphI doubly digested pBACBelo11 (New England Biolabs) to yield pBelo-CEN-URA and pBelo-CEN-HYG.

To construct BAC6-VH3-11, initially two fragments, a 115 kb NotI-PmeI and a 110 kb RsrII-SgrAI, were cut out from the BAC clone 3054M17 CITB. The 3' end of the former fragment overlaps 22 kb with the 5' end of the latter. The NotI-PmeI fragment was ligated to a NotI-BamHI YAC arm containing S. cerevisiae CEN4 as well as TRP1/ARS1 from pYAC-RC, and the RsrII-SgrAI fragment was ligated to a SgrAI-BamHI YAC arm containing S. cerevisiae URA3, also from pYAC-RC. Subsequently, the ligation mixture was transformed into S. cerevisiae AB1380 cells via spheroplast transformation[41], and URA+TRP+ yeast clones were selected. Clones, termed YAC6, containing the linear region from human VH4-39 to VH3-23 were confirmed by Southern blot analysis. YAC6 was further extended by addition of a 10.6 kb fragment 3' of VH3-23, and conversion to a cYAC. The 10.6 kb extension contains the human VH3-11 and also occurs at the 5' end of BAC3. We constructed pBeloHYG-YAC6+BAC3(5') for the modification of YAC6. Briefly, 3 fragments with overlapping ends were prepared by PCR: 1) a 'stuff' fragment containing S. cerevisiae TRP1-ARS1 flanked by HpaI sites with 5' tail matching the sequence upstream of VH4-39 and 3' tail matching downstream of VH3-23 in YAC6 (using long oligoes 561 and 562, and pYAC-RC as template), 2) the 10.6 kb extension fragment with a 5' tail matching the sequence downstream of VH3-23 as described above and a unique AscI site at its 3' end (using long oligoes 570 and 412, and human genomic DNA as template), and 3) pBelo-CEN-HYG vector with the CEN4 joined downstream with a homology tail matching the 3' end of the 10.6 extension fragment and the HygR joined upstream with a tail matching the sequence upstream of VH4-39 as described above (using long oligoes 414 and 566, and pBelo-CEN-HYG as template). Subsequently, the 3 PCR fragments were assembled into a small cYAC conferring HYGR and TRP+ in S. cerevisiae via homologous recombination associated with spheroplast transformation, and this cYAC was further converted into the BAC pBeloHYG-YAC6+BAC3(5'). Finally, the HpaI-digested pBeloHYG-YAC6+BAC3(5') was used to transform yeast cells carrying YAC6, and through homologous recombination cYAC BAC6-VH3-11 conferring only HYGR was generated. Via transformation, see below, this cYAC was introduced as a BAC in E. coli. The human VH genes in BAC6-VH3-11 were cut out as a ~182 kb AsiSI (occurring naturally in the HygR)—AscI fragment, and the VH genes in BAC3 were cut out as a ~173 kb NotI-fragment (FIG. 1 top).

For the assembly of the C region with the VH overlap, the human VH6-1-Ds-JHs region had to be joined with the rat genomic sequence immediately downstream of the last JH followed by rat Cs to yield a cYAC/BAC. To achieve this, 5 overlapping restriction as well as PCR fragments were prepared; a 6.1 kb fragment 5' of human VH6-1 (using oligoes 383 and 384, and human genomic DNA as template), an ~78 kb PvuI-PacI fragment containing the human VH6-1-Ds-JHs region cut out from BAC1 (RP11645E6), a 8.7 kb fragment joining the human JH6 with the rat genomic sequence immediately downstream of the last JH and containing part of rat μ coding sequence (using oligos 488 and 346, and rat genomic DNA as template), an ~52 kb NotI-PmeI fragment containing the authentic rat μ, δ and γ2c region cut out from BAC M5 (CH230-408M5) and the pBelo-CEN-URA vector with the URA3 joined downstream with a homology tail matching the 3' end of the rat γ2c region and the CEN4 joined upstream with a tail matching the 5' region of human VH6-1 as described (using long oligoes 385 and 550, and pBelo-CEN-URA as template). Correct assembly via homologous recombination in S. cerevisiae was analysed by PCR and purified cYAC from the correct clones was converted into a BAC in E. coli.

For the assembly of Annabel parts of the above cYAC/BAC containing humanVH6-1-Ds-JHs followed by the authentic rat μ, δ and γ2c region, as well as PCR fragments were used. Five overlapping fragments contained the 6.1 kb fragment at the 5' end of human VH6-1 as described above, an ~83 kb SpeI fragment comprising human VH6-1-Ds-JHs immediately followed by the rat genomic sequence downstream of the last JH and containing part of rat Cμ, a 5.2 kb fragment joining the 3' end of rat μ with the 5' end of rat γ1 (using oligos 490 and 534, and rat genomic DNA as template), an ~118 kb NotI-SgrAI fragment containing the authentic rat γ1, γ2b, ε, α and 3'E IgH enhancer region cut out from BAC 18 (CH230-162I08), and the pBelo-CEN-URA vector with the URA3 joined downstream with a homology tail matching the 3' end of rat 3'E and the CEN4 joined upstream with a tail matching the 5' end of human VH6-1 as described above. There is a 10.3 kb overlap between the human VH6-1 regions in both the BAC3 and Annabel. The human VH6-1-Ds-JHs followed by the rat CH region together with the S. cerevisiae URA3 in Annabel can be cut out as a single ~183 kb NotI-fragment (see FIG. 1 top).

BAC6-VH3-11, BAC3 and Annabel were checked extensively by restriction analysis and partial sequencing for their authenticity.

b) IgL Loci

The human Igk locus on a ~410 kb YAC was obtained by recombination assembly of a Vλ YAC with 3 Cλ containing cosmids[25]. Rearrangement and expression was verified in transgenic mice derived from ES cells containing one copy of a complete human Igλ YAC[38]. This Igλ YAC was shortened by the generation of a circular YAC removing ~100 kb of the region 5' of Vλ3-27. The vector pYAC-RC was digested with ClaI and BspEI to remove URA3 and ligated with a ClaI/NgoMIV fragment from pAP 599 containing HYG. PCR of the region containing the yeast centromere and hygromycin marker gene from the new vector (pYAC-RC-HYG) was carried out with primers with 5' ends homologous to a region 5' of Vλ3-27 (primer 276) and within the ADE2 marker gene in the YAC arm (primer 275). The PCR fragment (3.8 kb) was integrated into the Igλ YAC using a high efficiency lithium acetate transformation method[42] and selection on hygromycin containing YPD plates. DNA was prepared from the clones (Epicentre MasterPure Yeast DNA purification kit) and analysed for the correct junctions by PCR using the following oligos: 243+ 278 and Hyg end R+238. Plugs were made[43] and yeast chromosomes removed by PFGE (0.8% agarose (PFC) (Biorad) gel [6V/cm, pulse times of 60 s for 10 hr and 10 s for 10 hr, 8° C.) leaving the circular yeast artificial chromosome caught in the agarose block[44]. The blocks were removed and digested with NruI. Briefly, blocks were pre-incubated with restriction enzyme buffer in excess at a 1× final concentration for 1 hr on ice. Excess buffer was removed leaving just enough to cover the plugs, restriction enzyme was added to a final concentration of 100 U/ml and the tube incubated at 37° C. for 4-5 hrs. The linearized YAC was ran out of the blocks by PFGE, cut out from the gel as a strip and purified as described below.

For the human Igκ locus 3 BACs were chosen (RP11-344F17, RP11-1134E24 and RP11-156D9, Invitrogen), which covered a region over 300 kb from 5' Vκ1-17 to 3' KDE[45]. In digests and sequence analyses three overlapping fragments were identified: from Vκ1-17 to Vκ3-7 (150 kb NotI with ~14 kb overlap), from Vκ3-7 to 3' of Cκ (158 kb NotI with ~40 kb overlap) and from Cκ to 3' of the KDE (55 kb PadI with 40 kb overlap). Overlapping regions may generally favour joint integration when co-injected into oocytes[24].

Gel Analyses and DNA Purification

Purified YAC and BAC DNA was analysed by restriction digest and separation on conventional 0.7% agarose gels[46]. Larger fragments, 50-200 kb, were separated by PFGE (Biorad Chef Mapper™) at 80 C, using 0.8% PFC Agaraose in 0.5% TBE, at 2-20 sec switch time for 16 h, 6V/cm, 10 mA. Purification allowed a direct comparison of the resulting fragments with the predicted size obtained from the sequence analysis. Alterations were analysed by PCR and sequencing.

Linear YACs, circular YACs and BAC fragments after digests, were purified by electro-elution using Elutrap™ (Schleicher and Schuell)[47] from strips cut from 0.8% agarose gels run conventionally or from pulsed-field-gel electrophoresis (PFGE). The DNA concentration was usually several ng/μl in a volume of ~100 μl. For fragments up to ~200 kb the DNA was precipitated and re-dissolved in micro-injection buffer (10 mM Tris-HCl pH 7.5, 100 mM EDTA pH 8 and 100 mM NaCl but without Spermine/Spermidine) to the desired concentration.

The purification of circular YACs from yeast was carried out using Nucleobond AX silica-based anion-exchange resin (Macherey-Nagel, Germany). Briefly, spheroplasts were made using zymolyase or lyticase and pelleted[20]. The cells then underwent alkaline lysis, binding to AX100 column and elution as described in the Nucleobond method for a low-copy plasmid. Contaminating yeast chromosomal DNA was hydrolyzed using Plamid-Safe™ ATP-Dependent DNase (Epicentre Biotechnologies) followed by a final cleanup step using SureClean (Bioline). An aliquot of DH10 electrocompetent cells (Invitrogen) was then transformed with the circular YAC to obtain BAC colonies. For microinjection, the insert DNA (150-200 kb), was separated from BAC vector DNA (~10 kb) using a filtration step with sepharose 4B-CL[48].

Derivation of Rats and Breeding

Purified DNA encoding recombinant immunoglobulin loci was resuspended in microinjection buffer with 10 mM Spermine and 10 mM Spemidine. The DNA was injected into fertilized oocytes at various concentrations from 0.5 to 3 ng/μl.

Plasmid DNA or mRNA encoding ZFNs specific for rat immunoglobulin genes were injected into fertilized oocytes at various concentrations from 0.5 to 10 ng/ul.

Microinjections were performed at Caliper Life Sciences facility. Outbred SD/Hsd (WT) strain animals were housed in standard microisolator cages under approved animal care protocols in animal facility that is accredited by the Association for the Assessment and Accreditation for Laboratory Animal Care (AAALAC). The rats were maintained on a 14-10 h light/dark cycle with ad libitum access to food and water. Four to five week old SD/Hsd female rats were injected with 20-25 IU PMSG (Sigma-Aldrich) followed 48 hours later with 20-25 IU hCG (Sigma-Aldrich) before breeding to outbred SD/Hsd males. Fertilized 1-cell stage embryos were collected for subsequent microinjection. Manipulated embryos were transferred to pseudopregnant SD/Hsd female rats to be carried to parturition.

Multi-feature human Ig rats (human IgH, Igκ and Igλ in combination with rat J KO, κ KO and κ KO) and WT, as control, were analyzed at 10-18 weeks of age. The animals were bred at Charles River under specific pathogen-free conditions.

PCR and RT-PCR

Transgenic rats were identified by PCR from tail or ear clip DNA using a Genomic DNA Mini Kid (Bioline). For IgH PCRs<1 kb GoTaq Green Master mix was used (Promega) under the following conditions: 94° C. 2 mins, 32×(94° C. 30 secs, 54-670 C (see supplemental Table 1 for primers and specific annealing temperatures) 30 secs, 72° C. 1 min), 72° C. 2 mins. For IgH PCRs>1 kb KOD polymerase (Novagen) was used under the following conditions: 95° C. 2 mins, 32×(95° C. 20 secs, 56-620 C (supplementary Table 1) 20 secs, 70° C. 90 secs), 70° C. 2 mins. For Igκ and Igλ PCR, all <1 kb, the above condition were used except extension at 72° C. for 50 secs.

RNA was extracted from Blood using the RiboPure Blood Kit (Ambion) and RNA extraction from spleen, bone marrow or lymph nodes used RNASpin mini kit. (GE Healthcare). cDNA was made using Oligo dT and Promega Reverse Transcriptase at 42° C. for 1 hour. GAPDH PCR reactions (oligos 429-430) determined the concentration.

RT-PCRs were set up using VH leader primers with rat μCH2 or rat γCH2 primers (supplementary Table 1). Amplification with GoTaq Green Master mix were 94° C. 2 mins, 34×(94° C. 30 secs, 55-65° C. 30 secs, 72° C. 50-60 secs), 72° C. 2 mins. PCR products of the expected size were either purified by gel or QuickClean (Bioline) and sequenced directly or cloned into pGemT (Promega).

Protein Purification

IgM was purified on anti-IgM affinity matrix (BAC B.V., Netherlands, CaptureSelect #2890.05) as described in the protocol. Similarly, human Igκ and Igλ was purified on anti-L chain affinity matrix (CaptureSelect anti-Igκ #0833 and anti-Igλ #0849) according to the protocol.

For rat IgG purification[29] protein A and protein G agarose was used (Innova, Cambridge, UK, #851-0024 and #895-0024). Serum was incubated with the resin and binding facilitated at 0.1 M sodium phosphate pH 7 for protein G and pH 8 for protein A under gentle mixing. Poly-prep columns (Bio-Rad) were packed with the mixture and washed extensively with PBS pH7.4. Elution buffer was 0.1 M Sodium Citrate pH 2.5 and neutralization buffer was 1 M Tris-HCl pH 9

Electrophoresis was performed on 4-15% SDS-PAGE and Coomassie brilliant blue was used for staining MW standards were HyperPage Prestained Protein Marker (#BIO-33066, Bioline).

Flow Cytometry Analysis and FISH

Cell suspensions were washed and adjusted to 5×105 cells/100 µl in PBS-1% BSA-0.1% Azide. Different B-cell subsets were identified using mouse anti-rat IgM FITC-labelled mAb (MARM 4, Jackson Immunoresearch Laboratories) in combination with anti-B cell CD45R (rat B220)-PE-conjugated mAb (His 24, BD biosciences) or anti-IgD-PE-conjugated mAb (MARD-3, Abd Serotec). A FACS Cantoll flow cytometer and FlowJo software (Becton Dickinson, Pont de Claix, France) was used for the analysis.

Fluorescence in situ hybridisation was carried out on fixed blood lymphocytes using purified IgH and IgL C-region BACs as described.[49]

Immunization, Cell Fusion and Affinity Measurement

Immunizations were performed with 125 µg PG in CFA, 150 µg hGHR in CFA, 200 µg Tau/KLH in CFA, 150 µg HEL in CFA, 150 µg OVA in CFA at the base of the tail and medial iliac lymph node cells were fused with mouse P3X63Ag8.653 myeloma cells 22 days later as described[50]. For multiple immunizations protein, 125 µg PG or HEL, or 100 µg hGHR or CD14 in GERBU adjuvant (www.Gerbu.com), was administered intraperitoneally as follows: day 0, day 14, day 28 and day 41 without adjuvant, followed by spleen cell fusion with P3x63Ag8.653 cells 4 days later.[49]

Binding kinetics were analyzed by surface Plasmon resonance using a Biacore 2000 with the antigens directly immobilized as described[23].

SUPPLEMENTARY TABLE 1

PCR* and RT-PCR** conditions to detect human IgH and IgL integration and expression

|  | Primers | Annealing Temp (Tm-5) | Fragment size |
|---|---|---|---|
| IgH |  |  |  |
| Hyg (5' BAC6) | Hyg 3' F - 459 | 54° C. | ~400 bp |
| V4-34 (BAC6) | 205-206 | 65° C. | ~1 kb |
| V4-28 (BAC6) | 203-204 | 65° C. | ~1 kb |
| V3-11 (overlap BAC6-BAC3) | 448-461 | 60° C. | ~500 bp |
| V1-8 (BAC3) | 371-372 | 60° C. | ~300 bp |
| V4-4 (BAC3) | 393-396 | 60° C. | ~750 bp |
| V6-1 (BAC3-Annabel) | 359-360 | 65° C. | ~350 bp |
| JH (Annabel) | 368-369 | 62° C. | ~250 bp |
| µ-γ1 (Annabel) | 583-535 | 62° C. | ~3 kb |
| Ura (3' Annabel) | 241-253 | 56° C. | ~3 kb |
| Igκ |  |  |  |
| KDE | 313-314 | 66° C. | ~600 bp |
| cKappa | 307-308 | 64° C. | ~600 bp |
| V4-1 | 333-334 | 60° C. | ~300 bp |
| V1-5 | 329-330 | 64° C. | ~400 bp |
| V1-6 | 331-332 | 60° C. | ~300 bp |
| V3-7 | 309-310 | 66° C. | ~700 bp |
| V3-15 | 311-312 | 66° C. | ~500 bp |
| Igλ |  |  |  |
| V3-27 | 215-216 | 67° C. | ~400 bp |
| V3-19 | 213-214 | 67° C. | ~700 bp |
| V2-14 | 211-212 | 67° C. | ~400 bp |
| V middle | 168-169 | 65° C. | ~500 bp |
| JLambda | 162-163 | 67° C. | ~800 bp |
| cLambda | 170-171 | 67° C. | ~500 bp |
| Enhancer | 172-173 | 67° C. | ~400 bp |

SUPPLEMENTARY TABLE 1-continued

PCR* and RT-PCR** conditions to detect human IgH and IgL integration and expression

|  | Primer | Annealing Temp (Tm-5) | Fragment size |
|---|---|---|---|
| IgH |  |  |  |
| VH1 Leader | 390 | 65° C. | ↓ |
| VH2 Leader | 391 | 65° C. | ↓ |
| VH3 Leader | 392 | 65° C. | ↓ |
| VH4 Leader | 393 | 60° C. | ↓ |
| VH6 Leader | 394 | 65° C. | ↓ |
| VH4-39 Leader | 761 | 55° C. | ↓ |
| Rat µCH2 | 345 | ↑ | ~1 kb |
| Rat □CH2 | 682 | ↑ | ~800 bp |
| Ig□ |  |  |  |
| HuVK1 Leader | 400/474 | 63° C. | ↓ |
| HuVK3 Leader | 401/475 | 63° C. | ↓ |
| HuVK4 Leader | 476 | 63° C. | ↓ |
| HuVK5 Leader | 477 | 63° C. | ↓ |
| Hu □ C region | 402 | ↑ | ~600 bp |
| HuVL2 Leader | 388/478 | 58° C. | ↓ |
| HuVL3 Leader | 398/479/480/482/ 483/481/484 | 58° C. | ↓ |
| HuVL4 Leader | 485 | 58° C. | ↓ |
| Hu □ □C region | 387 | ↑ | ~600 bp |

*For DNA extraction from ear and tail clips the Genomic DNA Mini Kit (Bioline) was used. For PCRs 1 kb or less in size GoTaq Green Master mix (Promega) was used under the following conditions: 94° C. 2 mins, 32 × (94° C. 30 secs, Tm-5 (below) 30 secs, 72° C. 1 min [50 sec for Igκ/λ]), 72° C. 2 mins. Annealing temperatures were set at the lowest primer Tm-5° C. (www.sigmagenosys.com/calc/DNACalc.asp). For PCRs > 1 kb KOD polymerase (Novagen) was used under the following conditions: 95° C. 2 mins, 32 × (95° C. 20 secs, Tm-5 20 secs, 70° C. 90 secs), 70° C. 2 mins.
**RNA was extracted from Blood using the RiboPure Blood Kit (Ambion). RNA extracted from spleen, bone marrow or lymph nodes used the RNASpin mini kit (GE Healthcare). cDNA was made using Oligo dT and Promega Reverse Transcriptase at 42° C. 1 hour. PCRs using the GoTaq Green Master mix were set up as follows: 94° C. 2 mins, 34 × (94° C. 30 secs, Tm-5 30 secs, 72° C. 1 min [50 sec for Igκ/λ]), 72° C. 2 mins.

Primers

| Number | Oligonucleotide sequence 5'-3' |
|---|---|
| 162 | GGGGCCAAGGCCCCGAGAGATCTCAGG |
| 163 | CACTGGGTTCAGGGTTCTTTCCACC |
| 168 | GTGGTACAGAAGTTAGAGGGGATGTTGTTCC |
| 169 | TCTTCTACAAGCCCTTCTAAGAACACCTGG |
| 170 | AGCACAATGCTGAGGATGTTGCTCC |
| 171 | ACTGACCCTGATCCTGACCCTACTGC |
| 172 | AAACACCCCTCTTCTCCCACCAGC |
| 173 | CGCTCATGGTGAACCAGTGCTCTG |
| 203 | GCTATTTAAGACCCACTCCCTGGCA |
| 204 | AAAACCTGCAGCAAGGATGTGAGG |
| 205 | GCTCCTTCAGCACATTTCCTACCTGGA |
| 206 | CCATATATGGCAAAATGAGTCATGCAGG |
| 211 | CTCTGCTGCTCCTCACCCTCCTCACTCAGG |
| 212 | GAGAGTGCTGCTGCTTGTATATGAGCTGCA |
| 213 | TGGCTCACTCTCCTCACTCTTTGCATAGGTT |
| 214 | GATGGTTACCACTGCTGTCCCGGGAGTTAC |
| 215 | ATCCCTCTCCTGCTCCCCTCCTCATTCTCTG |
| 216 | TGATGGTCAAGGTGACTGTGGTCCCTGAGCTG |

| Number | Oligonucleotide sequence 5'-3' |
|---|---|
| 238 | AACAAGTGCGTGGAGCAG |
| 241 | GTACTGTTGACATTGCGAAGAGC |
| 243 | TGGTTGACATGCTGGCTAGTC |
| 253 | TGTCTGGCTGGAATACACTC |
| 275 | AAATGAGCTTCAAATTGAGAAGTGACGCAAGCATCAATGGTATAATGTCCAGAGTTGTGAGGCCTTGGGGACTGTGTGCCGAACATGCTC |
| 276 | CCAGCACTGTTCAATCACAGTATGATGAGCCTAATGGGAATCCCACTAGGCTAGTCTAGTCACCACATTAAAGCACGTGGCCTCTTATCG |
| 278 | TGACCATTGCTTCCAAGTCC |
| 307 | GAGGAAAGAGAGAAACCACAGGTGC |
| 308 | CACCCAAGGGCAGAACTTTGTTACT |
| 309 | TGTCCAGGTATGTTGAAGAATGTCCTCC |
| 310 | TGGACTCTGTTCAACTGAGGCACCAG |
| 311 | GGCCTTCATGCTGTGTGCAGACTA |
| 312 | CAGGTCGCACTGATTCAAGAAGTGAGT |
| 313 | TTCAGGCAGGCTCTTACCAGGACTCA |
| 314 | TGCTCTGACCTCTGAGGACCTGTCTGTA |
| 329 | TCACGTGACTGTGATCCCTAGAA |
| 330 | CACTGTTATGCCAACTGAACAGC |
| 331 | CGTAGCAGTCCCCATCTGTAATC |
| 332 | ATGTCAGAGGAGCAGGAGAGAGA |
| 333 | CACGCCTCACATCCAATATGTTA |
| 334 | ATACCCTCCTGACATCTGGTGAA |
| 345 | GCTTTCAGTGATGGTCAGTGTGCTTATGAC |
| 346 | TGGAAGACCAGGAGATATTCAGGGTGTC |
| 359 | TTGCTTAACTCCACACCTGCTCCTG |
| 360 | TGCTTGGAACTGGATCAGGCAGTC |
| 368 | CACCCTGGTCACCGTCTCC |
| 369 | AGACAGTGACCAGGGTGCCAC |
| 371 | TGAGGAACGGATCCTGGTTCAGTC |
| 372 | ATCTCCTCAGCCCAGCACAGC |
| 383 | CCTCCCATGATTCCAACACTG |
| 384 | CTCACCGTCCACCACTGCTG |
| 385 | CTGTGCCACAAACATGCAAAGATAAGTTCCATGTGACAAGTCTGAACTCAGTGTTGGAATCATGGGAGGCGGCCGCGTTATCTATGCTGTCTCACCATAG |
| 387 | TGCTCAGGCGTCAGGCTCAG |
| 388 | TGCTCAGGCGTCAGGCTCAG |
| 390 | ATGGACTGGACCTGGAGGATCC |
| 391 | TCCACGCTCCTGCTGCTGAC |
| 392 | ATGGAGTTTGGGCTGAGCTGG |
| 393 | TGAAACACCTGTGGTTCTTCC |
| 394 | TCATCTTCCTGCCCGTGCTGG |
| 396 | GACTCGACTCTTGAGGGACG |
| 398 | ATGTGGCCACAGGCTAGCTC |
| 400 | ATGAGGGTCCCCGCTCAG |
| 401 | ATGGAAGCCCCAGCTCAGC |
| 402 | CCTGGGAGTTACCCGATTGG |
| 412 | GGCGCGCCAAGCATCATGTCCTACCTGGCTG |
| 414 | CAAAGTACGTGGCACCTCCCTCGTCTTTCTTCCTCCTGCTCCAGCCAGGTAGGACATGATGCTTGGCGCGCCGTTATCTATGCTGTCTCACCATAG |
| 429 | CAGTGCCAGCCTCGTCTCAT |
| 430 | AGGGGCCATCCACAGTCTTC |
| 448 | CTTCACTGTGTGTTCTTGGGATAC |
| 459 | GTGTAATGCTTTGGACGGTGTGTTAGTCTC |
| 461 | GCATAGCGGCGCGCCAAGCATCATGTCCTACCTGGCTG |
| 474 | GACATGAGAGTCCTCGCTCAGC |
| 475 | AAGCCCCAGCGCAGCTTC |
| 476 | ATGGTGTTGCAGACCCAGGTC |
| 477 | GTCCCAGGTTCACCTCCTCAG |
| 478 | TCCTCASYCTCCTCACTCAGG |
| 479 | CGTCCTTGCTTACTGCACAG |
| 480 | AGCCTCCTTGCTCACTTTACAG |
| 481 | CCTCCTCAYTYTCTGCACAG |
| 482 | GCTCACTCTCCTCACTCTTTGC |
| 483 | CCTCCTCTCTCACTGCACAG |
| 484 | GCCACACTCCTGCTCCCACT |
| 485 | ATGGCCTGGGTCTCCTTCTAC |
| 488 | ATTACTACTACTACTACATGGACGTCTGGGGCAAAGGGACCACGGTCACCGTCTCCTCAGGAAGAATGGCCTCTCCAGGTC |
| 490 | CTGTCGTTGAGATGAACCCCAATGTGAG |
| 534 | GGAACTGATGTGATCTCAGTCACACAGCTAATGCAAAGGTCAGCAGGCTGTTTACTGCCTGGAGGTTCATCGCCCAATTCCAAAGTCAC |
| 535 | CTAGTCTGCATGGGTCTCCGCAAAC |
| 550 | CTGGTATAATCATAAGTCTCCACTTAATAGTTCTGTAGACAGAATCTTCATTTAGACTTACAGACCGCGGCCGCACCGCAGGGTAATAACTG |

-continued

| Number | Oligonucleotide sequence 5'-3' |
|---|---|
| 561 | GCAACCCTTCTTGCCACTCATGTCCCAGCTCTCACCATGTGACATAGCCTGTTAACAATTCGGTCGAAAAAAGAAAAGGAGAG |
| 562 | AATGTTCTTAGTATATATAAACAAGCTACTCCAATTCATAGTCAACTAAGTTAACATTCCACATGTTAAAATAGTGAAGGAG |
| 566 | TTAACAGGCTATGTCACATGGTGAGAGCTGGGACATGAGTGGCAAGAAGGGTTGCCAGACTCCCCCTTTACCTCTATATCGTGTTC |
| 570 | CTTAGTTGACTATGAATTGGGAGTAGCTTGTTTATATATACTAAGAACATTTGTCAGAAGCTCTTTCTTGTTTATTCCCAGTTTGC |
| 583 | CATGTCCGTATGTTGCATCTGC |
| 682 | GGGAAGATGAAGACAGATG |
| 761 | TGGAGTGGATTGGGAGT |

Results

The Human IgH and IgL Loci

Construction of the human Ig loci employed established technologies to assemble large DNA segments using YACs and BACs[16, 19, 24-26]. As multiple BAC modifications in *E. coli* frequently deleted repetitive regions such as switch sequences and enhancers, a method was developed to assemble sequences with overlapping ends in *S. cerevisiae* as circular YAC (cYAC) and, subsequently, converting such a cYAC into a BAC. Advantages of YACs include their large size, the ease of homologous alterations in the yeast host and the sequence stability, while BACs propagated in *E. coli* offer the advantages of easy preparation and large yield. Additionally, detailed restriction mapping and sequencing analysis can be better achieved in BACs than in YACs.

Sequence analysis and digests identified gene clusters of interest and ensured locus integrity and functionality to secure DNA rearrangement and switching over a wide region. The layout of the human IgH (human VH, D and JH segments followed by rat C genes), Igκ and Igλ loci are depicted in FIG. 1a-c. As shown previously, overlapping regions may generally favor joint integration when co-injected into oocytes[24]. Thereby, insertion of BAC6-VH3-11, a 182 kb AsiSI-AscI fragment, with BAC3, a 173 kb NotI fragment, and BAC3-1N12M518 (Hu-Rat Annabel), a 193 kb NotI fragment, led to the reconstitution of a fully functional transgenic IgH loci in the rat genome. Similarly, the human Igκ locus was integrated by homologous overlaps. The human Igλ locus was isolated intact as a ~300 kb YAC and also fully inserted into a rat chromosome. The integration success was identified by transcript analysis which showed V(D)J-C recombinations from the most 5' to the most 3' end of the locus injected. Multiple copies were identified by qPCR (not shown) and it is likely that head to tail integrations occurred. In all cases, transgenic animals with single-site integrations were generated by breeding.

Breeding to Homozygosity

The derivation of transgenic rats by DNA microinjection into oocytes, their breeding and immunization is comparable to the mouse. However, ZFN technology to obtain gene knock-outs has only been reported recently[11, 13]. Silencing of the rat IgH locus by $J_H$ deletion using ZFN KO technology has been described[12] and a manuscript describing silencing of the rat IgL loci, targeting of Cκ and deletion of J-Cλ genes, is in preparation. We derived multiple founders with integrated human Ig loci and silenced endogenous Ig production; all analyzed by PCR and FISH with complete trans-locus integration selected and interbred (Table 2). Several founder rats carried low translocus copy numbers; with the rat C-gene BAC in OmniRat likely to be fully integrated in 5 copies as determined by qPCR of Cμ and Cα products (not shown). Identification by FISH of single position insertion in many lines confirmed that spreading or multiple integration of BAC mixtures were rare; an advantage for breeding to homozygosity, which was achieved.

TABLE 2

Generated rat lines: transgenic integration, knock-out and gene usage

| | human $V_H$ | | rat $C_H$ | human Igκ | human Igl | ZFN KO | | | FISH |
|---|---|---|---|---|---|---|---|---|---|
| | BAC6- | | | | | | | | |
| rat line | VH3-11 182 kb | BAC3 173 kb | (Annabel) 193 kb | BACs 300 kb | Igl YAC 300 kb | $J_H$ KO | Igκ KO | Igγ KO | rat chromosome |
| HC14 | ✓ | ✓ | ✓ | | | | | | 5q22 |
| OmniRat | ✓ | ✓ | ✓ | ✓ | ✓ | ✓ | ✓ | ✓ | homozygous KOs |
| LC#79 | | | | ✓ | | | | | 17 |
| LC#6.2 | | | | | ✓ | | | | 6q23 |
| #117 | | | | | | ✓ | | | 6q32 |
| #23 | | | | | | | ✓ | | 4 |
| #35 | | | | | | | | ✓ | 11 |

Rats carrying the individual human transloci—IgH, Igκ and Igλ—were crossbred successfully to homozygosity with Ig locus KO rats. This produced a highly efficient new multi-feature line (OmniRats™) with human $V_H$-D-$J_H$ regions of over 400 kb containing 22 functional $V_H$s and a rat C region of ~116 kb. DNA rearrangement, expression levels, class-switching and hypermutation was very similar between the different founders and comparable to wt rats. This is probably the result of the associated rat constant region accommodating several Cs and with the 3'E (enhancer control) region in authentic configuration.

B-Cell Development in the Knock-Out Background

To assess whether the introduced human Ig loci were capable of reconstituting normal B-cell development flow cytometric analyses were performed. Particular differentiation stages were analyzed in spleen and bone marrow lymphocytes (FIG. 2), which previously showed a lack of B-cell development in JKO/JKO rats[12], and no corresponding IgL expression in κKO/κKO as well as in λKO/λKO animals (data not shown). Most striking was the complete recovery of B-cell development in OmniRats compared to wt animals, with similar numbers of B220(CD45R)+ lymphocytes in bone marrow and spleen. IgM expression in a large proportion of CD45R+ B-cells marked a fully reconstituted immune system. Size and shape separation of spleen cells was indistinguishable between OmniRats and wt animals and thus successfully restored in the transgenic rats expressing human idiotypes with rat C region. Moreover, the small sIgG+ lymphocyte population was present in OmniRats (FIG. 2 right).

The analysis of other OmniRat lymphocyte tissues showed that they were indistinguishable from wt controls and, for example, T-cell subsets were fully retained (data not shown), which further supports the notion that optimal immune function has been completely restored.

Diverse Human H- and L-Chain Transcripts

Extensive transcriptional analysis was carried out using blood lymphocytes or spleen cells from transgenic rats with functional endogenous Ig loci. RT-PCR from specific human $V_H$ group forward to Cμ or Cγ reverse primers, showed human $V_H DJ_H$ usage. For L-chain analysis group specific human Vκ or Vλ forward primers were used with Cκ or Cλ reverse primers. The results (Table 3) showed the use of all integrated human $V_H$ genes regarded as functional[27] in combination with diverse use of D segments and all $J_H$ segments.

Figure 3:
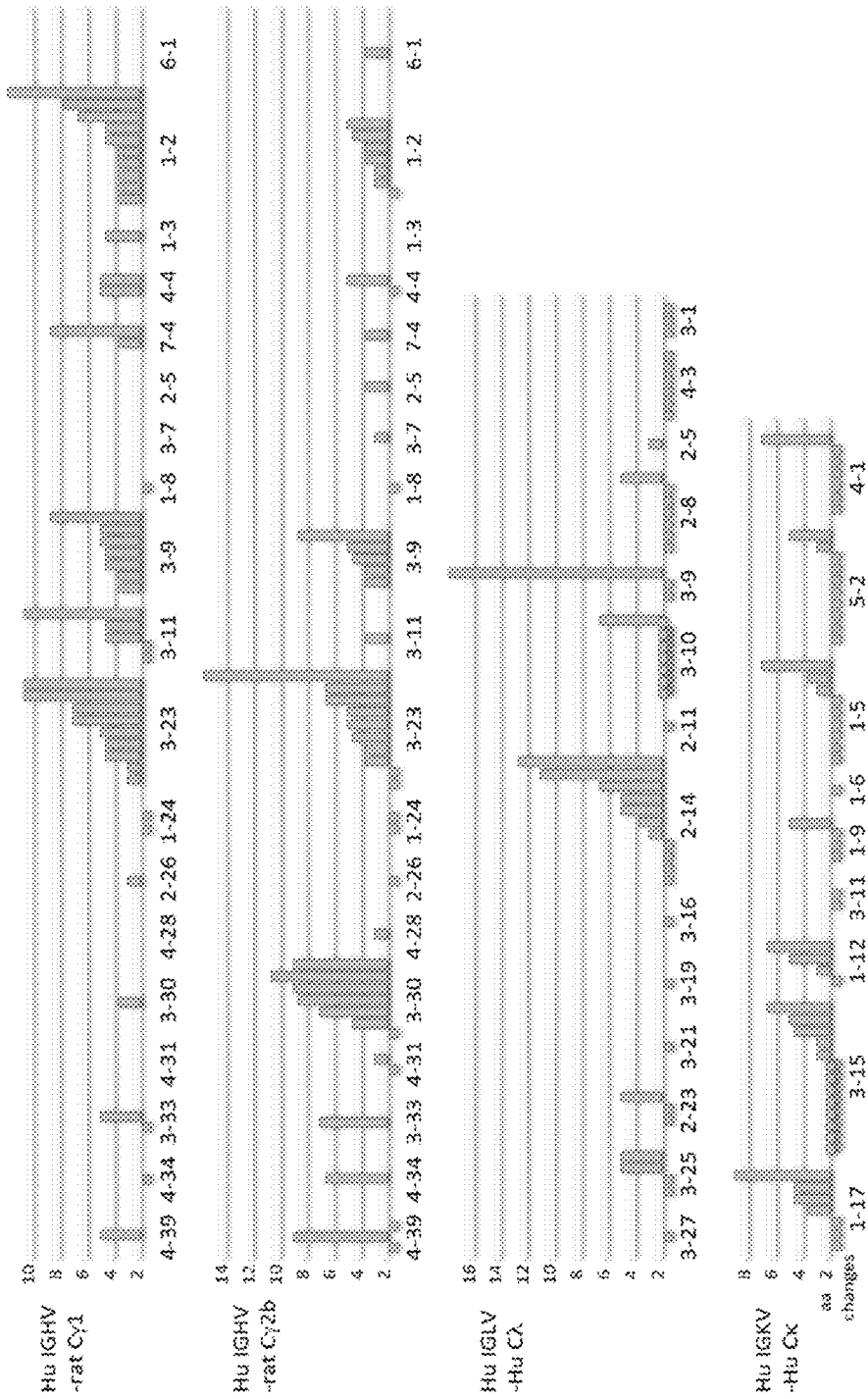
FIG. 3: Mutational changes in IgH and IgL transcripts from PBLs. Unique (VHDJH)s and VLs were from amplifications with V group specific primers: IGHV1, 2, 3, 4 and 6 in combination with the universal γCH2 reverse primer, IGLV2, 3 and 4 with reverse Cλ primer; and IGKV1, 3, 4 and 5 in with reverse Cκ primer (Supplementary Table 1). Mutated trans-switch products were identified for humanVH-rat Cγ2a (4) and human VH-rat Cγ2c (2).

The analysis of class-switch and hypermutation (FIG. 3) in the JKO/JKO background showed that these essential and highly desirable mechanisms are fully operative in OmniRats. Amplification of IgG switch products from PBLs revealed an extensive rate of mutation (>2 aa changes) in the majority of cells, ~80%, and in near equal numbers of γ1 and γ2b H-chains. A small percentage of trans-switch sequences, γ2a and 2c, were also identified (FIG. 3), which supports the observation that the translocus is similarly active, but providing human ($V_H$-D-$J_H$)s, as the endogenous IgH locus[28]. The number of mutated human Igγ and Igκ L-chain sequences is ~30% and thus considerably lower than IgG H-chains. The reason is the general amplification of L-chain from all producing cells rather than from IgG+ or differentiated plasma cells.

Ig Levels in Serum

To gain unambiguous information about antibody production we compared quality and quantity of serum Ig from OmniRats and normal wt animals. Purification of IgM and IgG separated on SDS-PAGE under reducing conditions (FIG. 4) showed the expected size—~75 kDa for μ, ~55 kDa for γ H-chains, and ~25 kDa for L-chains—which appeared indistinguishable between OmniRats and wt animals. The Ig yield from serum was determined to be between 100-300 μg/ml for IgM and 1-3 mg/ml for IgG for both, several OmniRats and wt animals. However, as rat IgG purification on protein A or G is seen as suboptimal[29], rat Ig levels may

TABLE 3

| | 4-39 | 3-38 | 3-35 | 4-34 | 3-33 | 4-31 | 3-30 | 4-28 | 2-26 | 1-24 | 3-23 | 3-22 | 3-11 | 3-9 | 1-8 | 3-7 | 2-5 | 7-4 | 4-4 | 1-3 | 1-2 | 6-1 |
|---|---|---|---|---|---|---|---|---|---|---|---|---|---|---|---|---|---|---|---|---|---|---|
| | IgH V | | | | | | | | | | | | | | | | | | | | | |
| HC14 | ✓ | | ✓ | ✓ | ✓ | ✓ | ✓ | ✓ | ✓ | ✓ | | ✓ | | ✓ | ✓ | ✓ | ✓ | ✓ | ✓ | ✓ | ✓ | ✓ |
| HC14 JKO/JKO | ✓ | | ✓ | ✓ | ✓ | ✓ | ✓ | ✓ | ✓ | ✓ | | ✓ | | ✓ | ✓ | ✓ | ✓ | ✓ | ✓ | ✓ | ✓ | ✓ |

| | 1-1 | 2-2 | 3-3 | 4-4 | 5-5 | 6-6 | 1-7 | 2-8 | 3-9 | 3-10 | 4-11 | 5-12 | 6-13 | 1-14 | 2-15 | 3-16 | 4-17 |
|---|---|---|---|---|---|---|---|---|---|---|---|---|---|---|---|---|---|
| | IgH D | | | | | | | | | | | | | | | | |
| HC14 | ✓ | ✓ | ✓ | | ✓ | ✓ | ✓ | | ✓ | ✓ | | ✓ | ✓ | | ✓ | ✓ | ✓ |
| HC14 JKO/JKO | | ✓ | | | ✓ | ✓ | ✓ | | ✓ | ✓ | | ✓ | ✓ | ✓ | ✓ | ✓ | ✓ |

| | 5-18 | 6-19 | 1-20 | 2-21 | 3-22 | 4-23 | 5-24 | 6-25 | 1-26 | 7-27 | 1 | 2 | 3 | 4 | 5 | 6 |
|---|---|---|---|---|---|---|---|---|---|---|---|---|---|---|---|---|
| | IgH D | | | | | | | | | | IgH J | | | | | |
| HC14 | ✓ | ✓ | ✓ | ✓ | ✓ | ✓ | ✓ | | ✓ | ✓ | | ✓ | ✓ | ✓ | ✓ | ✓ |
| HC14 JKO/JKO | ✓ | ✓ | | ✓ | ✓ | ✓ | ✓ | ✓ | ✓ | ✓ | ✓ | ✓ | ✓ | ✓ | ✓ | ✓ |

| | 3-27 | 3-25 | 2-23 | 3-22 | 3-21 | 3-19 | 2-18 | 3-16 | 2-14 | 3-12 | 2-11 | 3-10 | 3-9 | 2-8 | 4-3 | 3-1 | 1 | 2 | 3 |
|---|---|---|---|---|---|---|---|---|---|---|---|---|---|---|---|---|---|---|---|
| | IgL V | | | | | | | | | | | | | | | | IgL J | | |
| Hu L #6.2 | ✓ | ✓ | ✓ | | ✓ | ✓ | | ✓ | | ✓ | ✓ | ✓ | ✓ | ✓ | ✓* | ✓ | ✓ | ✓ | ✓ |

| | 1-17 | 1-16 | 3-15 | 1-12 | 3-11 | 1-9 | 1-8 | 3-7 | 1-6 | 1-5 | 5-2 | 4-1 | 1 | 2 | 3 | 4 | 5 |
|---|---|---|---|---|---|---|---|---|---|---|---|---|---|---|---|---|---|
| | IgK V | | | | | | | | | | | | IgK J | | | | |
| Hu K #79 | ✓ | ✓ | ✓ | ✓ | ✓ | ✓ | ✓ | ✓ | ✓ | ✓ | ✓ | ✓ | ✓ | ✓ | ✓ | ✓ | ✓ | be under represented. Taken into consideration that these young (~3 months old) rats were housed in pathogen-free facilities and had not been immunized, this compares well with the IgM levels of 0.5-1 mg/ml and IgG levels of several mgs/ml reported for rats kept in open facilities[30, 31]. Interestingly, we were able to visualize class-specific mobility of rat IgG isotypes on SDS-PAGE as demonstrated for monoclonals[29]. In IgG separations (FIG. 4b) a distinct lower γH-chain band is visible in wt but not OmniRat Ig. This band has been attributed to γ2a H-chains, which are not present in the OmniRat (HC14) translocus. As the IgG levels are similar between OmniRats and wt animals we assume class-switching is similarly efficient. The reason that the lack of Cγ2a in OmniRats is not limiting may be that several copies of the transgenic locus favorably increase the level of switch products. Purification of human Igκ and Igλ by capturing with anti-L-chain was also successful (FIGS. 4c and d) and predicted H- and L-chain bands were of the expected size. Confirmation of the IgM/G titers was also obtained by ELISA, which determined wt and OmniRat isotype distribution and identified comparable amounts of IgG1 and IgG2b (not shown).

A direct comparison of human Ig L-chain titers in solid phase titrations (FIGS. 4e and f) revealed 5-10 fold lower levels in OmniRats than in human serum. However, this was expected as human control serum from mature adults can sometimes contain over 10-times higher Ig levels than in children up to their teens[32], which would be similar to the human Igκ and Igλ titers in young rats. Interestingly, wt rats produce very little endogenous Igλ while transgenic rats can efficiently express both types of human L-chain, Igκ and Igλ.

Fully Human Antigen-Specific IgG

Several cell fusions were carried out, using either a rapid one-immunization scheme and harvesting lymph nodes or, alternatively, using booster immunizations and spleen cells (Table 2). For example, a considerable number of stable hybridomas were obtained after one immunization with human progranulin (PG) and myeloma fusion 22 days later. Here cell growth was observed in ~3,520 and ~1,600 wells in SD control and OmniRat hybridoma clones, respectively. Anti-progranulin specific IgG, characterized by biosensor measurements, was produced by 148 OmniRat clones. Limiting dilution, to exclude mixed wells, and repeat affinity measurements revealed that OmniRat clones retain their antigen specificity. A comparison of association and dissociation rates of antibodies from SD and OmniRat clones showed similar affinities between 0.3 and 74 nM (Table 4 and data not shown). Single immunizations with human growth hormone receptor (hGHR), TAU receptor coupled to keyhole limpet hemocyanin (TAU/KLH), hen egg lysozyme (HEL) or ovalbumin (OVA), followed by lymph node fusions also produced many high affinity human antibodies often at similar numbers compared to wt.

Furthermore, conventional booster immunizations with human PG, hGHR, human CD14 and HEL resulted in high affinities (pM range) of IgG with human idiotypes. OmniRats always showed the expected 4- to 5-log titer increase of antigen-specific serum IgG, similar to and as pronounced as wt rats (Table 4a). Although the results could vary from animal to animal, comparable numbers of hybridomas producing antigen-specific antibodies with similarly high affinities were obtained from wt animals (SD and other strains) and OmniRats. A summary of individual IgG producing lymph node and spleen cell fusion clones, showing their diverse human $V_H$-D-$J_H$, human Vκ-Jλ or Vλ-Jγ characteristics and affinities are presented in Table 4b. The immunization and fusion results showed that affinities well below 1 nM (determined by biosensor analysis) were frequently obtained from OmniRats immunized with PG, CD14, Tau, HEL and OVA antigens. In summary, antigen-specific hybridomas from OmniRats could be as easily generated as from wt animals yielding numerous mAbs with sub-nanomolar affinity even after a single immunization.

TABLE 4a

Diverse antigen-specific rat IgG hybridomas with fully human idiotypes[a]

| Animal | Antigen | Cells* | fusions | titer | hybrids | IgGs** | Kd*** |
|---|---|---|---|---|---|---|---|
| SD | PG | LN | 1 | 38400 | 3520 | 38 | 0.3-1.0 nM |
| OmniRat | PG | LN | 1 | 12800 | 1600 | 148 | 0.7-2.4 nM |
| SD | PG | SP | 1 | 51200 | 8000 | 29 | ND |
| OmniRat | PG | SP | 1 | 51200 | 36000 | 24 | ND |
| OmniRat | hGHR | LN | 3 | 4800 | 704-1024 | 18, 3, 2 | ND |
| SD | hGHR | SP | 1 | 204800 | 53760 | 230 | 0.07-0.4 nM |
| OmniRat | hGHR | SP | 1 | 76800 | 53760 | 7 | 0.16-2.4 nM |
| OmniRat | CD14 | SP | 2 | 102400 | 2800-3500 | 54, 14 | <0.1-0.2 nM |
| SD | TAU/KLH | LN | 1 | 20000 | 1728 | 99# | 0.6-2.4 nM |
| OmniRat | TAU/KLH | LN | 1 | 4800 | 1880 | 118# | 0.5-3.2 nM |
| SD | HEL | LN | 1 | 12800 | 1564 | 26 | 0.02-0.1 nM |
| OmniRat | HEL | LN | 3 | 25600 | 288-640 | 0, 2, 7 | 0.6-1.5 nM |
| SD | HEL | SP | 1 | 6400 | 30720 | 0 | ND |
| SD | OVA | LN | 1 | 9600 | 1488 | 10 | 1.1-4.8 nM |
| OmniRat | OVA | LN | 4 | 8000 | 512-2240 | 0, 30, 0, 1 | 0.7-1.5 nM |

*cell numbers were 3-9 × 10^7 per fusion
**antigen specificity confirmed by biosensor analysis
***range of 5 highest affinities
8 mAbs were specific for Tau-peptide TABLE 4b

| Antigen | Fusion Cells[a] | Clone | $K_D$ (nM) | IGHV | AA changes | IGHD |
|---|---|---|---|---|---|---|
| PG | LN | 8080.1B2 | 0.7 | 4-31 | 2 | 7-27 |
| PG | LN | 8080.2B3 | 1.4 | 3-23 | 1 | 3-3 |

TABLE 4b-continued

| Antigen | Fusion Cells[a] | Clone | $K_D$ (nM) | IGHV | AA changes | IGHD |
|---|---|---|---|---|---|---|
| hGHR | LN | 9045.8A3 | 2.4 | 1-2 | 6 | 6-19 |
| hGHR | LN | 9046.6E10 | 4.2 | 1-2 | 7 | 3-16 |
| TAU/KLH | LN | 8898.2B10 | 0.8 | 4-39 | 5 | 3-22 |
| OVA | LN | 9477.2F4 | 2.7 | 3-23 | 6 | 1-26 |
| OVA | LN | 9477.2A9 | 3.9 | 3-11 | 5 | 3-10 |
| HEL | SP | 1H2 | 0.9 | 3-23 | 15 | 6-19 |
| HEL | SP | 3C10 | 0.8 | 6-1 | 1 | 6-19 |
| β-gal | SP | 5005.6C1 | nd | 6-1 | 5 | 2-21 |

| Antigen | IGHJ | CDR3 | IGκ/λV | AA changes | IGκ/λJ |
|---|---|---|---|---|---|
| PG | 3 | CATGTGEDAFDIW | LV3-10 | 1 | 2 or 3 |
| PG | 4 | CAKGIGSALITPPDYW | LV3-19 | 2 | 2 or 3 |
| hGHR | 3 | CARVGQWLNAFDIW | LV2-14 | 9 | 2 or 3 |
| hGHR | 4 | CARRGDGAFDYW | LV2-23 | 5 | 2 or 3 |
| TAU/KLH | 4 | CARHRYYYDSRGYFIFDYW | KV4-1 | 0 | 2 |
| OVA | 4 | CAKEWGYGGSYPFDYW | KV1-17 | 1 | 5 |
| OVA | 4 | CARAYYYGSGSSLFDYW | KV1-6 | 12 | 4 |
| HEL | 4 | CAKREYSSDWYPFDHW | KV3-11 | 1 | 2 |
| HEL | 1 | CAREGSSGWYGFFQHW | KV1-5 | 0 | 5 |
| β-gal | 4 | CARTPRLGLPFDYW | KV1-12 | 0 | 4 |

[a]OmniRats (HC14/Huκ and/or Huλ/JKOJKO/KKOKKO) and control SD rats were immunized with human prograulm (PG), human growth hormone receptor (hGHR), human CD14, Tau-peptide (TAU-KLH), hen egg lysozyme (HEL), ovalbumin (OVA) or β-galactosidase (β-gal).
*Lymph nodes (LN) or spleen cells (SP) were fused after single or multiple administration of antigen, respectively.

Discussion

A combination of human and rat genes to assemble a novel IgH locus has resulted in highly efficient near normal expression of antibodies with human idiotypes. Moreover, integration of the human Igκ and Igλ loci revealed that chimeric Ig with fully human specificity is readily produced and that association of rat C-regions with human L-chains is not detrimental. Advantages of using part of the rat IgH locus are that species-specific C regions and enhancer control elements are kept in their natural configuration, with essentially only the diverse human $V_H$ D $J_H$ region being transplanted. Furthermore, expression of antibodies with rat Fc-regions allow normal B-cell receptor assembly and optimal activation of the downstream signaling pathway essential for the initiation of highly efficient immune responses. In particular, the quality of an immune response to antigen challenge relies on combined actions of many receptor associated signaling and modifier components (see: www.biocarta.com/pathfiles/h_bcrpathway.asp).

The approach of using YACs and BACs, and interchanging between the two, has the advantage of both, speed and the ability to check integrity when making constructs of large regions by overlapping homology. Several founder rats carried low translocus copy numbers; with the rat C-gene BAC in OmniRat likely to be fully integrated in 5 copies as determined by qPCR of Cμ and Cα products (not shown). Identification by FISH of single position insertion in many lines (see Table 1d) confirmed that spreading or multiple integration of BAC mixtures were rare; an advantage for breeding to homozygosity, which was achieved. Little was known whether extensive overlapping regions would integrate, such as to maintain the full functionality, essential for DNA rearrangement. Previously, overlapping integration has been reported but for much smaller regions (<100 kb)[24, 33] and our results suggest that desired integration by homology or in tandem is a frequent event. This eases the transgenic technology substantially as no laborious integration of large YACs into stem cells and subsequent animal derivation therefrom has to be performed[18, 19]. In addition, ZFN technology, also performed via DNA injection[11, 12], produced Ig KO strains easily and may well be the future technology of choice for gene disruptions and replacement. Silenced endogenous Ig gene expression in OmniRats, containing human-rat IgH and human IgL loci, has the advantage that no interfering or undesired rat Ig could give rise to mixed products. Interestingly, immunization and hybridoma generation in OmniRats still producing wt Ig revealed that many products were fully human, human-rat IgH and human IgL, despite incomplete Ig KOs. Here, despite the extensive number of wt V genes, it was remarkable that the introduced human genes amplified readily and thus showed to be efficient expression competitors. This is in line with the observation of generally good expression levels of all our integrated transgenes, which favorably compete with the endogenous loci. Previously in mice expressing a human antibody repertoire, Ig KOs were essential as little expression of human products was found when wt Ig is released[8, 18].

It is possible that the production of fully human Ig loci even in Ig KO mice is suboptimal as strain specific cis-acting sequences are required for high-level expression. In the mouse an enhancer region downstream of Cα plays a vital role in class-switch recombination[34] and it is likely that elements in that region may facilitate hypermutation[23]. This may be the reason why immune responses and generation of diverse hybridomas at high frequency may be difficult in mice carrying even a large fully human locus[35, 36]. As the chimeric human-rat IgH locus facilitates near wt differentiation and expression levels in OmniRats, it can be concluded that the endogenous rat C region and indeed the ~30 kb enhancer sequence 3' of Cα are providing optimal locus control to express and mature human $V_H$ genes. Another region, Cδ with its 3' control motif cluster[26], has been removed from the chimeric C-region BAC since silencing or a lack of IgD did not appear to reduce immune function[37 and refs therein]. Normally, mature IgM$^+$IgD$^+$ B-cells down-regulate IgD upon antigen contact, which initiates class-switch recombination[37]. Thus, switching may be increased without IgD control, which is supported by our finding that IgG transcripts and serum levels are significantly lower when the Cδ region is retained in transgenic constructs (data not shown).

The production of specific IgG in OmniRats is particularly encouraging as we found that in various immunizations mAbs with diversity in sequence and epitope, comparable to what was produced in wt controls, could be isolated via spleen and lymph node fusion. V-gene, D and J diversity was as expected and nearly all segments were found to be used productively as predicted[27]. This was in stark contrast to mice carrying fully human transloci where clonal expansion from a few precursor B-cells produced little diversity[23]. Since the number of transplanted V-genes is only about half of what is used in humans we anticipated to find restricted immune responses and limited diversity when comparing OmniRats with wt animals. However, this was not the case and a comparison of CDR3 diversity in over 1000 clones (sequences can be provided) revealed the same extensive junctional differences in OmniRats as in wt animals. The few identical gene-segment combinations were further diversified by N-sequence additions or deletion at the $V_H$ to D and/or D to $J_H$ junctions and also by hypermutation. Thus, it is clear that the rat C region sequence is highly efficient in controlling DNA rearrangement and expression of human $V_H DJ_H$. Extensive diversity was also seen for the introduced human Igκ and Igλ loci, similar to what has previously been shown in mice[22, 23, 38]. Hence, substantially reduced efficiency in the production of human antibodies from mice[7] has been overcome in OmniRats, which diversify rearranged H-chains reliably and extensively by class-switch and hypermutation to yield high affinity antibodies in bulk rather than occasionally. The yield of transgenic IgG and the level of hypermutation, impressively utilized in antigen-specific mAbs, showed that clonal diversification and production level are similar between OmniRats and wt animals. Routine generation of high affinity specificities in the subnanomolar range was even accomplished by different single immunizations and again compares favorably with wt animals; results that have not been shown in transgenic mice producing human antibody repertoires from entirely human loci[18].

In summary, to maximize human antibody production an IgH locus that uses human genes for antibody specificity but rodent genes for control of differentiation and high expression should be regarded essential. L-chain flexibility is a bonus as it permits highly efficient human IgH/IgL assembly even when wt Ig is present. For therapeutic applications chimeric H-chains can be easily converted into fully human Abs by C-gene replacement without compromising the specificity.

All patents and patent publications referred to herein are hereby incorporated by reference.

Certain modifications and improvements will occur to those skilled in the art upon a reading of the foregoing description. It should be understood that all such modifications and improvements have been deleted herein for the sake of conciseness and readability but are properly within the scope of the following claims.

REFERENCES

1. Chan, A. C. & Carter, P. J. Therapeutic antibodies for autoimmunity and inflammation. *Nature reviews. Immunology* 10, 301-316 (2010).
2. Enever, C., Batuwangala, T., Plummer, C. & Sepp, A. Next generation immunotherapeutics—honing the magic bullet. *Current opinion in biotechnology* 20, 405-411 (2009).
3. Brüggemann, M., Smith, J. A., Osborn, M. J. & Zou, X. Part I: Selecting and shaping the antibody molecule, Selection Strategies III: Transgenic mice, in Handbook of Therapeutic Antibodies. Ed. Dübel, S. *Wiley-VHC*, 69-93 (2007).
4. Green, L. L. Antibody engineering via genetic engineering of the mouse: XenoMouse strains are a vehicle for the facile generation of therapeutic human monoclonal antibodies. *Journal of immunological methods* 231, 11-23 (1999).
5. Ishida, I. et al. Production of human monoclonal and polyclonal antibodies in TransChromo animals. *Cloning and stem cells* 4, 91-102 (2002).
6. Kuroiwa, Y. et al. Cloned transchromosomic calves producing human immunoglobulin. *Nature biotechnology* 20, 889-894 (2002).
7. Lonberg, N. Human antibodies from transgenic animals. *Nature biotechnology* 23, 1117-1125 (2005).
8. Bruggemann, M. et al. A repertoire of monoclonal antibodies with human heavy chains from transgenic mice. *Proceedings of the National Academy of Sciences of the United States of America* 86, 6709-6713 (1989).
9. Kitamura, D., Roes, J., Kuhn, R. & Rajewsky, K. A B cell-deficient mouse by targeted disruption of the membrane exon of the immunoglobulin mu chain gene. *Nature* 350, 423-426 (1991).
10. Davies, N. P. & Bruggemann, M. Extension of yeast artificial chromosomes by cosmid multimers. *Nucleic acids research* 21, 767-768 (1993).
11. Geurts, A. M. et al. Knockout rats via embryo microinjection of zinc-finger nucleases. *Science* 325, 433 (2009).
12. Menoret, S. et al. Characterization of immunoglobulin heavy chain knockout rats. *European journal of immunology* 40, 2932-2941 (2010).
13. Flisikowska, T. et al. Efficient immunoglobulin gene disruption and targeted replacement in rabbit using zinc finger nucleases. *PloS one* 6, e21045 (2011).
14. Xian, J. et al. Comparison of the performance of a plasmid-based human Igκ minilocus and YAC-based human Igκ transloci for the production of a human antibody repertoire in transgenic mice. *Transgenics*, 333-343 (1998).
15. Anand, R. Yeast artificial chromosomes (YACs) and the analysis of complex genomes. *Trends Biotechnol* 10, 35-40 (1992).
16. Davies, N. P., Rosewell, I. R. & Bruggemann, M. Targeted alterations in yeast artificial chromosomes for inter-species gene transfer. *Nucleic acids research* 20, 2693-2698 (1992).
17. Zou, X., Xian, J., Davies, N. P., Popov, A. V. & Bruggemann, M. Dominant expression of a 1.3 Mb human Ig kappa locus replacing mouse light chain production. *FASEB journal: official publication of the Federation of American Societies for Experimental Biology* 10, 1227-1232 (1996).

18. Mendez, M. J. et al. Functional transplant of megabase human immunoglobulin loci recapitulates human antibody response in mice. *Nature genetics* 15, 146-156 (1997).

19. Davies, N. P. et al. Creation of mice expressing human antibody light chains by introduction of a yeast artificial chromosome containing the core region of the human immunoglobulin kappa locus. *Biotechnology* (N Y) 11, 911-914 (1993).

20. Davies, N. P., Popov, A. V., Zou, X. & Brüggemann, M. Human antibody repertoires in transgenic mice: Manipulation and transfer of YACs. *IRL Oxford*, 59-76 (1996).

21. Lonberg, N. et al. Antigen-specific human antibodies from mice comprising four distinct genetic modifications. *Nature* 368, 856-859 (1994).

22. Nicholson, I. C. et al. Antibody repertoires of four- and five-feature translocus mice carrying human immunoglobulin heavy chain and kappa and lambda light chain yeast artificial chromosomes. *J Immunol* 163, 6898-6906 (1999).

23. Pruzina, S. et al. Human monoclonal antibodies to HIV-1 gp140 from mice bearing YAC-based human immunoglobulin transloci. *Protein engineering, design & selection: PEDS* 24, 791-799 (2011).

24. Wagner, S. D., Gross, G., Cook, G. P., Davies, S. L. & Neuberger, M. S. Antibody expression from the core region of the human IgH locus reconstructed in transgenic mice using bacteriophage P1 clones. *Genomics* 35, 405-414 (1996).

25. Popov, A. V., Butzler, C., Frippiat, J. P., Lefranc, M. P. & Bruggemann, M. Assembly and extension of yeast artificial chromosomes to build up a large locus. *Gene* 177, 195-201 (1996).

26. Mundt, C. A. et al. Novel control motif cluster in the IgH delta-gamma 3 interval exhibits B cell-specific enhancer function in early development. *J Immunol* 166, 3315-3323 (2001).

27. Lefranc, M.-P. & Lefranc, G. The immunoglobulin factsbook. *FactsBook Series, Academic Press, GB*, 45-68 (2001).

28. Reynaud, S. et al. Interallelic class switch recombination contributes significantly to class switching in mouse B cells. *J Immunol* 174, 6176-6183 (2005).

29. Bruggemann, M., Teale, C., Clark, M., Bindon, C. & Waldmann, H. A matched set of rat/mouse chimeric antibodies. Identification and biological properties of rat H chain constant regions mu, gamma 1, gamma 2a, gamma 2b, gamma 2c, epsilon, and alpha. *J Immunol* 142, 3145-3150 (1989).

30. Bazin, H., Beckers, A. & Querinjean, P. Three classes and four (sub)classes of rat immunoglobulins: IgM, IgA, IgE and IgG1, IgG2a, IgG2b, IgG2c. *European journal of immunology* 4, 44-48 (1974).

31. McGhee, J. R., Michalek, S. M. & Ghanta, V. K. Rat immunoglobulins in serum and secretions: purification of rat IgM, IgA and IgG and their quantitation in serum, colostrum, milk and saliva. *Immunochemistry* 12, 817-823 (1975).

32. Shansab, M., Eccleston, J. M. & Selsing, E. Translocation of an antibody transgene requires AID and occurs by interchromosomal switching to all switch regions except the mu switch region. *European journal of immunology* 41, 1456-1464 (2011).

33. Bruggemann, M. et al. Human antibody production in transgenic mice: expression from 100 kb of the human IgH locus. *European journal of immunology* 21, 1323-1326 (1991).

34. Vincent-Fabert, C. et al. Genomic deletion of the whole IgH 3' regulatory region (hs3a, hs1,2, hs3b, and hs4) dramatically affects class switch recombination and Ig secretion to all isotypes. *Blood* 116, 1895-1898 (2010).

35. Davis, C. G., Gallo, M. L. & Corvalan, J. R. Transgenic mice as a source of fully human antibodies for the treatment of cancer. *Cancer metastasis reviews* 18, 421-425 (1999).

36. Lonberg, N. Fully human antibodies from transgenic mouse and phage display platforms. *Current opinion in immunology* 20, 450-459 (2008).

37. Chen, K. C., A. New Insights into the Enigma of Immunoglobulin D. *Immunol Rev* 237, 160-179 (2010).

38. Popov, A. V., Zou, X., Xian, J., Nicholson, I. C. & Bruggemann, M. A human immunoglobulin lambda locus is similarly well expressed in mice and humans. *The Journal of experimental medicine* 189, 1611-1620 (1999).

39. Marchuk, D. & Collins, F. S. pYAC-R C, a yeast artificial chromosome vector for cloning DNA cut with infrequently cutting restriction endonucleases. *Nucleic acids research* 16, 7743 (1988).

40. Kaur, R., Ma, B. & Cormack, B. P. A family of glycosylphosphatidylinositol-linked aspartyl proteases is required for virulence of Candida glabrata. *Proceedings of the National Academy of Sciences of the United States of America* 104, 7628-7633 (2007).

41. Nelson, D. L. & Brownstein, B. H. YAC libraries: A user's guide. *Freeman and Company, NY* (1994).

42. Gietz, D. & Woods, R. A. Transformation of yeast by the lithium acetate single-stranded carrier DNA/PEG method. *Methods in Microbiology* 26, 53-66 (1998).

43. Peterson, K. R. Preparation of intact yeast artificial chromosome DNA for transgenesis of mice. *Nature protocols* 2, 3009-3015 (2007).

44. Beverly, S. M. Characterization of the 'unusual' mobility of large circular DNAs in pulsed field-gradient electrophoresis *Nucleic acids research* 16, 925-939 (1988).

45. Kawasaki, K. et al. Evolutionary dynamics of the human immunoglobulin kappa locus and the germline repertoire of the Vkappa genes. *European journal of immunology* 31, 1017-1028 (2001).

46. Sambrook, J. & Russell, D. W. Molecular Cloning. A laboratory Manual. *Cold Spring Harbor Laboratory Press, NY* (2001).

47. Gu, H., Wilson, D. & Inselburg, J. Recovery of DNA from agarose gels using a modified Elutrap. *Journal of biochemical and biophysical methods* 24, 45-50 (1992).

48. Yang, X. W., Model, P. & Heintz, N. Homologous recombination based modification in *Escherichia coli* and germline transmission in transgenic mice of a bacterial artificial chromosome. *Nature biotechnology* 15, 859-865 (1997).

49. Meisner, L. M., and J. Johnson Protocols for cytogenetic studies of human embryonic stem cells. *Methods* 45, 133-141 (2008).

50. Kishiro, Y., Kagawa, M., Naito, I. & Sado, Y. A novel method of preparing rat-monoclonal antibody-producing hybridomas by using rat medial iliac lymph node cells. *Cell structure and function* 20, 151-156 (1995).

SEQUENCE LISTING (11 sequences)

SEQ ID NO: 1 - DNA, 30702 bp, Rattus rattus
  misc_feature (12962)..(13011): n is a, c, g, or t
tgctactgagccaccttgcctgcccctactccttaaataaactctgtgctcatccaaagtatccctgcacttccatccagtgcctgtccatcatccttagggtctacaaaacactgggaggggtcagggcccagggaaggaggaacccccaccacctgagcttgtaaggcctcagagactctgaaggacctacatgcctagagtatatgtgtatgcatgtatacgtattagtgagtgcctttgcgtgtgtacctgtgtgtaacaagagaggagtgagtttgtgcgtgcctacgggtttatataggtatgtatatgggcataagtgcatacgcctttaagtgtgagcatatctgtgtccccgtgagcacatgtgtgtctgtgtatgcctatgagtgtgcacgtatctgtgtatgctcatgttggtggaaacatgtgtgcctatagtgtgtgtacctgccaggtggatgtgcaatgaaagggaggtgagaatgggggtgaagtccgagatgagcagattcagccaagacaggcaaacctcaggggagagtcccaagagcagtgggttgctgcagaggtactctgaatggtacttctgaatggtggtgtggctgtctgagtataagattacagcttttgtcccaaacaagaaagggatagatggagcaagagagtagcaagaccaaggctggtactgcctgggagtcacaataggaacggtagaggagtgaggagatgaatccaaggggcactgggaagaagatgccacccaccctcagtgggccagccctgaatggagacgtgcatagccactcagggtgaccactgactcatgagaaagagacataacatggcacagacagccctcagcagcaccctgctctgcatatatgcacatgggcatacaccctggtctgcatacaggtacatgggcatacacgcacatacatttgcacactcacacagacccgaaccctggaggaggacgaagttcacagcccacacgcagcttctggaaagcaatgggagtcccctcccaagcccaaccatgacaactcatggacaagtctataagctcctccaggtggcccctttctaacctaagtctcccttcccatcctgagcccaagtataacaaaccagaaacagggtatgtggcaagctgggaaaagacaggagcaggccatagagaccactctcacacaggccttggcctcctccatgggcacccctagaacacaaagttctacaaccaggtacacttggcacccagatgcccacaagagggcagtggggcccctgctcctgtctcacgggccttcagaacctctccaggggcctggtttctagcaacttccctctgctgtcagagcaaggcccatgcacaccctggataccctccagcttgaaagtccacttccccgaggatagcaaaagcgacaggccagctttggaaacctgacccagaaaagcacgatagccacccatggaacccaaggcctggtccaaaacagaattctagtaaggaggagccaataggtgaaagactgaacacacacagggagagaagacagaggagcacgatagtcgagagaggggggctggtgggtgaggcgatgagtgagtgactggaacaaggttgggtggatatgcagatgaatgatgggaatggtggatggactgatggatggctgcagtgacagaaatatgagtgactgagtatcggcacacagtccctacctccacttaaaatcaaagttctatgcgcggagactctgagggcagtggggttgtctctaccgggagactttagtgttggttaacccccccccaagttctttataatgcaacagaatcctctgaccacatgtccaccccttggtattccaacctcggcccagaaatcaccttggcctgtatctgtttgagagtgtccgatcttaccgaaccctagtacccaggccaagttcaacctaagaactggggcttttgtgaggtgttgctaaatgtctagagaggtctgagacaagtggccttgggctcaaactcttctcagagcctcaaagacagaaacaactctcttaccatgatagttctctaattaagatcccctgagggaaagagagagagtcaggtcttggggggcatctcaagaacttcaaggattccagccccttacctgggaccctgccttctcattatcccagaacaagtcccttctcagagataaggaacccctgccaccaccgtccccaaagcccaagggggcatagaaacagaggccttaagcctgagcccccatccccatgggtttggatctagaaggtcatctatgtcttacagaatgccaagagccaccttcctacgtgatactggaccagtcacaagacatcctggaggaagagaccccgggtgccagtctgtggcccaccgctgtgaccttcctcaccctcttcctactgagcttgttctacagcacagcactcaccgtcacaactgtacgaggcccatttggcagcaaagaggtcccccagtactgaccaggagccagccacaggtggctgtcatggagacggtggggtacagggtgggggcaggggccttgaggatttactcagcccctccacatgtggccttgcaacccttcacagacatcaaggaagtggaaggaagtagaaggaaattatggcagcacttcctgggtttaacccagtcttccagaagccaggctgagacctcagcaaaagcaaagacataacccaactccaggatcctcccctctggctgaccacttgtgtctttgcacggatgaagcttggagaaagtcctctatgtttcagagactgatgtgacagcttcccacccgactcccatactttgctgagcaataaactggtgcaaaagcacagtttcttactctcaaaaacaaaagttaacaaaggattgggtgagggggtcagagatagtgtggtggtgccatgctaaactgttgcttacggtatagaatgtggcagcattgggcagggcagacacagggtgaccactgtctagtatccgagacaaccgtgtgtagctgtagccaagatgaacactgactgacttcaacaagtatttgtggcctcttcagacccaataccaggccattagcttgatctctggacctgacttctaaacatttggcctctgtgaacacccttgccaaacactggtcctggttgtgaaccttggtcctgaatactgagccttatcttggtaactgaaccataatcctgatccctgacctcagtcacgatcatgaaaccctggtcctggccactcgttccaataactggtccctagtcctgagccctgagtcctggtccaggtcactgaatcctggtcatgatcaatgggtttggtcctcattcctgagcctagtcttgatcactgatcactggttctgatcattaacaactaacctgatcactagtccccattcctaatcactgggccgcgatactgatcactgaaccctgtttctaaacaatgtgtagtgaaatgtatggtaaaacctttgcatctggctttgagtgaaatgtttcggcagacctttgctatgttttgggttagtcaggaaaggctgagaaatggttttgaggctgtttgaaccttgaagaaatgttgtctccctggacaatctgcacttggtactacattaaggtttgcagttgcacacaccttggtcctaaacactcctggcagacttagaactcttacgtttgattatggctagccatagttgaaaagggctgagagttgtatgggtggtctgctctctctcgcagcaagggcaagatgactttggtagttgaaaactttcccagccccaactaactctgtataatgtttgaataaagtaacggcagtaggctagttgtggttaatttttattccaagaagaatgaacccctctgctccttcagaaaaggaaggcttagcattttggtgagcttctctctactgaggcacctatgaccaactcagtgttctttgattcctgtcaccacatccagtcttgatcactaagtgccagtcctcatcactaaaccctggtctccaccagtctgcttgggttctgataatcagactcacattctgataactgggccctgattctggtcactagctctttgccctggtcatggacatttgaccctagtccacggcactgagttctgggcatggaccctgggccctagtcctaggtactgggttctggttctaacaactaggtcctgtactgatcaatgggccctgacctagacattgggccctggtcctcaacatcaacttctaagcctgaactctagccccaaattctgcttatcaacactggtcctggaccttggtcctcatcacacatccattctctgagacccaaggaatcagtggtattttgcaagaagtccctttgatattccaagcctcattctcattaggaagatctcttcaggggattcctgcagaaggttccagaatccccaccacactgttcacatactgggctgcaactgggacagtgaccccttttgctcatggaaacaaagcaggcccaggccctgtgagctggagcctctggcctggggtctacagatgtggggtcagcattgtggagaaggtttgcagggcaggtgtgggggtagggcagggatggtcacattagcatcttgtttttctttcttctgaagtctctgttttctatcacctgctgaaacattcaaagtagctccaagctgaggccagctgagtcatcctgagcctatctcagcccaggtgcctcaaaacagagctactgttctgagaatcacaccaccctggaccaggccaggtgggtctggggctggatgaggggtcagagccaggggagccctgacagggactgagaaggccccaacccccatcactcaaggttctccacaaccatccacagtcatgccttagtgaggccatgttctgtcccaatgagaacaagtccaattaagattaagtctggtcttcccagggtcattcagtgtcaaggagtgtcaaccaaggccagccaaggccagcctgaggtcagccagcatcacccaaggacacacaactattctagtagacaactagaatagtcagctcaacagggccctggtgatgcaaaatggagagtgtattcctgccagacagggctccacagataggctccctcactgcatatgacctccctgaatgtttcccacactgcagttggttctagactacttcttgataagcatgcagaaagataacaggataagaaattttatgcagagaacagaagtatctacggaatagaatagaagatagatagtagaagtctgctacaggccccagtggagtctctttgtagagtcaagagatcaaacctaaactgagtctcaggattgagtccagtacagaagcaaccttcaggatgctaaagaccatacaggcaatggacagaatggagtccagacagaccaatgagtggacagtccaatctcacataatgaaccatgtcaagagcagatagtgagccaaagaaggctctgggacactcggagattctcggcctctggatctcctgatgtatataccaggtgatcaagtgacagtctagtggagccattgccatcacagtgtcaggtgtcctccccttcatgggttccggtgaggatgtggcacctccctttagttggacgtgtacaataaattctcaggcctggtatgatttttaatgatccatgtgtttctatagtcttaattatctttaataaaattatagggtgacaccaaatttagggataagttatttatcaggctgtgcctttggaaggtgacgttatttacatagccaccaaggtgcccagtcatcggcccatcttccaaacggagtcaagggccatttgaaacagtgaaatccctcagggcaagggacacaacatggaggaatttaaaacagagtacagcttgatcttaacacacacacacacacaaacgtaagagatggaaaaggggatcaagggacacagaagtacagagaaaacaagacagtaagggatgtagagatgagaggtaaccacagggaaaggtgagacacaaagacgagaggagaaagacacagggacagaaagacccatgcaagcaagagagacagacataaggaagaaaaggcgagaagagacagacaaaggtgcagcaatgtggcccacctggtactcacaagaaggccctggcacacactccgatgagagccatgcacctacaaacacgtagacacagctccacacagacacacacggcatctgcacaactgtctgaacctcaaacaggtctgcccactccctctcctccaggcctttgtccttaggaaggcacgctgagggtaactcagtcgggatacttctgattggggctcactgaacagcctgaggctgggtccacagttgctctcactgtctggccctgtaccccaggtcatgcttcagagggaattaactgaatgcagtaaacaccgtctgtggtcagcatgtactaagggatagaaccctatcaggatttgtccaactaaggtccaaatacagagtgaagaagacgatgggggagatcagatggcagatgggagcactctggatagagctcagggatatggtggctgaggaacattacagctgccaggcttggcctttcatctcagctctaggtcaaggggaactacccaggtctctgctttgttgctggtaactatacctaagtctaagaacctcagtaagacacagaaccagtaagacgacagcctccatcgataagaaagaaaggagaaaggcagaatggataagtctctggacagatgagagcctacacccaaaaacagttcgttcagccagttaatagggtgtagccctagcacacgagagaaaacagttccacaggtgtaagggagtaaatctgtgcgaaggggtactgcttgagctcctcatggcctggtccagaagcagaagctgggcaggggcaaaggacagggtaaggcagggagacaggggcatgaaggagcctttgggactgtgtggtgagaactaggctgtgcttttactgagcctgagtttgtggcagttgcctcatggggaaggcacccagaggtaaggcagaggaaaggagtaactagggctgagggcaccacagggtctgaggaattagaggcagctatgacccatttgtcatggtatttggacatgtacttcatggacacagatctgagaaccaggcctggctctcactaaccagcaggaggtgtcccacttgtggctgtaggtctttcagcacaccatgccatgggcctctcacactggacgatctgtctgaaaggctgatgttgggaggtgggagcccaggcctggggtctgggacactgggtgacagaggtgtccagaatgtagagtgctcagagtgtgggtggggacaagctgtagagtgtccccatgaggggacaggctgagatagggactgaagtccatctacaggcttaccacactccatgctctggatgagagcactgagctctgccaccctacaacagcaggcagagcggcctccatgctaggaaagccaggcagcagggacagagttcctggatggggcaggtggaattgtctctgctcggcatcaaactaagtggaccttcagcagtaaggtcttactgtctagtcatggtggacagccaggaacatagtcaatgaacagcctgctttgtttggattcctctggagacttcctgatcaataacttgtaggcctccatgtttcatgtgacaacttacatctctctatgtataacatgggctttctgtgtagtcctgggtatcctagaacaccctgtgtagaccaggctggcttcaaacttgggacatcctcctgtctctgccttctaataaatgctgggattaaaggctgtgccaccacacacaatctaacccatttcttctgggaataacactgttcacccagccatacactgagttaaaattccttaataaatgttagttcatttacaaaatagtggatttccataaggcttcttcatggatcctaatccaacttttaccttctcttttccccaatcctccaatccccctattcccacttaaatctgaaatccccctccctccattttcaagctgcctgtgttctatgtcccctcatattgtttttttcttgtgtggaggtttgcagatttgaatgcaggaacccttcactggggctaagcctcctgccacccagcacttcccatccccacacctcctcacgcttgatttagcccatgtcccctcatgtgtatgggtgtttctcttcagtctgaggcattactccccgtgtcctctggagagctgcctactgtcacagatacctttcttctgtttctgctagggaaagcttttatttccccttgaattttaatcattgtctgggtgtaataccctgggttgagagctgtgttctttcagaacttggactacgtctatccaggcatctggctttaaagtttctactgtggggctgcagagatggctcagtggttaaccacacatttcttcttgcagaggacttgggcttgattcctagtacctccgtggcagctaagaaccatctgtgactccaactgcacaggattcgatgcccttttctggaggtcatctggagtagtcagctcaacagggccccgggatgcagcatggagagtccatgctgacaggcagggctccacagagagagaaagacagaaacacaggccactgaaagagacagtaatggactgaggggacagagagaaacacacggacagacagacagagataacaaaacaccgacactcatagacacagagaagagaggggacagggaagttttgagagcaatgggtaggaggtgagagagacacagaggcaatacatacagagagtgactccagaagacagagtctgagaggagacactgcaagagacagagaccccaaaagggttgagagcactggatgctttcacagagaatccagattcgattcccagcaggctcatggcagctcatactgcaatcccagttccagagtgccctgaaggatccttcatgcatgtggagcacagaagcgctctctctctctctctctctctctctctctctctctctctctctctctctcagatgaaagccatgaaccagaagacagagacatgagtgaacactcctcagagacatagccacagcactcacacccagttccacacagacacatacagcacctgcctgcctgatccaaaccccaaacccattgacccactccctctcctccaggtctttgttctcagagtagcacactgagggtagctcagcctggatacttcccaaggggcctggacacacagcatgcatctctggtccacagcccccatcccttgttggccctgtaatccatgtgatgtctcaggagaagatgttgtctgagagcagggcctggtacagtgtccctggtacagtgtccctggtacagtgtccctggtacagtctctctagtaaagtctctctggtacagtttccctggtacagtcttcctggtacagtgtccctggtacagtctctctggtaaagtctctctggcacaggatgcctagtatagtctttctggtacaatctgcctggtacagtctgcctagtacagtcttcctggcacagtctatccctggtgcaggcttcaggtcaggcccaagtgtgaagagtgcagaagacagtgggcagagctgagagagcgctagtcagttttgttcagagaacagtgatggccgctccaggctactggacatcccaggtgtgcttcttacacttctcaaagctgtgggaacacaaccgaccctctactcacttcagtgtaattgcctatagcagggcatgcctctgggcatcagggagtcacacagaggcaggtaagactctagacctggggactgagaggggaaggcatgtacaagagggcctcatccttaggacacagggattcgaggcctctggatagccagtgagcaacatatgcagagtgatgaggccccaggagtctaatggacgccaggaggtcacagagctagaggcctggagggctagagtctgtgggaagggggactgcttaggttcttcccacccatgtccaggagcagaggctgggcagggccacaggacagggtaaggcagggagacaggggcatgaaggagcctttgggactgtgtggtgagaactaggctgtgcttttactgagcctgagtttgtggcagctgcctcatggggaaggcacccagaggtaaggcagaggaaaggagtaactagggctgagggcaccacagggtctgaggaattagaggcagctatgacccatttgtcatggtatttggacatgtacttcatggacacagatctgagaactaggcctggctctcactaaccagcaggaggtgtcccacttgtggctgtaggtctttcagcacaccatgccatgggcctctcacactggacgatctgtctgaaaggctgatgttgggaggtgggagcccaggcctggggtctgggacactgggtgacagaggtgtccagaatgtagagtgctcagagtgcgggtgggaacaagctgtagagtgtccccatgaggggacaggctgaggtagggactgaagtccacccaaggctcaccacactccatgctctggatgagagcactgagctctgccaccctacaacagcaggcagagcggcctccatgctaggaaagccaggcagcagggacagagttcctggatgggacaggtggaattgtctctgctctgcatcaaactaagtggaccttcagcagtaaggtcttactgtctagtcatggtggacagccaggaacatagtcaatgaacagcctgctttgtttggattcctctggagacttcctgatcaataacttgtaggcctccatgtttcatgtgacaacttacatctctctatgtataacatgggctttctgtgtagtcctgggtatcctagaacaccctgtgtagaccaggctggcttcaaacttgggacatcctcctgtctctgccttctaataaatgctgggattaaaggctgtgccaccacacacaatctaacccatttcttctggaaacaacactgttcacccagccatacactgagttaaaattccttaataaatgttagttcatttacaaaatagtggatttccataaggcttcttcatggatcctaatccaacttttaccttctcttttccccaatcctccaatccccctattcccacttaaatctgaaatccccctccctccattttcaagctgcctgtgttctatgtcccctcatattgtttttttcttgtgtggaggtttgcagatttgaatgcaggaacccttcactggggctaagcctcctgccacccagcacttcccatccccacacctcctcacgcttgatttagcccatgtcccctcatgtgtatgggtgtttctcttcagtctgaggcattactccccgtgtcctctggagagctgcctactgtcacagatacctttcttctgtttctgctaggggaagcttttatttccccttgaattttaatcattgtctggctgtaataccctgggttgagagctgtggtctttcagaacttggactttgtctatccaggcatctggccttaaagtttctactgtggggctgcagagatggctcagtggttaaccacacatttcttcttgcagaggacttgggcttgattcttagtacctccgtggcagctaagaaccatctgtaactccagctgcacaggattcgatgcccttttctggaggtcatctggagtagtcagctcagcagggccccgggatgcagcatggagagtccatgctgacaggcagggctccacagagagagaaagacagaaacacaggccactgaaagagacagtaatggactgaggggacagagagaaacacacggacagacagacagacagacagacagacagacagacagacagacagagatagataacaaaacaccgacactcatagacacagagaacagaggggacagggaagttttgagagcaatgggtaggaggtgagagagacacagaggcaatacatacagagagtgactccagaagacagagtctgagaggagacactgcaagagacagagaccccaaaagggttgagagcactggatgctttcacagagaatccagattcaattcccagcaggctcatggcagctcatactgcaatcccagttccagggtgccctgaaggatccttcatgcatgtggagcacagaagctctctctctctctctctctctctctctctctctctctacactgtccccatgaagggacacgctgacgtacggactgaagtccacccaaagctcaccacactccatgctctggatgagagcactgagctctgccaccctacaacagcaggcacagcggcctccatgctaggaaagccaggcagcacggacagagttcctggatggggcaggtggaattgtctctgctcggcatcaaactaagtggaccttcagcagtaaggtcttactgtctagtcatggtggacagccaggaacatagtcaatgaacagcctgctttgtttggattcctctggagacttcctgatcaataacttgtaagcctccatgtttcatgtgacaacttacatctctctatgtataacacgggctttctgtgtagtcctgggtatcctagaacaccctgtgtagaccaggctggcttcaaacttgggacatcctcctgtctctgccttctaatccatgctgggattaaagcctgtgccaccacacacaatctaacccatttcttctggaaacnnnnnnnnnnnnnnnnnnnnnnnnnnnnnnnnnnnnnnnnnnnnnnnnnncagtggcacacacacatacacacacacacacacacacacacacacacacacacacacatacactctaatgaaggcagtggcgcacacacacactctcagatgaaagccatgaaccagaagacagagacatgtgtgaacactcctcagagacatagccacagcactcacacccagctccacacagacacatacagcacctgcctgcctgatccaaaccccaaacccattgacccactccctctcctccaggtctttgttctcagagtagcacactgagggtagctcagcctggacacttcccaaggggcctggacacacagcatgcatctctggtccacagcccccatcccttgttggccctgtaatccatgtgatgtctcaggagaagatgttgtctgagagcagggcctggtacagtgtccctggtacagtgtccctggtacagtgtccctgggacagtgtccctggtacagtctccctggtacagtctccctggtacagtctctctagtaaagtctctctggtacagtttccctggtacagtcttcctggtacagtgtccctggtacagtctctctggtaaagtctctctggcacaggatgcctagtatagtctttctggtacaatctgcctggtacagtctgcctagtacagtctccctggtaaagtctgtccctggttcaggcttcaggtcaggcccaagtgtgaagggtgcagaagacagtgggcagagctgagagagcgctagtcagttttgttcagagaacagtgatggccgctccaggctactggacatcccaggtgtgcttcttacacttctcaaagctgtgggaacacaaccgaccctctactcacttcagtgtaattgcgtatagcagggcatgcctctggacatcaggaagtcacacagaggcaggtaagactctagacctggggactgagaggggaaggcatgtacaagagggcctcatccttaggacacagggatttgaggcctctggagagccagtgagcaacatatgcagagtgatgaggccccaggagactgatgggcaccaggaggtcacagagctagaggccgggagggctagagtctgtgggaagggggactgcttaggttcttcccacccatgtccaggagcagaggctgagcagggccacaggacagggtaaggcagggagacaggggcatgaaggagcctttgggactgtgtgatgagaactaggctgtgcttttactgagcctgagtttgtggcagctgcctcatggggaaggcacccagaggtaaggcagaggaaaggagtaactagggctgagggcaccacaggatctgaggatttagaggcagctatgacccatttgtcattgtatttggacatgtacttcatggacacagatctgagaaccaggcctggctctcactaaccggcaggaggtgtcccacttgtggctgtaggtctttcagcacaccatgccatgggcctctcacactggacgatctgtctgaaaggctgatgttgggaggtgggagcccaggcctggggtctgggacactgggtgacagaggtgtccagaatgtagagtgctcagggtgcgggtggggacaagctgtacagtgtccccatgaggggacaggctgaggtagggactgaagtccacccaaggctcaccacactccatgctctggatgagagcactgagctctgccaccctacaacagcaggcacagcggcctccatgctaggaaagccaggcagcagggacagagttcctggatggggcaggtggaattgtctctgctcggcatcaaactaagtggaccttcagcagtaaggtcttactgtctagtcatggtggacagccaggaacatagtcaatgaacagcctgctttgtttggattcctctggagacttcctgatcaataacttgtaggcctccatgtttcatgtgacaacttacatctctctatgtataacacgggctttctgtgtagtcctgggtatcctagaacaccctgtgtagaccaggctggcttcaaacttgggacatcctcctgtctctgccttctaatccatgctgggattaaagcctgtgccaccacacacaatctaacccatttcttctggaaacaacactgttcacccagccatacactgagttaaaattccttaataaatgttagttcatttacaaaatagtggatttccataaggcttcttcatggatcctaatccaacttttaccttctcttttccccaatcctccaatccccctattcccacttaaatctgaaatccccctccctccattttcaagctgcctgtgttctatgtcccctcatattgtttttttcttgtgtggaggtttgcagatttgaatgcaggaacccttcactggggctaagcctcctgccacccagcacttcccatccccacacctcctcacgcttgatttagcccatgtcccctcatgtgtatgggtgtttctcttcagtctgaggcattactccccatgtcctctggagagctgcctactgtcacagatacctttcttctgtttctgctaggggaagcttttatttccccttgaattttaatcattgtctgggtgtaataccctgggttgagagatgtggtctttcagaacttggactttgtctatccaggcatctggccttaaagtttctactgtggggctgcagagatggctcagtggttaaccacacacgttgttcttgcagaggacttgggcttgattcttagtacctccgtggcagctaagaaccatctgtaactccagctgcacaggattcgatgcccttttctggaggtcatctggagtagtcagctcagcagggccccgggatgcagcatggagagtccatgctgacaggcagggctccacagagagagaaagacagaaacacaggccactgaaagagacagtaatggactgaggggacagagagaaacacacggacagacagacagacagacagacagacagacagacagacagacagacagacagacagacagacagacagagataacaaaacaccgacactcatagacacagagaacagaggggacagggaagttttgagagcaatgggtaggaggtgagagagacacagaggcaatacatacagagagtgactccagaagacagagtctgagaggagacactgcaagagacagagaccccaaaagggttgagagcactggatgctttcacagagaatccagattcaattcccagcaggctcatggcagctcatactgcaatcccagttccagggtgccctgaaggatccttcatgcatgtggagcacagaagctcgctctctctctctctctctctctctctctctctctctctctctctctctctcagacacacacacacacacatacacacacacacatacactctcaaatgaaagccatgaaccagaagacagagacatgtgtgaacattcctcagagacatagccacaacactcacacccagttccccgcagacacacaaatcacctgcctccctgttccaaatcccaaacccattaactcactccctctccttcaggcctttgatttcagagtagcacaccgagggtagctcagcctagacacttcccatgggacctggttacatagcgtgcacagggccacctcttgttggccctataacccatgtgatgattcaggaaaagatgttgtctgagagcagggcctggtacagtccccctggtacagtccccctggtacagtctctctggtacagtctccttggtacaggcttcctgatacagtctctctggtacagtctctctggtacaatctgcctcgtacagtctccctgatacagtctgcctggtacagtctctctggtacagtctgcctggtacagtctccctggtacagtctccctgatacagtctgcctggtacagtctctctggtacagcctctctggtacagtcggcctggtacagtctccctggtacagtctccttggtacagtctccctgatacagtctgcctggtacagtctgcctggtacagtctctctagtacagtctgcctggtacagtctgcctgatacagtctgcctgatacagtctgcctggtacagtctccttggtacagtctgcctggtacagtctgcctgatacagtctgcctggtacagtctctctggtacagtctccttggtacagtctccctgatacagtctccttggtgcagtctccctgatacagtctctctggtacagtctgcctggtacagtctccctggtacagtctccttggtacagtctccctgatacagtctgcctggtacagtctccctggtacagtctccctggtacagtctgcctggcacattctatccctggtgcaggcttcaggtcaggcccaagtgtgaagggtgcagaagacagtgggcagagctgagagagcgctagtcagttttgttcagagaacagtgatggctgctccaggctactggacatcccaggtgtgcttcttacacttctcaaagctgtgggaacacaaccaaccctctacccaattcattgtaattgtctatagcagggcatgcctctgggcatcagggagtcacacagaggcaggtaagactctagtcctggggactgtagaaggtatgtaagtacaacagggcctcatccttggaacactggtgtctcaggcttcaatacagccagtgagaaacacatgcagagtgatgtggccccaggagactgatgggcaccaggaggtcacagagctagaggcctggagggctagggtctgtgggaagggggactgcattcactcttcctatgcttgcccaggaacaactgtctatgcagggccacaggacagggtaaggcagggagacaggggcatgaaggagcctttgggactgtatgatgagagtctaggctgtgctctgactgagcctgagtttgtgacagctgtctcatgaggaagacacccagaggccagacagaggaaaagagtaatcagggctgagcggaccacagggtctggggacgtggaggtggctggcctggctcccacaggccctcagatggagctgcacatcatcccatagcatatcactctggagggcttatcaaaatggttgtgctgtgggactgggtctcaggactgaggcctgagatactgggtagcagaacatgttcagtatacagggtgctcagagtacgggggggggggggacaagctctgcagtgttcctccatgttgggacaagcagaaagaggtcttgaagctgtttgtccatccataggcctaacccatactggccctgctcatggccctagcttgggccacatatctagtgcccactgaatcatcaccatgaagactgttggaaaaccagagcctctgatgtcttcctgccttgcttgctctccctgactctcatagctcacacaggctctgccctggtccaccactgtcctcaactgtaaaccatgccaggcacagagagcaaggaatgtggtggtctcagactgtcacacacaacaatcttgtgcctttcacatccacacgcacaagcatgctcatacccctctgtcaggggtcagtggggtcttccttgggctcactcccatttctagctgctccttggtattggtgactgcggctgctgtgtcggtggctgccagagatgcttgatcggcatgacctcagatataggaatggcctggggtcaacagagtgcacacacttagggcactggccagagttctatgtagaccaaggcctctcttcctagtgtgttatttcacaaaaccttatgcaacaacatcttctattccttttattcctctttgtctgctaatggggaattttctagaaagagtgtcccctctctgtcttcctgctgtgtagacagatcttgtaggtgtgatcacagagtggtgtttcccttcttggccattttcaggccaggaactcagggccagagacagaaagtcaggaaggtaggaaagacagggagacataataaaggtgagatggagacagagaaagacaaagggagaaaagcacaggattgcagggagagacaaggagacgcccgacggaaacagacatcagggaaaagacatgattgttcctttagtaaattgctttccggagaaaagagacagcagagagacatggataggcacacaaagatacaaggagagagacaggaaacagagaaagagagaaacagagatggagaaacaacgagggagagagaagagtagagagaaagacacggagaaaaaaaatcaagaaacagaaaagacaaaagataggaagacagagaaataggccagaaatacagacagacagagagatgcctgaagatgttctctctcacctagagaaagaaagcacaggcagagataatacagagagagagagagagagagagagagagagagagagagagagagagagagagagagagaggagagaaagaggagagacacggtgttagaggagaaagcattatgttttgatagagacagagatacagcaactgaggaacagactgagcagaaagaatcccactcagagagagacagaggctaagctgggagaggcaggggtggccagagagggagacagaggagagcctgtgggacaggtcagacaccatcttggaagacccagtgacaagccagggaggtgacaggttagtgcagtttctaccccacagtccacaggctggagccacaggcctgtgtccatgtggccacaggctagctcccagcctgccaagcctgtctgtggagggattgcggagtggggctgggctgaggcaggccaggatttttccagtggagcagccagtgactgggctgagggtcactgcccaccatccccgtgattctgggtagacccaggacctggagcacacacagccttcctgtctctcccacttccctggggtgtttggaccttgcctatctcctgtcattccctcctagggtcagattccagcagtgtcgataaatgggaaaacactgaattcaatgtcaccgttaggggtcatggaacccccagccccatccccaaagctggtcaacctggccagggtggggtgaacctgcagctgcaggtgggggaatcattgatgctatttttggctcagagaatgagaaacatgtttttctgcatggaacaaacatccatttgcatgtgccccgagggccaaccctgcacagagtgagtcactcggcaggtgtgtgtgtgtgtgtgtgtgtgtgtgtgagagagagagagagagagagagagagagagagagagacagagacagagacagagacagacagagagacagagagacagagagagagacagagagagacacacacagagacagagagacagagagagacagagacagagagagacacacacacagagacagagagacagagagagagatgttgtgagcaagccctgtttcaggtactgatatctgtgcccccgtgccccagcccatgtggaaaaactacccttaggggcccattaactcatcacagtccaggccatcatggtgagccctagctgacctaagcaggttccaccctaaacatgaaggaaaataataaaggccatctgttacccagaatcctagggatggtgggcagtgaccctcagcccactcctggccgctccactggaagaatcctggcctgcctcagcccagccccactccgcaatccctccacagacaggcttggcaggctgggagctagcctgtggccacatggacacaggcctgtggctccagcctgtggactgtggggtagaaactgcactaacctgtcacctccctggcttgtcactgggtcttccaagatggtgtctgacctgtcccacaggctctcctctgtctccctctctggccacccctgcctctcccagcttagcctctgtctctctctgagtgggattctctctgctcagtctgtcagccatagttggagagagtccatctatgtttgcctctgtctctgccaattccatcagaggtctctctactaacacttgcctctgcatgtgtctcttggtccttctcctgtcttcccatctctctatctcctcatctctctgtctttctgttactccctgtctctgtctctctgtcttttctctcactgtctttatctctctgcctgtttcatggacttttctctgtctctctgtctctgtctctctgtctctctctctgtctctctctgtctctgtctctctctgcccctatctcttggtctctatctctatcttcaactccctatctttgttcctcatactcacatttacctctttcccaagcccccagtctccaggtctgcctgtttctgtctctcccttgccatgtttccctgttttattctctctcctcctgaatgctctggcttgaaactggccaagaagggaaacaccactctgtgatcacacctacaggatctgtctacacagcaggaagacagagaggcgaccctctttcaccctacagtgtctggacttggttgattccaggttactcctatactcaagtccgggactatggtggtcaagcatctctggcagccactgggacagcagctatagccaccaacatcgagccctgttagctaccaacattagctcctcaaagaggttgggtctataggcctctggtgtgaggagatgttgacagtgagaattagttcccaaggaggacaccactgtttcctgttagatggagaactacagtgggtacgaacatgcttgaacacatgagtgtcaaatgcacaagactgttgggtgtgtcacccttcccctctctgttcatggcatgactgcacactgaacacaatggtggattgggacagagtctgtgtgagttgagaatcatgaagagtgtagacacttcaaggatagtgtagacccttctagttcgtggtgatggctcacttggcactgagtttctgaccccacagggaccatggacaagggcagtatgggctgtgcctatggatacaaaagagacttcgaagcctgtattagcctgtcccctcatggaggaacacagcacagcttgtctctacccacactctgagtactctacgtcctggacacctctgtcacccagtgtcctaggtcccatccttggctcccacatcacatctgcctttcagacagatcttccagtgtgacagacccatttcatggtgctgaacaacataaacccatttcctgagggttggtgagagccggcctggttctcagatctgtgtccatgaagtacatgaccaaataccatgacaaatgggtcatagctgcctctaattcctcagaccctatgggccctcagccctggttactcctttcctcggcctggcctctgggtgccttccccatgaggcagctgccacaaacccaggctcagtcagaacatagcctagttcctaccatacagtcccaaaggttgcttcatgcccctgtctccctgccttagcctgtctgtgctcctgcacagacaagagttcctgggcaagcataggaagagtgaatgcagtccctcttccaacagaccctagccctccaggcctctagctctgtgacctcctggtgtccattagactcctggggcctcatcactctgcatgtgttgctcttgtacatgccttcccctctcagtccccaggtctagagtcttacctgcctctgtgtgacttcctgatgtccagaggcatgccctgctatagacaattacactgaagtgagtagagggtcggttgtgttcccacagctttgagaagtgtaggaagcacacctgggatgtccagtaacctggagcggccatcactgttctctgaacaaaactgactagcattctctcatctctgcccactatcttctgcacccttcacacttgggcctgacctgaagcctgcaccagggacagactttaccaggcagactgtaccaggaagactgtaccagggagattgtaccaggcagagtgtgccaggcagactgtacaaggcacactatatcagagagactttaccatgcagactgcaccagggagactgtaccagggagactgtaccagggagactgcaccagggagactgtaccaggccctgatctcagacaacatcttttactgagacatcacatggattacagggccagcaagaggtgggggctgtggaccagaggctcatactgtgttaccaggtcccatgggaagtgtccaggctgagctaccctcagtgtgctactctgagaacaaaggcctggaggagagggagtgggtcaatgggtttggggtttggatcaggcaggcaggtgctgtgtgtgtctgtgtggaggctgggtgtgagtgctgtggctatgtctctgaggagcgttcactcatgtctctgtctctggttcatggctttcatctgagagagagagagagagagaaagagagagagagagagagagagagagagagagagagagagagagcgcttctgtgctccacatgcatgaaggatccttcagggcaccctggaactgggatttcagtatgaactgccatgaacctgctgggaattgaatctggattctctgtgaaagcatccagtgctctcaacccttttggggtctctgtctcttgcagtgtctcctctcagactctgtcttctggagtcactctctgtatgtattgcctctgtgtctctctcacctcctacccattgctctcaaaacttccctgtcccctctgttctctgtgtctatgagtgtcggtgttttgttatctctgtctgtctgtctgtctgtctgtccgtgtgtttctctctgtcccctcagtccattactgtctctttcagtggcctgtgtttctgtctttctctctctgtggagccctgcctgtcagcatggactctccatgctgcatcccggggccctgctgagctgactactccagatgacctccagaaaagggcatcgaatcctgtgcagctggagttacagatggttcttagctgccacggaggtactaggaatcaagcccaagtcctctgcaagaacaacgtgtgtggttaaccactgagtcatctctgcagccccacagtagaaactttaaggtcagatgcctggatagacaaagtccaagttctgaaagaccacatctctcaacccagggtattacacccagacaatgattaaaattcaaggggaaataaaagcttcccctagcagaaacagaagaaaggtatctgtgacagtaggcagctcttcagaggacacggggagtaatgcctcagactgaagagaaacacccattcacatgaggggacaggggctaaatcaagcgtgaggaggtgtggggatgggaagtgctgggtggcaggaggcttagccccagtgaagggttcctgcattcaaatctgcaaacctccacacaagaaaaaaataatatgaggggacgtagaacacaggcagcttgaaaatggaggatgcttttagcattaaagatttaagtgtagataacagggatgggggaccggggagaggagaggagaggagaggagaggagaggagaggagaggagaggagaggagaggagaggagaggagaggagaggagaggagagatgttcagttatccaaaactaaggatccatgaagaagccttatggaaatccactattttgtaaatgaactaacatttattaaggaattttaactcagtgtatggctgggtgaacagtgttgttcccagaagaatgggttagattgtgtgtggtggcacaggctttactcccagcatttattagaaggcagagacaggaggatgtcccaagtttgaagccagcctggtctacacagggtgttctaggatacccaggactacacagaaagcccgtgttatacatagagagatgtaagttgtcacatgaaacatggaggcctacaagttattgatcaggaagtctccagaggaatccaaacaaagcaggctgttcattgactatgttcctggctgtccaccatgactagacagtaagaccttactgctgaaggtccacttagtttgatgccgagcagagacaattccacctgccccatccaggaactctgtccctgctgcctggctttcctagcatggaggccgctgtgcctgctgttgtagggtggcagagctcagtgctctcatccagagcatggagtgtggtgggcctgtggatggacttcagtccctatctcagcctgtcccctcatggggacactgtacagcttgtccccacccgcaccctgagcactctacattctggacacctctgtcacccagtgtcccagaccccaggcctgggctcccacctcccaacatcagcctttcagacagatcgtccagtgtgagaggcccatggcatggtgtgctgaaagacctacagccacaagtgggacacctcctgccggttagtgagagccaggcctggttctcagatctgtgtccatgaagtacatgtccaaataccatgacaaatgggtcatagctgcctctaaatcctcagatcctgtggtgccctcagccctggttactcctttcctctgccttacctctgggtgccttccccatgaggcagctgccacaaactcaggctcagtaaaagcacagcctagttctcatcacacagtcccaaaggctccttcatgcccctgtctccctgccttaccctgtcctgtggccctgcccagcctctgctcctggacatgggtgggaagaacctaagcagtcccccttcccacagactctagccctcccggcctctagctctgtgacctcctggtgcccatcagtctcctggggccacatcactctgcatatgttgctcactggctatccagaggcctcgaatccctgtgtcctaaggatgaggccctcttgtacatgccttcccctctcagtccccaggtctatagtcttacctgcctctgtgtgactccctgatgcccagaggcatgccctgctataggcaattacactgaagtgagtagagggtcggttgtgttcccacagctttgagaagtgtaagaagcacacctgggatgtccagtagcctggagcggccatcactgttctctgaacaaaactgactagcgctctctcagctctgcccactgtcttctgcactcttcatacttgggcctgacctgaagcctgcaccagggatagactgtgccaggcagactgtaccagagagactgtaccaggcagactgtatcagggagactgtaccaggcagactgtatcagggagactgtaccaggcagactgtatcagggagactgtaccaggcagactgtaccacacagactatactaggcatcttgtaccagagagactttaccaggcagactgcaccagggacactctaccagggacactgtaccagggacactgtaccagggacactgtaccaggccctgctctcagacaacatcttctcctgagacatcacatggattacagggccaacaagggatgggggctgtggaccagagatgcttgctgtgtctccaggccccttgggaagtgtccaggctgagctaccctcagtgtgctactctgagaacaaagacctggaggagagggagtgggttcatgggtttggggtttggatcaggcaggcaggtgctgtgtgtgtctgtgtggagctgggtgtgagtgctgtggctatgtctctgaggagtgttcacacatgtctctttcttctggtgcatggctttcatctgagagagagagaaagagagagagagagagagagagagagagagagagagagagtgtgttgctgccttcatttgagtgcttggtgggctccatgctgtacctctgccttccctgtgtgtctgtccttttgcctctcccttcctttggcctgtctctcttgtctgcatctgtctctcttgtctctccctctctgtgtctcttttctctcctgtctctgtgtctcttctttcctgtggtctctcctcatccccatgtctgcatcagtgtctatcagtctttaactctgtgtcctcttgttcccatttctgtccctctggatatttctgtctttctgtgtgtctgtcctcatctctcccagcgtccatgtctttgtgtccctttgtccccacacagtatcttctcaaatactctgtgtgcctggtcccctgtctctcattccttttctcactgctcccatcagtgtttctctgtgtctctgcttctgtgtctctgtgtgtctgtctcatgctatctctttctctctcattatctctgtctccctcagacttctctgtctttcttggtctctgtctccctctgtgtctctgtctttctgcatgtctaatgtctctgtgtctcccttagctcatctctgtctctctcaatattcccacaatcccctttattctttgtgtctctgtctctgtggtgtctctttctcagtctctctgtatttcgctctgtctctcagaatctctgtgtccctcatattatttttcgaagtgtctccctatctctttcagtaacactatttctgtttttctcagtctctctctctctctctctctctctctctctctctctctctctctctctcagaaagtctatggcacctcttctatgtgtgtcccactctggacctggatcaatcttccttcttggacctcagtttcatcagttgtgagacgataccttgccagaagtccagaggactgtctgtcctccatagtctagaccacctgtgatctgagagatattgggacaacggatgtgcagtgagggacctgcctttctgtggagccctgtctggctggaatacactctccattctgcatcaccagagccttgttgagctggctattctagttgtctactagaatagttgtgtgaccttgggtgatgctggctgacctcaggctggccttggctggccttggttgacactgaatgaccctgggaagaccagacttaatcttaattggacttgttctcattgggacagaacatggcctcactaaggcatgactgtggatggttgtggagaaccttgagtgatgggggttggggccttctcagtccctgtcagggctcccctggctctgacccctcatccagccccagacccacctggcctggtccagggtggtgtgattctcagaacagtagctctgttttggggcacctgggctgagataggctcaggatgactcagctggcctcagagtggagttattttgaatgtttcagcaggtgatagaaaacagagacttcagaagaaagaaaaacaagatgctaatgtgaccatccctgccctacccccacacctgccccgcaaaccttccccacaatgctgaccccacatctgtagaccccaggccagaggctccagctcacagggcctgggcctgctttgtttccattcagtgcctctgggaaaggcagatgagtaaaggggtcactctcccagttgcagcccagtgtgtgaacagtgtggtggggattctggaatcttctgcaggaatcccctgaagagatcttcctaatgagaatgaggcttggaatatcaaaggtacttcttgtaaaataccactgattccttgggcctcagagaatggatgtgtgatgaggaccaaggtccaggaccagtgttgataagcagaatttggggctagagttcaggcttagaagttgatgttgaggacctgggcccattgatcagtacagaacctagttgttagaatcagaacccagtgtctatgaccagagctcagtgatagggaccaagtcccaaggccaaatgatcaagaccaggacccagttgccaggaccaagatccaggtttcacaaccaaacctagttacgcagaccagaaaccattcgttggaatctggatctgaatcagagcccaatcacactactctaaaccagagttcagtgttgaggaccagggtacgtgatgagcccaagattcagagatcaagaggtggattcagtaattaagaccaggattcagagatcaggatcagggctcagttagcaggatcagggctcagtcatgtggtcatgggctcacggtccaatgtccatgcccaaaacacaactaaggacccagtggtcagaaccaaggcctgatgatcagagacaatacacactgctcagagctgaatttcagtggcaaggatgaagacataatgataaagactagggatcagtgagcagaaccagcgatgaggacccagacgcatctctgaagactagagtcagtgaccatgaccagttcaacgatcatgagtaggacttaattctgatcatacgagttcagtgatcacgaacaaggctcagtgatcatgacaagggctcagggaacaagagtgaggctcagcgatgaaaactggacctcagttatgagcccagtgatgagtaaccaggtctcggtcattagggccaggattcagtgataagaaccaagggtctctgcagggctcagtgcatcctctccccctgagactggacaaagccgcccagccacagggatggattctccagacaggcaacagcttcagggacagcccccccgtgatgcgccagagtaggggatacccaggggacttccacactctcaaagaagaaggggagaatggaacatgaagaagggactgtgaggggggaccgggaagtgggggacacagtgactgggatataaagtgaataaataaattaatggaaaatatcacatgggtgtagggaattttgaaagaataaataaaatgttaaaaatgaaaagaaaaaaagaccaagggtcaatgatcagggtgataataaataaataaataaataaataaataaataaataaataaataaataagaaaggaaagagagaaagaaaggaaggaagaaagaaagaaagaaagaaagaaagaaagaaagaaagaaagaacaaacgaactgaatgtcagaatttagggtaagatctcagtgatgaggatcagggatcagtggtttgaacgcagacacactgcccagggccattgttcaatgacgagagtcagggatcagctatcagaaccagggccagtaacgaaagccagggcccagtgaccccaaccaaaaaccagtgactaaaaccaaataaaatagaaactaggcagccacgatggtgcacacctttaatcccagaactcaggagtcaggggcagggggagttcaagacaaccctggtctacacagtgagttccaagacagccagggctacccagagaaaccctgtctagataacaaagactagaaaccatgagctcagtgatcagtggcagttcttgatgactaagaccatggtcaagaggactgatcagcaggactcagtggttagactcaggacatggtgatgatagcctctgttccagggatcagaaccaaggccaagggccaaggccatgactgagtcatcagaacagggcctctccatgagcactagtcaggcgcagccaggcctagcatgtcaatcaggcaaaattgggtatgtgtgtggtggtatgactgactatacatcgtcttagtatctgtctgaccccaccaccatcttccctgcctccgtccactcacagatctctg

SEQ ID NO: 2 - DNA, 525871 bp, Artificial Sequence
  BAC6-BAC3-Annabel (FIG. 1a after integration)
  misc_feature (474423)..(474552): n is a, c, g, or t
  misc_feature (506441)..(506490): n is a, c, g, or t
  misc_feature (518064)..(518468): n is a, c, g, or t
  misc_feature (521625)..(521632): n is a, c, g, or t
atcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaataaagatcccccgaacacaacccacagctaccaccatcaacaatatttatatatataacgtacacatagaaatcacacaaacagagtatttattcttaactacatgaactaccatcagaccgtctgggccactatataatgtgccattcataaacgtgatcactttacgtagcaggcaaccccaggtgaaaatttttcagcgagctgccagattgtcaggtgaaaaactgaaaaaaacttctgggcgatgagcttgtggcgggaaattaagtatataaagcagttagtttcttctgcttcttgtggttctgggtattcttgtaatatttggaagaatagaaaatcaagactactgcctttcttttcatattatagaggaagaaatacgcacgaacacgatatagaggtaaagggggagtctggcaacccttcttgccactcatgtcccagctctcaccatgtgacatagcctgttccccctttgccttccatcatgattgtaaagtagatcctggtgccatgcttctcacacagccttcagaactgtaagccaaatgtgcctcttttctttgtaaatcacttggcctcaggtattaatttataggaatgcaaaagagactaacacaccgtccaaagcattacacagattcaactctatttttatcaaatgaccaatataattgattacatatttagaaaaaaaatactaaaattcctatagaatcaaaaaagagtctgaatagcaaaagcaatcctaagcaaaaagaccgaagctggaagcaccacattctctgacctcaaattatactacatgaatataataagaaagacagcatgctactagtagaaaaaaatagcccagaaagaaagccaaatatctaaaaccaactgttgtttgacaaaactgacaaaaatatacactggagaaacaaccctctattcaataagtggtgccgggaaaattaggtggcttatgtggaagaatagaactagacttccatatcaccgtagacacaaattaactgaatatggattcagtgtttaaatttataaactaaaactataaaaatacttgaataaaatctaaaaagagtcctctggacattggtctaagcaaacaatatatgactaagacttcaaaagcaaatgcaataaaaacagaagtagacaaacaggatttagttgaactaaaggtcttctgcacagcaaaagaaataaccaacatggtgaccagacaatctgcaaatggaaaaaatatctggaatctattcatcttgcaaagggctaatatatagaatctacaagtaactcaaataagtcaactaaaaattacaaataacttcattaaagaatagacataaacagacatttatcaaaagaatacacagaagtggccaacacaaataagaaaatatactcagcatcaccaatcatctgataaatgtaaattagaaacaacatgatacggcatcttccaccagtcagaatggctgttattacaaataaaaacagcaggtgtttgcagacaaacataggaaaaataatgatttatatatgcttggtgagaatgtaaattagtacaacctccatgaaaaacaacatagaaatttctcaaagaactaaaattagaattaccatttcttccagtaagctgtcccagtaggcatgttcctcccaaacttttatatcagagaatgttgcctgcactcatatgtttatttcaacaccattttcaatagaaaagtcaaataatctaagtgtcaatcagtggatgattagataaaatatgatatatgtaaatcatggaatactatgcagccagtatggtatgaattcagtgtgaccagcccctggacaagggcttgagtggatgggatggatcatcacctacactgggaacccaacatataccaacggcttcacaggacggtttctattctccatggacacctctgtcagcatggcgtatctgcagatcagcagcctaaaggctgaggacacggccgtgtatgactgtatgagagacacagtgtggaaacccacatcccgagggagtcagaaaccccgagggaggaggcagctgtgctgagctgaggcagtggtgcagcagtttctttaacttccatatgatctcattttgcatcatcttctacttttatattagctaagaacttggggtagacaggtgctcctaagagatccttaacttgcccattttgatgggttttccagaagacgtgagaagccactttgttagcaaagcatcccaaatccatgccctgttctagatacatgtgagcccatttcctggtctttgcttaactgacaagctctcatcagtgcacctgggctaatttcacatcaggtagaggaacgcgttataaaggaaagctaatgttgtaatagcaattcctgcttaaaaaccttcagcttcattgtttttgtgtaatccatcagcaaattatgttagttcaaggttctcaatgggagtttctaataaatagaaaggatgtataaagcttcccctaattaaaatgaaacaattgtgaacacaacctcggtattcagccatgtctccacccttcacacccttcgccacaaaggaattttcacctctcctggaagctgggttcattttcaaattagttatttttttcaatgtaatatctcaagattatcgtatatgactattttagcagaaagtgaattatgggaacttgaactaaacaactgaaaacaaattcacaactaattaaacaagatgccagaatgtgattggctccaggctttgtaattcagcagttcatgtacccagactggaaatttacatgtcttcttgttaccttcacagcacagtcaactcccattatgtaagaaatggtgactgcattcccaagggttatgcatagatatgaaaatagactgggtaaggtgaggagttgattgtttaaattcccctctgaagaagcagcatcaactcaacaaaccacctctcttcactctgtgactagagctatgtcacaggccacatggacctaaatccttgatggatataacatgactacataaattgggctgatcatttttatgctataaaattaatagatgacactgcactccagcctgcacaaccaagcaagtcttcatctgtaaaatctaaaaaagaaaaattaataggtactgacttcgaaatttttgataataatattttcaccacccaaatttaatcacacccacatgttacctgcatcttcactgaaaagttcccagtcacgatgagttccttcaatgctccatgtgttcaaatctggacatcaagagagtccagagaataaaacacaatgacggcagtgaaactgatatatattcagcacctcttaactcaggaggactccatacaccctggcacacagctgcttttctaaatggctcacaatgactccagctcactcacagagctcagacagaaacctcccttcagggtgggagctgggtggcagggggcactcagtacccgcagaggtgaaaatgagctttcagatggaacttccctgtcacctcaacatggaatttattgtttcatttcattacctctctttccataatggttcatttcttttggcctgttcattactgatatttttcagagcaatctcacttgaatctttactcttttgcattttgtctccttgacaatgttgggaagttttacctccagcatcataacatgatctagtgatctgacacattgtgcaaacaatacctacaaattcagaacctctttgtttttctttccacaaaatataattctttctgttctgtgtatgagcatgtcttagcaaccctgtacacacccacatagatgtctacaagcctatgaattgttctctgtaaataaaaatttatctcaaattccttcaatgttcataattctgagagtgaggaaggtccttctcaatctgttcaaacaaaatgcccagagaccatccagtaggtaaggagttcacctggctctggtgtggggtctgtctctttccctctgttgtcccacaggtcagcccagttgttcacgtcctaacaagaaagcccaggtttgtcctgattttaaaacacatcaaacttctgatgactctcctgttacccacatccatggagatagattatttattatataattcagcaaactaatgtcaaatgcccaagttgcaataccgcacatcctagggtatgttcatgcaattcaatggaggagaaaatctttcagagacagatggatctgaaatgataaatatgtgggtaaggactctgggcttgagtatcattgtccagccatgtttcacaagtgtgtcctgtcagggaaggatcagagttccttgtgctctcagagggaaggggtcacagagttcctctctggttcccaggaaaggtaatcgcactaatcttcatgatcttcatgagactatcctccagtgctgacctgttacggagtttttgtctgaagttctcactgcaatccccaatctacatattttcaatcagaagtgtttagaggccaggacacatcttcaaggtcacacattgagaagtatggagatatgtcccactaccttctcctacgatctcagacagaatcccaaatttcaaaaggacacagaaggacagctctcaggtgcttttaaaaaatgacccacttccagggacagtgagcttccctgtaaccatggtggatgttctgaactacaataaacattggatggatccagtattgtttgaagtcactgtcattattacattcagctgttgtttcaatgtgtctgaaagggtaaatgactatttagatggcctgggtgtgtggttggttttatatgaatctttaagggttgaacagtactgaccctattccaaaatctgtccttgatccaggatcacactcatctctcagaccagctccttcagcacatctctttacctggaagaagaggactctgggcttggagaggggaggccccaagaagagaactgagttctcaaagggcacagccagcattctcctcccagggtgagctcaaaagactggcgcctctctcatcccttttcactgctccgtacaaacgcaccacccccatgcaaatcctcacttaggcgcccacaggaagccaccacacatttccttaaattcaggtccaactcataagggaaatgctttctgagagtcatggatctcatgtgcaagaaaatgaagcacctgtggttcttcctcctgctggtggcggctcccagatgtgagtgtttctaggatgcagacatggagatatgggaggctgcctctgatcccagggctcactgtgggtttttctgttcacaggggtcctgtcccagctgcagctgcaggagtcgggcccaggactggtgaagccttcggagaccctgtccctcacctgcactgtctctggtggctccatcagcagtagtagttactactggggctggatccgccagcccccagggaaggggctggagtggattgggagtatctattatagtgggagcacctactacaacccgtccctcaagagtcgagtcaccatatccgtagacacgtccaagaaccagttctccctgaagctgagctctgtgaccgccgcagacacggctgtgtattactgtgcgagacacacagtgaggggaggtgagtgtgagcccagacaaaaacctccctgcagggaggctgagggggcgggcgcaggtgcagctcagggccagcagggggcgtgcggagctcacggaatacaaggccgggtcaggagcaggtgcagggtgagcggggcttgctcatcttctcagtcgtctccctcctcgccagcacctcagctttccgtagaggtcctctttctttattgtgtgtggttctacttcctcacatccttgtgccaggaaagaaaggagtaaggcaaattttcctgttacaattgaagtttcaccaattactaagaactttcctgcaagtacctgcacagcccattataccttatttatatatgtatatattctaatgcttctcaccatctcttgatttgtgtcatcaatttaattgtgccctttttgaaattcatatgctgaaactttaaatccaatggatctatatcggaattttaatggtataattaatgttaaatgtggtcataaatgagaccctaatgcaatagagctgttgtctttataagaagaggaagagacaccagatacctctcacttctcacatgcactcagagaagaggccacgtggagacatagtgcactagaaggtgggcctctgcaagccaggaagaagccgcaccaagaaccaaccctgccagcaccttgatcttctacattcagactgcagaattgtaagaaaatcaatatttgttgtttaagccacccactccttttgtcttcttacgaagacccagacaggctaataccacacaactctgttagctccgtctcctggagggagaagcagccccctgaagctgggcacatcgctcagattttcacatgaattaggcaaaaacagtagctctcatataaaaactgtcacgtccctgttgggacaaggtcttttaaacaagccctggggctttgtcacaaatgttgcattttatcctttattaggacttaactaattgacaatgagtaccagctggatggaaactgaccactgaccatcttctgctgtctccttattatatcacagaaaaccacagcaacattactctatgtcttcaactttctaaatttgtactgaatctattgctaaatgaggagctacatggggtctgagttttgttaccttcttcccagtcttccccaattaccaagcatagaagatactttcagtgaaatttagctgtcaatgcccccgacaccacatcatgttttaaggtccaaggactttctttggggggctattgaaaaacacttttgaatggaaaatcctaaagcatacaacagctgaaagaatggcccctgtgcacatgaaggctgaagggatggatgatagggtacgttcctccaaggtgttcctgggcatgtgatggttggatacctcatgcatacgaaaacaaggactgaactgagatagaaacaagggccatatcctataggaaaacaagaaaaaaacgggcatccctgaagagagttaattagacttggtgggtttaagatgaatttttttccaaagttttttaatgttctaagctaaatatgaatattttcaataaactgcaaattaaaaggagaatgaatttagaagtttagacagaaaaaagccatgagggtgtagaaagcaaatccacacaaaactgtcacatggcagaggccagaatggagctgatgcagctacatcattattctgcagacctagttgagaccctttggtgtttaaggcaggtccagcagtgaagaactcctttattttttgtctggcaaagttctaatctaatcttcatttctgaaaaggatttacatggtaaagattcgtcttggcaggttttatttatttttagtcccccccaacccacgtcaatttgagtaaagtcatgtgttacgtaacaatgctgcagtcaacagtagaccacatatatgtttgtggccacataatgttgtaataccatattttcactaaactttttccatgttttgatgtgtttagatagagagatacttaccatggtgtttccatttcctgcagtgttcagtgcagtaacacgctgtacaggttagttgtctgggaaccctgcgctaatccacataccctgtgtgtagtagggtattccttgtaggtttgtgaaaattcacccttgatgcttgcacaatgatgaaattgcccagggacacatttctcaaaaagaacctctgtcaataaaccacacaccattgaatacaatccctgtgccttctgaactgaaaaccttctgctgagaaatctgttccttttctttctgttttctaaagcctcttttatttccagcaatgtggttttaaactgtgtcacattttttgtcattgggtttatcttacgtaaaatttatagagcttcttcattgtggatgaatatttgcttcccttctccaaatttggaaatattttttgctattattttgaataatttatctcttctctctctctctctctctctctctctctctctctccctctctctctctctctctctctctctctctctctctctctctctctctccccctctctcccttcactaccccttttgtcttgtctttgtataactcctcaaatgcgtagttgagtgtttagtgtctttcctggcccataagtcttgaactcttttttatttctttcacttaaatttttcttctctgtctctactatttcaaatgatctttctttgagtttactgtttcttctattacttgatctagtttggtctaaaatcttgttaaaatttttggctgtattcttcaggatcaatatttttgtttagtcatcttttaaatgttttatctttattaaaattctcacattgttcttgcatgctgccactagctcattgaacatgtttctaacatttactttaaagtttctgtcaggtaatccatgttcttccttttcattgatgtcagtttatggaccttttggttgttcttctgtttggaccatgttcccctgcttcttcattttccttgactgtctttgttgttatctgttctttataacaaaagccatcatatacttcttcaaagactaggctcatagagatcaccctcaccaatcagcccagacagtaattgtgggtctctcaaaacttgataggattcaaacttctgtctgttcttagtggcccctaggttttagaggatgatagattgtgccaggactcacaggtaagggaggtagaaactatgtactcatgaccatggggtctgtgctgatctgagcttctcttgtcatcactctcaatattcaacttccccgtggatcaggctcagctgtggctgctccacgtggggctgttctcagtctgttgcctctgtgtgtgcagaagtcctctgtgaagttaactagtggagtcagacaggaaaatactacagaccaagaattctcagactgttctgcaaagcccctggattcactgaaaaaagaacaagtttggtccagcaggattcatggcaagtgttggtgagggagataacagtaattcaagtggaagttctcaatgggactcgccttcagtacaaagaagattaacagtcctcagagacactgttcagaagattctcttttaagataataaaactgagagcccaagacaagtctgtgtattactgtgagggacacagtgtggggacatctatgtgagcacagacacaaaagtccctgcagggagacaggaggggactgcatgttagttgctgctcagaaccaccagggggcattcaggacaccagtaggcactcagaaccaccaaggagagctcagaatcaccagggggcactcaggaaactggcaggtgctcagaaccaccaaggggcgctcaagatcccagcgggagctcataaccaccagggggcgctcaggacactagggggctcagaaccactagggggcgcccaggaccaccaggtctctcaagacaggagggcgcactcaggacactagggggcgctcagaaccatcagggggcaatcaggacaccagagggacttcagaaccaccagggggcgctgagaaccaccagggggtgctcaggacatgaccggccctcaggaccaccaggggatgttcagaacaccaggaagcactcaggacaccagagagcgatcagaacaccagggggcactcagatcctccagggggcactcaggacaacagggagctctcaggacaccagggtgagctcagtaaaccagtgttcgctcagaaccaccagggagcactgaggacaccaccgctcccttaggaggcagctccacatcaggtccctggatccgggcagggagggcggttccttttggatcttgccactaaccttttgggagttttcctgcttcctttgtggtttcaagaatcatttgcagattcttctcatgtacaaagctctgctttcttggattatgtaatgtttttggctttggatgctaccagaattacgttgtactgtgagaggattcattcgtggtgtgtgcaatagtgaatgaaagctccaatgttaggggtggctttgaaagctacgttaggggtggctgagggcagttagcagaaaatgatcatcactatagaaggctactcatttctttgcacatttgcataaacaattgtagtttatgccctaaaaactgcatgttttcttggccctttttcttaaatggctccactctaagtccagtaatctaattaagctgtgtttcaaagaccaccaatcaagttaattctgtttaatgcaacactttgtaaagaaaatgtacatctgttttttagagtcagctttaaattttacattactttacaaatattgatttgtcaaatttagtctcataactatcttcagtaatttaaaatcttagtcatgtcatgttaaattaagtaatcctaggtttctcacttgaattagggttactaagaattagaatagtaaaagagtataattagcttttggtgaggtttataaagaaagatgaggatttttttttttttttgcttaaaaatattctgttttccagtttacagggcttttcaactggttttaagataaccactgtttacatctaaacttttttttgtaaatgactgctgagtttctatacatattccatagctagagtttcaaagtaaaagctctagtatctttgtattagtgtgtgtatgcgtagatgtgttaatatgtgcatgtatatatatgtgtgtgtgtgtgtgtgtgtgtgtgtgtgtgtgtgtgttgtggctactaggtacaaaattggctttgaaataaatattttcaaattaagtaaatgagcccaatgcatttgaagtacatgtgacttaaataaatatttaataaataagttggctttaaaattattggtaaaaacaaattagagatattttaacaattatcagcataccttatagtttatattaattcatcaagtgattttatatttaaaatcacagctagatattatatggtgtcaaaattttttatgatgattataaaattattaacctcgttggccatatgcggtggctcacacctgtaatcccagctctttggaaggctgaggtgggtggatcacgaggtgaggagattgagaccatcctggctaacatggtgaaaccccatctctactaaaaatacaaaaagaaaaaaaaaattagctgggcatgctggcaggcgcctgtaatcccagctactctggaggctgaggcaggagaatgcttgaaccccagaggtggagcttgcagtgagctgagatcgcaccactgtactgcagcctggatgacagagcgagactccgtctcaaaaaaaaaaattataaacctcattaaaaccagaatgatctttgtaattttttgacaaatatgatgtttaatattgttgttttaataaaaaacaggtaaatagttattagaaaaacaattatttgcttaattataaggtttttactcaggcaagcacctgaaattcatgggttataacatggttaacagagaaaaaactttaaaggatgaattacaattttcataagtaatctagataagctacttaaataaaatagggaaatgtaatcaaataaaccttttaaataaacttgttctacaatttaaaaatctaaagtttaattaaataatagatattgactaaatgtttaggtcattactaattgttttaaaaaatatataagaaaatatttttcttaaaaaattattcttagaaaaataatgtaattcaaagttatttatataacatcataaaaagtaagagagttttaaagaaatttattgacatagagaagtacttttggtaagaaaggttaaaataaaaaaattttatatgagaaataatcttgcatggtaattttttatcctaaaataaaatgactaagaaagaatgacgtttagaataaaacaagatgttcaactatgccataaatggtttgtgtaagtgaaaataagatttataaaaagttaatttattaaaaaaccttcatattatcaagttgactataattgaaagggaagtatttataatagtctttatagagatctggcttttatataaaatatagtaatacactgaagactggttagaatgacaaaattgtcttaaagtgttgatttactaaataaaattataagatattttaattttttaacccccaaatttaacttttattgcatcttgccattttgattttttccctttgagaagacttgagaggctctccattttttcatcacgtcctttaacattttttttcttacagcgattagcttcttactgacttaacttctaactgttgttagcttttaactgctattattgtctgatgctaaaaacattttatctttaagttctaaataaaatgttttctttcaatataacattctacactcttggcttatctttaaatgtctacatttttctatgaaaccaaagtcttcacgtgtaatctgagtcacattcttggtatgtctaattaattcaaatgcttttttcattagagttgacctgcaggttatctacatgcattttccaatagggaaaagcaatcacactgtaaaaggttttgctttgctatttggtaactggcataaaacaaattttatattttattgaaataattcctatgttactgttattaaggtttccaacttactgagattttaagaaaatataaattaatgttattacattcatgtagctatctacattacttttaaaggccttgtgctgccacattactgacctttgactcctaggtctaaaaaggacacacagcattttgggagactaaggcaggcagatcacctgaggtcaggagtttgagaccagcctggccaacatggcgaaaccctgtctttataagaaatacaaaaattacccaggcatggtggtggatgcctgtaatcccagctacttggaagcctgaggcagggagaattgcttgaacctgggagacagagattgcagtgagccaagattgtgccactgaactccagcctgggtgatagagcaatattccatctcagaaaaaatatataaataagagaaaaaggacactaagtcctgctaaatcttaaacactgacagtaattaaagccccatctacagacctggaagaaaatgacaataaaaattcatcatactcttaagacataaggccagaaattgaaactactcaacaactccaggcccagggactattacagaagtggatttgtaagattgtaaaagctaattttgagatataatattacttgagagtttctttataagttaagcattaatattaaatgcacactaatggaagtctagcatctgggcccctgtgacagattgacaagggtttcttgaagaagtaatccactctttagcttaaaaaattattaaaatttataaaagacctatgaaaattatattttatggtaaaagtagttataatttaatagacttatttctcagaattgagagatagttttaatttttctcatgatgttcttataaggggttattgtttagaaaattaattctttcaaaaataaaagtttttgcttttttaagaaatcactgagttttcacttggctaaataaataacttactttacaataatctgtaattccattttgtaatatcaagtgttctaaataaacctttgatatttgacctccttcacaaaataaaagtctaaattcagtcatttgacctcattattcttttttgatatttgatctcctgaagccaaaaagaaacatatttagcttctttggtacaattaaattatactggaagcaatgtcaaatttgaaatggtgtttaactttggactatatttatataaatgtggactatataattggagtatattcatataaattaaagagtacatgttctaaaatggtatgaggttcaattgactttgatatgtcagtatattttgtcagtagtacttatgattattatataaaatttttgttcatcacagaaataaccaaactttctcctcaattctgtctttaaccgtggctattctaaaacttcagccatccacaattgttttcctttgattctttatcaggtggcttataataatctatagaattttgaggggtactcttaaatacacaattgtgacaattttataaattgtgccatttatatacagagaaaaacttccaagactctcatggagacctgatgcatttatgatggttgttaatataatgtcaaacaggacaggacttaattgcatgaactgaactaacaggagcctgaaataaattttatggcttattctttaaagcatttgctaattacttacattttgtttttcagaatcaaaaaaaaaattctcttaagctattcattgtttttaacaattgagtatagtatattctagtgagaaaattcaaaaacacaatttcttcttctctacataatttctccaaaatttggaaactgtgagtattgttatatcaaaatattaattcacataggttcaatataaatctgctttcttccgtaacagggcacaattggagacaatgatcattttaccaagactttaacttgaatgacatattttcatatttactttataaaatgaatttaagctggatagctgataaaagccccttgggaaaactggcatgtaacctgttttgttcagggccctgagctgtagtaagtcaataattttactttctgacagacccaggaatcccaagttgtcttggaaaattgaaaaaagaagaagtaacccaattcatatagctgtctgaaggcacagatgaaacaatgtctgggcttgatgcttttaaagattctacccttagatttcttataaaaaatttccagcaaggtcaatttatgaattaaatagcctatgtacaaaaaatagaaaaaaagagagctaatatgttaaattactatttttgcctcatcttatacaaaaaaattaagcctaaaacttatattacaaataaatttgccctactatgattgtgtctctaataactttggggaattatagagagaaatactgtttcaaaataaacaacagtgcatctgttattagattctaaccttgtccacttgtttttcaatttatattattttctacaatttatattagtttctacaatttatattagtttctataaaaatttatatttgcagaagcctccaaaatatttttcctgatttaaaattaccagaagttaaactgtgctttcttatagctagacatcttatactctaaagaaaataaaatcaatgacatgatttggctctgtgtccccaccccaatctcatcttggattgtaataattcccacatgtcaagtggaaaaaggtgggaataattgaatcatggaggctgttttctccatgctgttctcctgttattctcacaagatctgatggttgtataaggggcctccctcttcccttggcacttctctcttgcagccatgtgaagaagcacgtgtttgctaccccttccatcatgattgtaaatttcttgtggctttctcagccacgcagaactgtaagacaattaaaccttttttctttataatttacccagcctcaggtatgtccttatagcagcatgaaaacggacaaatgtaagcaacttaattatatacaaaaactcttttatacctgcctactgtgaaaggaaaataagtcttgagaccgcaaaatcaccaagctaaatggaagagtcaaactggtgttacaggagatagaaagaaattattttggtagatagttaggatgacagaatttctgccgaaaacatttcttctaacaaaaatcagcttggcaattacttattttctattcacacagagttcaaagaaatcacttctaacaaaaagcagcctgaaagatcaggctgtaaaacatataagcaactctgccacagagagggtgtttctgggtgtaatcaccaaacttcacatacatacactgggccctagtaaaaacagtgggccttaatgagcacattcctttccttttctgggggcactataacatcagaaagctggaaacttgcacaagtttaggatgcctgcacttgcaaggaggtacctgggacctagcatggaaaatcctcttcccctttttagcactctgggagtggagccccagccttgggattcccaggtgtttcccttcagtgatcaggactgaacacacacaactcatcatgcagtttgtgctgagctgggttttccttgttggtattttaaaaggtgattcatggagaactacagatgttgagtgtgagtggacatgagtgagcaaaacagtgggtttgtgtggcagtttctgaccttggtgtctctgtgtttgcaggtgtccagtgtgaggtgcagctggtggagtctgggggaggcttggtacagcctagggggtccctgagactctcctgtgcagcctctggattcaccgtcagtagcaatgagatgagctggatccgccaggctccagggaaggggctggagtgggtctcatccattagtggtggtagcacatactacgcagactccaggaagggcagattcaccatctccagagacaattccaagaacacgctgtatcttcaaatgaacaacctgagagctgagggcacggccgtgtattactgtgccagatatacacagaggggaagtcattgtgcgcccagacacaaacctccctgcaggaacgctggggggaaatcagcggcagggggcgctcaggagccactgatcagagtcagtcccggaggcaggtgcagatggaggctgatttcctgtcaggatgtgggacttcatcttcttccaacagtttctctaatgaacctccctaattttagaattctgtggttcctaatgtcatctctacatattttcaaaagatcattttaatatgaggacataacctctcatgtaccaaatgcacattgatgcttacaaagatgaaaagttctcaaccattgtcaccaggatcgcagtcctgaggaagctcacgggtgtctgatgagtctcctccattcaggcccaggacagaaacctcagggagactcctggactagaacggcagggattctgatcacagccaatagagagcctgggccagggtcagtgtcctgtagaagctcacagggttcacatctgacccttctcctgaccctaaagccaatccgcatcagcactgatctggtgctccttttgctcccaatacatgttctttctttggagtgtttgttctcccttttttatttgcttttctttcttcctgaaaaagaaacacatggtctctatgctctacactccagggctcaaggcattttcttagaactcaggcaaggctcaggcttggctactccagcccacgtgggagaggctgatgggatttccttctctccccatattctcagggccctcctctgtgttgtgtgtagactcatctgggaatgcaattggccgttaatagtgaaggggataaactcatttgatcaaaatgggatgtggatgtggaattaaccctgttctatgcacactgtcagagtcatcttcttcagaagtagtgttagaaagagcttgtgaactttatcagaatcaaaatggatccacttgtgttaaaaccctaatgaatgaagctggggaaggccatgaaggagggttctaacacacatattcctgataagaagaactatcataaatagaccctgcacagccacaaccttttacacagaggccaccacagccttaaaagctttatttctccaagtaaatctgccccgcaactgcctattcaaccttacaccgctatctcaaaatagctgctgtcaccctcctcatttttccttaattctcttttttattattttttaaattatactttaagttctagggtacatgtgcacaaagtgcaggtttgttacatatgtatacatgtgccatgttggtttgctgcccccattaactcatcatttacattaggtatttctcctaatgctgtccatcccccttcccccaaccccactacaggccccggtgtgtgatgtttcccaccctgtgtccacatgttctccttaattctttatcttccttttcctacctgaatgtacccatacatattttaattgaaacgcacatcctagaaaaaatattattatactttagagtctctgtctgttattcaggttgacatgacaagctacagacggacatgccacttttctgtgagacatagaggatgacagtttttggagatgtctaggaatatccaatgtccataagatcagccatcaataagtgcagactggaggtcccagagagaggcgaagctgctgaatcatcgtggaatttcattttctccagttctgctctgatggaatcaggcccacccattttatcaatgacaatctacctaacctagagtcagctgatgacagtattaatatcatctattaagtaaagtcataactatatatatagtgagagagggagagagagagagacggagtctcgctctgtcacccagggtggagtgcaatgtcgtgatcttggctcactgcaacctctgtctccggagttcgagcagttctcctgtctcagcctcctcccagtatctgggaatacaggcacacaccaccatgtccggccaatttttgtatttttagtagagatggtgtttcaccacattggtcaggctggtctcaaactactgacctcaggtgacccacctgccttagcctcccaaagtgctgggattacaggggcaggccaccaagtccagctaatttttgtatttttagtagagaccaggtttcacgatattggtcaggctggtctcaaactcctgatctcagcctcccaaagtgctgggattaaagatgtgagctactgtgcccggccaacaccacctatattaatgttggattgaataactacaaagtctaccctaaccaagtgtaccatcaaacttaccattacccagaggaaagaatctttaacatgagatctatattcttaaatgttttaaggtgtaaaactgaccacagtacaatcacccaattatgattttgctaatgagttgtagaaactgcatgtatattttggatattaacactttttcagatgcacaccttataattatattctctcattctgtaggttgcaattttttccacactttgcggcatctttttgttgtgatgtagttctgcttgttcaattctgcttttattatctgtgactttaatttgaaatatagaaaatcatccttttttatatactttaaattttagagtacatgtgcacaacatgcaggtttgttacatatgtatacatgtgccatgttggtgtgctgcacccagtaacttgtcatttaacactaggtatatctcctaatgctatccctctcccctccccccaacccacaacaggccccggtgtgtgatgttccacttactgtgtccatgtgttctcattgttcaattcccacctatgagtgagaacatgcggtgtttggttttttgtccttgtgatagacttctgagaatgatgatttccagcttcatccatgtccctacaaagggcatgatctcatcattttttatggctgcatagtattccatggtgtatatgtgccacattttcctaatccagtctatcattgttggacatttgggttggttccaagtctttgctattgtgaatagtgccgcaataaacatacgtgtgcatgtgtctttacagcagcatgatttataatcctttgggtatatacccagtaatgggatggctgggtcaaatggtatttctagttctagatccctgaggaatcgccacactgccttccacaatagttgaactagtttacagtcccaccaacagtgtaaaactgttcctatttctccacatcctctccagcacctgttgtttcctgactttttaatgattgccattctaactggtgtgagatggtatctcattgttgttttgatttgcatttctctgatgaccagtgatgatgagcattttttcacgtgtcttttggctgcataaatgtcttcttttgagaagtgcctgttcatatccttcgcccactttttgatggggttgtttgcttttttcttgtaaatttgtttgagttcattgtagattctggacattagccctttgtcagatgagtagattgcaaaaattttgtcctattctgtaggttgcctgttcactctgatggtagtttcttttgctgtgcagaagctctttggttcaacatactcaaatcaataaacaaaatccagcatataaacagaaccaatgacaaaaatcatatgattatctcaatagatgcagaaaaggcctttgacaaaattcaacaaccttcatgctaaaaactctcaaaaaattaggtattgatgggacgtatcttaaaataataagagctatctatgacaaacccacagccaatatcatactgaatggacaaaaactggaagcattccctttgaaaactggcacaagaaagggttgccctctctcaccactcctattcaacatagtgttggaagttctggccagggcaatgagacagtagaaggaaataaagggtattcaattaggaaaagaagaagtcatattgtccctgtttgcagatgacatgattttatatctagaaaaccccattgtctcagcccaaaatctccttaagctgataggcaacttcagcatagtctcaggatacaaaatcaatgtgcaaaaatcacaagcattcttacacaccaatcacagacaaacagccaaatcatgagtgaactcccattcacaagtgcttcaaagagaataaaatacctaggaatccaacttacaagggatgtgaaggacctcttcaaggagaactacaaaccactgctcaatgaaataaaagaggataaaaacaaatggaagaatattccatgctcatgggtaggaagaatcaatatcgtgaaaatggccatactgcccaaggtaatttatagattcaatgccatccccatcaagctaccaatgactttcttcacagaattggaaaaacctactttaaagttcatatggaatcaaaaagagcccgtattgccaagtcaatcctaagccaaaagaacaaagctggaggcatcacgctacctgatttcaaactataccacaacgctacagtaaccaaaacagcatggtaccggtaccaaaacagagatatagaccaatgaaacagaacagagccctcagaaataatgccgcctatctacaaccatatgatctttgacaaacctgacaaaaacaataaatggggaaaggattccctatttaataaatggtgctgggaaaactggctagccatatgtagaaagctgaaactggatcccttccttacaccttatacaaaaattaattcaagatggattaaagacttacgtgttagacctaaaaccataaaaaccctagaagaaaacctaggcaataccattcaggacataggcatgggcaaggacttcatgtctaaaacacgaaaatcaagggcaacaaaagcccaaattgacaaatgcgatctaatatgaaattcttaatgagttctatagttataagtacattatttctccttattaaaactaatcttttttgctgaatgggtggaagatggtggcttccctccaaaagaaaacatagttggttctgtaaagagttcacccatttcttccactataggcctgccctggcataatacaagctcccaacttaagaacttatgattttccatccatgggagaagccatcttttccatctattataaaaacagaagacacttcattaatatcactcccaaaataggctatgtcatatccagtgaggtaggatggctgacagtggtgagaatccaagtaattggtcaagcactgctatgtgtgaagaaacaccacagcatactctacactgtcactcatgatatggaattgttgcctcctcagcaatgtaactgagcccttaatatgtggctgggatgacaaagcaatgccagcctgcagagtggaacctgttcttccttctgggattagccaaaggccggtggcactcatggctgaccctactttccttacaactggacgaagcgaagcaactggatatgaacttctatcccaggatgtaactgtccaaagtgccttctctttatgtcaactggaaaagtgtgaaagacagacactattctcataaacggatatcctagttattccacccactagccagctcttccccccaggtggcagtcatagatttagaattgcaagtagaggccctggctaagcataccaccagtccctttaacaacacctaccataccatcatcattcttactgaagaaacctcacagatttgacaagtgacactatgaagctatatgaccctaggtattgcaactacagccaaaggtaacacttgtgtattaatgaaccctgaatgttgcatatatatacaagattagtcccacaatataactcaagctatgcaagcattagatacccatatttctgctagagatggatgccctctctcaggaccctgcgacagcatggtttagttgacttcctaacacatggaagactttcatatatagtagagctggtatactcttcattgctatcttcagttgctgtggattttattggtaccttgcactttaagtgagaatgtaatactgaccttctcaaaaactcctaggtccttgcaccataatgctccaacaaacacctactgtaattccggagactccagaatatttccaactccagtttaatggattcccttccaatatatacaagctatgccctttctaagaagtagccagattgactatgacacacgttttccatagaaacaaaatggaatttgacagtggggaatgatatacaggcagcttaatttcaaaatgcattttaaacttattttttgaggttttaatattattttcatactccttgaaacctgaaatttcacacttacattctaattgagacttaataacaaataaccagaacacatgaattgcctgtaatctctataccttgtattgtaagccacatttcaagtgtaaccttacttgtcagcacagtatgtttaccataggcataattgcttgtcctgactgtccagaaggcagggtggtattaagtatgcggcctctggagctgggaagtctggctttgtatactgtctctgccactgctaactgaaggacaatgggccagttacttcctgtaccccagttttgtcatatgtaaagtagggttgttgtaagaatgaaattagttaatatttagtacctaacaactagtaggcattacgtggtagctattcgtattgctatcgtcagagaacacacaggagtccattgttatttttaccctccccctccaaacaaaatgtgtaagacactagacatggtagctctgtaacggggttcgtcatgtattaaactgtgtacccaaatgatatgtcaaagtcctgacaaccagcacttcagaacacgtccttatttggaaatatggtagctggagatgttattagtgaagatgaggtcttacttgagcagggcaggccctcaatgtgggaagatgggtgtctttctaagtacaaggaaatttggacacagagacagagacatacagtgtgccatatgacagcagaggcaaagatcagagtggtgcagcagtaaaccaatgcatgtccaggattaccagtcacctccacaagtgaggaaagggcaaggaagaagtctcctgagtctcagagggagtgcagcccagctcacacttgattttggacttctagtctctagaactgtgagacaatacagtcctgtcatttttaagccacccagtttgtagtatttcattttggcagccctacgatattcatacagagttcttcacccaaaaggaagcactctttctcacaaacagtcaaagtcctggatgacggacaacctggagattgcaaacctccaaggaatcaaaggaggttctataaagtctaggagccccatctttcaaaggctgctcctcaagtccacacacacactttggaaggagaatcctgctcttggacatgggatccttagtgagccaactgccaataatccaacatcatcatgaattaaagatctctgacatttcctcgtcaccaacgggaattctgtcaagtagtaagtaaaacccttcttcaggaatctccacaccaaacagttctgcatggcttgggacgcctcaggaaacttataatcatggcagaagaaaaaggggaagcaaggcagtcatacatggtggcagaagagagaggttaaacttttcagtctctcttgggtgtaaagatacaatcttgaggcaaacagcagaatcaattttcttatgccttgaaattctccctttcaccataaatattcccttcacattaatctaactttatgtttgcatcgaactatgtgcctttttggaagttccggaagctaatttgagacagatagacaaagtcgggagaccctgatgcagaattccagaggtgacttcaatgttgctagttaacaacccaggcattgcccagatgatgccagcccaagatccaggtggactgggatgccagagagctgccagaacaagacgcacagacctggttctcagcccaaatcttgcatgcctttcttaccaactttcccttttttaaacccctgcctttccttcaaaattgaagtggttgcttgggatgggaatgcgttcacttcccctttaccattatggttaatacaataatttttgtaccagatctctctcttgttaattggatcctgcaggtggcagattccggaccagagtgacgttagaaactgaatgcacatactgggtggttcacagacacagtgttctgtgaagtttatgggtggattcctggggaagcctgcaagcctgttagtgattagcagaaccgcatccagctactgggatctgcacgccaggtgccgtgagcccctcaccatgttccctggtcccagctgcccgcggatggttcagccttgacaacgggctcggtgttctgggtggtgggagagcaagggggccccttgggcagcgtgctacagggctgtgaatccaggggcccacccggtgttccctgtggagtcactgagggaatgaggggcttctcagggcacagagctgtaacgcctttgtgcagtggtggctgaatacagtgacactgggcgcgtggtgagaagcggggcaaggtcagttcactggaccctccgccctgagcctcagatgagtcgggggtccccagacaggcccggcctctgccctgcggcggacactggagcctttgctgtggccgccaccgaggagccttgacctcaaaggagggggaacctctctacccacctcggaaacctgaagggagcggcggtctctcccagacaggatctcgccggcctccgcgtctccaggcccaaccctgtaccacataaaggaagtccgcgctgagctaccgggacacagcgccgttgggtgggcgggcgcggcgcggcgggaagcaccggggcagctgccacagagatgcgcggggactgtcgggaagtgggcggtccgggaggcgcggggctgatgggacgtgggcggtccggggacgcgcgggggatggcgggacgtcggcgatcccgagatgccagggggcagctgggacgtgggcggtctggagaggcgcgggggcagctgagatgcaggtggtccgggacgcgcgggggctggcgggttgtgggaggtccagggatgcgagggggcagctgggacgtgggagttccggggacgcgtggggtcgccaggaagcggggtctaggacttagatccgccttctcttcaggccatgcagccccgaagctccgaatcctgggatgactcctgtccatgttggaagggaccctgccagtcctggcaaggttcaacggccttagggcaagaaatgttagtagagtcctggaagacgatgtggggaacgggtagcggccaccggatggtgatcgttcttctacaagaccttgacatggatggggagaaacagagaagaaccttccaagtttgtcccactggacatgcccaccacactttaccagccctttctagaaggcctgtgcgtaacacatgaaaaagctgctctcgacctttccctgaccttttaaaagaaaacatttgctgcatctaatccgcctagatgtaaggaggttcccaaatgtatgacagagtcagacaattacatgtcttgtaagttaccatgtgcttgtcttttgttttccgttttttttcgtttttttgttttttgtttttgagacggagtctcactctgtcgcccaggctggagtgcagtggcaggatcttggctcactgcaacctctgcttcctgagtttcaacaattgtgctgcctcagcctcccgagtagcttggattacaagtgtgcaccaccacgcctggctaatttttgtagtttttagtagagatggggttttgccacgttggccaggctggtcttgaactcctgacctcaggtgagccacccaccttggcctctcaaagtgctgggattacaggtgtgagccaccgtgcctggccgtaagttaccgtgtgctttttaaacaaatcatagcaaaggggtgtcttctggaaatgacattttgaaatggagttactagaccacccctggaagggacacagtaaccacacgtccacgttcgttcagtgggtgagaggacatggaggggagacctgggcaggaagggaagagggttccatgccaggctgctcatatttaaaagacattttcattgtagggacatggatgaaattggaaaccatcattctcagtaaactatcgcaagaacaaaaaaccaaacaccgcatattctcactcataggtgggaattgaacaatgagatgacatggacacaggaaggggaatatcacactctggggactgtggtggggtggggggaggggggagggatagcattgggagatatacctaatgctagacgatgcgttagtgggtgcagcacaccagcatggcacatgtatacatatgtaactaacctgcacaatgtgcacatgtaccctaaaacttaaagtataattaaaaaaaaaaaagaaaaataaaagacattttcatatcgttgtcattgttttcttgtgtgcattttattcctcgctattgtatacatcattggaaattctaagtattcttttgaaatatctagtctttctagatgttctgaagtgcctgatgtatgttaaaattacaggtggtaaaataataaattttgtaaatgtctttttgttaaaattcatatgcagtgttttattttattttgatgttggtggggggtggggaggatggccaaatccctgcttgatcaacacacattgcgtttgtgctctggttcaggggaggagagaggaggagaaagtgcagacttccaggcctctgtgcgcaccgggaggagagattaatgatcatctcttctgtctgtgtgtttgttttatttatctatggatatcctgtgtataaaggatgaacaagtcctatttataacatctaatcttttcaggtgttaagttgccagcgtatgacggaagtagcattattaaacgaatgcagcttgtacatattgtgttaaaattcataaaaagccagtcttctgaaaagaacccttgggccctccctccgcagcctccggcgccagctgcaggaagacctggccaggggaaggcgggcggcagaagctgctgctggctgtggggaaggcggtggagcccaggcctccacaggctccccacaggctccccacaggctcgcgcggctctggttgctgggctccgcacgggccgcgtgggggcgcctgctgggagcgaggaggcgccatcctggctcgcctgctccaggaggacgctctgggcctgcgcagatgcagttctccaggatgggcgcgggcgctgggggcggcgctccttgggctgctgcgcctccactgagccgcctgggtgtgaggacctcgcgccggcgcctccgggaaggacgcggagccgccgcggccgatcccagggctgcagctgctgcccgacgcccgcgggaaggcccttccgccaccgcccgggggttcgaacttggagcagctgctgccagctgaggcgccagcggcgtcgggagctcctcagagtcagtgttttgtgctggattcggcatgtcctctgaaaactcgggaatttgtcactgaaatggtgacaggaggtgagaagtttttttagacgttgccttcgctggcctggcgcggggctcaggcctggaatcccagcactttgggaggctgaggcgggcggatcgcttgagctccggaggtggagaagctgccttcgtggtaactgtggtcttaagttcagctgagaacgataaatggcttttccttgaattggctgcttttgtgatttctctcaggctcatcttttgtcagttaaaaatccagtggtaggtgtagcttagagacgggaaatttttggttttgttttggctacacgtaagtgttggaaattattttcttttacgttccagtgtgagcaaatccagaaggatgtcagattaaacaccgaatttaacaaattcagccgggcacggtggctcacgcctgtaatcccagcactttgagaggccgaggcgggtggatgatgaggtcaggagtttgagaacagcctgaccaacatagtgaaactccgtctctactaaaaatacaaaaattagccgggcgtggttgtgcgcgcctgtaatcccagctactcaggaggctgaggcaggagaatcgccgagattgcgccactgcactcagcctgggcgacagagcgagacttcgtctcaaaaaaacaaaaaaaaatcaatcattggaatactgttgttcattacaattaatgaacgtttgatagacgcataaacgaactaaattcacaagtacatataagtaaaataagccaaaaaaaaaaaactacatcccgtatgatgacacttttatacattctacagaatagaaactaaagtgatatgaaggttgggagttgaatggagaaaaggtgagcgaaaagagggaggacggaggagttgcaagagaacaagagaaaatgttgagggtaattgatctgttttctatcttaataatggttatggttacatcaataatttctaaattgtacattttgtgtgttaattataattttatattattcaagctattacaaataaatacctgtataaatttcttagggacggtttaagggagatggataaatcacataaaaagtcagatatttctgaatgtacaatgaataacccttagctctatctttattttttggtaattctaaaatgcagcagatttttttaatgtttttattacaagaagggtttcttcaaaccacaccaggtgtgtgtaactctgggctaaagttggttaagggagcagtgggatccggtggagaggagcacaggcctcgatcctggagcccattcttgtcacatgtgagctcctggacacatctcatagctccctcatgcttctgcgtttacattctcatctgtaaatggaggaccaatgggcatctgcctctaacaatgtattttcatgtgttaagatgatgtatgttaagtgtttactatagcacaatcttttaataagaaattacatttttttccaaatactatcattgtcttcaagccccaccacccaccagaaaacttaatatgctctgtgccctgccctgtcctcagacatccagcccaagagacttttatatagtaggagatatgcaaatagttccctccctctgctgatgatgaaaaccagcccagccgtgaccgtgcagctctgggagacgagctcaagtgccaggattcccaagtgttttcacttggtgatcagaacttaacacagaggaatcaccatgttgtttgggctgagctgggctttcctttttactattttaagaggtgatacatgaagaactacagatattgttcgtgagtggatattagagaaacagtggatatgtgtggcagtttctgaccaggatgtctctgtgtttgcaggtgtgcagtatgaggtgcagctggtagagtctgggggagacttggtacagctgtggtggggttgggggtgtcctgagactctcatgtgcagcctgcggattcatcttgagaagcaatgacatgaactgggcccaccgggcttcaagaaaggggctggaatgggtctcatacattagtgctagtggtggtagcctatactatgcagacactgaagggtagattcaccatctctagagacaatggcaagaacatgctgtacttgcaaatgaacagtctgagagatgaggactcggctgtgtgagagacatggtgaggggaaatcagtatgagcccagccagaaacctccctgcaggaaccctggggtggggggaaatcagctgcagggggcactcaggacccactgatcagaatcaaccccagaaggaggtgcacatggagattaggggctggattccttccaggatgtgggacttcaacttcttctgacagtttccccagggaaccgctctaagtttagaattctgtgtcatctctatgtatttaaaaaagatcattttaatgtgaggaactaactattctcacatgcacaaaatgcagattcacactcacagagatgaaaagtcctcaactgtggtcactaggatcagagtcctgaggaatctcaggcgttcctggtgagtcttctccaatcagacccaggacagacacctcagtgagattccatgactagaacaggctttatggattttaaaaaaaatagactgagccagggtcagtgtcatgtagaacctcacaggtttcacatctgacccttctcctgacactaaagtgtgcaaatcagcatcaatactgatctggtgctgcttttgctcccaatctgtgttctttcttgagttgtccctttttcatttgcttttcctgctccctgaaaaaagaaagatgttgtctctgtggtctaaattccagggctcaagcccttttcttggagctcaggtgggtctcaggttgtggctcctgcagccacgctggggaggctgatgggactttcttctctcccattgctcagggccctccactatattgtgtggagactcatctcagaatagatgtggccagtgggagctgaaggggacaagcttgtttggtcaaaatgagatacaaatatggaattcaccctgtgctgtacaaactgtcacagagtcactttctgaaacaatagtgttagaaagaacttgagaaagttgtcagaatcaaaattgggtcacttgtgttaaaactctgctgaatgaagctgggaaaggccgtgacggaatgttctcatgctcatatccctgataccaagaactatcgtaaatagactcttaaaaccacaatcttgcacaaaggtgcccacaaccttaaaagaattacttctctgagtaatcttcccagcagctctctgtgtaagattggactgatgccacccttgttattgattcttctatcccggagaagttgtctcaaaacagcttatgtaaccctcctcatttttctttaaacctttatctttctttacctgcctgagtgaacccatgcatgttcccattgcaatgtccatcttcaaataattatcattttactttagagtctctttttgtctgttattcagatttgacaagctgcagatggacacatcacgtttctgtaagacttaggggatgacagttttgaggcatggctggggaagtacaatgtccataagattgaccctcaataagtgcaggctgtaagtctcagagctgaagctgctgaatcaccatagaatttcatctttagttctgctctgatggaatcaggcccacctgtgtaatgaatgacactctacctaacctagagtcaactgatgacaggttaaatatctagacagcaaatttgcaacaccacttagattagtgtttgaataactacaaagtatagccgagccaagtatatcgtaaagcagactattatacatggagaatctttaacatgacatctacaattcttaattttttttacgtataaaactgatggttttacaatcaggctgtcatgattttgctaatgagttgtagaagttacatgtatgttttaaatattaacagttttttcagatgcctggtttgcaactatattctcccattctgtagatttggaattttttccatgctttgcaaaatctttatattttgatgtagttccagtccttcaattctgcttttgttgtctgtgcttttaatcttaaatttaggaaatcattgctaaccttttggtgggagagaattttacaattgcaggctatacatttaactgtttaacccatctagagttgattttttgtgtttattctaacctaatattcttaactatttgcaagtgaaaacccagtttgtttaacaccctctttaggggagagtatgatttagccgttgtgtagaaaatgttataaatcactttgccttcatattggttctcaacttgaaaatgagtttgccatcaatacgtgggtttatttctgagctctctatatgtatttatgccagtaccatcctgttttgattatgtttgtaattaattttgaagtctgagagtaaaatgcctccaagtttattcttgcccttttgcagatattagacaaaatattttaacatttcaccatgaagtatgataacagctatggcttttcataatgaattttattgtgtttaggttattttcttgtatttctattttgggtagagtttttatggtgaaaccttgaatttttttaatgttattttctgtctgagaagttaatgggaccttcttcgtatttaatttggcataccaaatgtattgatttgaggattttgaatcatctgtgcatctcaaaaataaatttgagttggtcatggtgtatgatccttctaaagtcctgtggaacttagttgactattatttggtgtgtggagggggctcatttatgtctactaggaatattggtctgtagtttacttttttgtgaccttgtctattactgaaaatacggtaatttgggccttatagaaagactggaaggttggcatctcaccaatttttgaaaaagttagagaatggttggcattacttctttaaatgttgagagtcctttttttacttaacatgtgacctatcatggagaatatttagtctttgcttcggaagcatacatattacactgctcttggttggaaggttctgtagatgtctattaggtcaatttgttcaatagtgttgttcaagtccactgtcttcttaagaattctcttaatgatgttctatccatcattgaaagtgaggtgctaaagtcttctcctaatttttattattttctatttatctctccatatctcttaaggtttgcttaatgcagttatatttatttttgtacaaatatgtaaaaaataaatgaaataataattgctaagtaattttaatggcaaaatcacataataagaaattatattttcccaaatgctgtcattgacactaagctcctccaggaatctcacatctgctctggacacggctctcctggtgtcctaccccagagcttgctatagaggaggagacatgcaaatagggccctcactgtcctgatgaaaaccagccttgcctgcgtctacgggagaagagccccagtccagaagtaccaggggtttccatttggtggtcaggtctctgaacacagaggactcactatggagtttgggctgagctgggttttccttgttgctaatgtaaaaggtgactcatggagaactagagatattgagtgtgagtggacacaagtgagagaaacagtggatatgtgtggcaggttctgaccagggtgtctgtgtgtgtttgcaggtgtccagtgtgaggtgcagctggtggagtctttgggaggcttgttatagcctgggggtccctgagactttcttttgcagcctctggattcacctttagtacctttattaggtactggatgagctgggtccatcaggctcctgggaaagggctggagtaggtctcatttatgagttgttgtgtaggtagcacaagctatgcagactctgtgaagggtcgattcaccctctccagagatgatgccaagaaatcactgtatctgcaaatgaacagcgtcagagccgaggataggtctgtgtattactgtggtggcattgtgtgcatcccttgtttaggtacatgcagagatgctgctttggtgtgttcaggggctcctgttttggggacaccaattttggagtttgcagtatccttgagtccagtacgttcatggtggcattgggtctggggtgtgcagtggcaatgagtccaggatacatgcagctgatgccgtatcttgtgaggacaagaacaactacaaaacgatcctattaataaataggcaaatgacttgaatacacatttttcaaaaaatacatacaaatgacatatagatatataaaatgttaaatatgagtaataatttttaaaattcaaatgtaatctacaataaattatcaccccatacctgttagaatagctatttttaaagaagatgaaagataaccagtattggggcagaagtggagtaaagggagcctatatatattgttactgaaaatgtcaattagtacagacattatggagaatactatggaggttcctcaaaaaataaaaatagaactaccatagtttccaacaagcccactactggctatgtatccacaggaagtgcaatcagtatgtcaaagagacatctgtgcccccacgttcattgcaggaatatttatgatagtaatgatgtgggaacatcctaaattaccataaatggatgaattactaaagaaaatgtagtatgtacccaatggagtaatgttcatcctaaaataagaagggaatcctgcatttgcaacagcaggcatgactctagaggaccatatgtgaagttccacaggcaggcgcagaagacgagtaattcgcgatttcactgtagtttgtttaaatggtagactcacagaagtagagtggagtgttggttaccaggggctggaggggtggactggaaaaggcgagattttggtcaaagggtgaaatgttccagttagacagaaggagaaagttacagtgttctaatgcacaagatggaaaatatggctaataatgcattatatatttcaaaatggctaaaaatgcaaatgttaaaaattttctcactaagaaatgatacagcctgggcgcggtggctcacacctgtaatcccggcactttgggaggctgaggcgggcgaatcacaaggtttggagttcaagaccagcctggccagatggcaaaaccccgtctccactaaaaacacaaaaaatagccaggtgtggtggcacgcggttgtaatgccagctactcgggaggctgatgcaggagaattgcttgaacccgggagacagaggttgcagtgagctgagatcatgccactgcactccagcctgggtgacagtgagactccaactcaaaaaaaaaaaaaaagaatgaaatgatagctgtgtgaggtgatggatatgtcaaatagcttgattaacaattccataatatatacatgtatcatagcatgtgtgaggtgacctgtatgaaggtgaagtgacctgggggctgtgtaagattacctgggggtatgtgtgaggtgaacacggcacatatgaggtgaccagagacacatgtgaggggacatgggagatatgtcgggtaagccagggggatttgtgaggtgacacagagcaagtgtgaggtgacgtggatgcatgtaaggtgatttggggcacatgtgaggtgacgtgggggatatgtgtgagctgacctcgggtgagtgtgaggtgatccaggatggatgtgaggtgacctgggggtgtgtgtgaggtgacttgggcacatgtcaggtgacatcggggattggtggtgatgtgggtgtgtgtgaggtgacctaaggaggtatgaggtcacctggggcatctgtggggacctggaaatgtgtgaggtgggtacaggtgaagtcacctagggcacatgtgaggtgacctgtggaatgtgtatggtgacctgggaccgtttgaggtgacatggggaatgcgtgaggtgacctggggcatgtgtgaggtgacaaagggcatgtgtgcagtgacctgggtgcatgtgaggtgacctggtgcatgtgttaggttacctgggggatgtgtgaggtgaacaggggcaggtgtgaagtgcctgaggaatgtgtgaggtgaactggtgcatgtatgtggtgacctgggggatttacgaggtgacctgcgggatgtgtgaggtgaccttgggtgagcgtgaggtgacctgacgtatgtatgaggtgaccagggtgtgtctgaggtgatgtggggtatatgtgcggtgacctggtggatgtgtgaggtgacctgcaggatgtgtaaggtgacactggggatgtgtgaggtgactcagggcacatgtgaggtgaaattggggatgcgtgaggtgattcagggcatatgtgaggtgaccttggggatgtgtgaggtcaccttgggtgagtgtgtggtcatctgggatatttcccaacttcgtaaggaaagcctgcaacaacacatggcattagaagcttcacactctagcaccattaatgcgtacatcctcaaggaactctaaatgttttgaggttagcttaaatgccatggagcggcaccttccccaggcacactcatatatgcatcctgggtctccctgccaagctatatctcctcaaatttacagtttatgtttgctctgtgacatcaactctgatatgttcaagtgtgtttttttttctttatttgtagttgttcaggcttgttgtttcactctcattactctgggctcagtcctctcctcaggtgtcccacttcagagctcgctgtgaaataggagacatgcaaatagggccccccctttcctgataaaaagcagcccagtcctgaccctgcagccctgggagagaagcaccagccctgggattctcaggtgtttccactttgtcatcagcaacaaacaaattaccatggaatttgggctgagctgggtttttcttgctgctattttaaaaggtgattcatgaagaactaaggatattgagtgagtggacatgagtgagagaaacagtggatttgtgtggcagtttctgaccagggtgtctctgtgtttgcaggtgtccagtgtgaggtgcagctggtggagtctgggggaggcttggtacagcctgggggatccctgagactctcctgtgcagcctctggattcaccttcagtaacagtgacatgaactgggtccatcaggctccaggaaaggggctggagtgggtatcgggtgttagttggaatggcagtaggacgcactatgcagactctgtgaagggccgattcatcatctccagagacaattccaggaacaccctgtatctgcaaacgaatagcctgagggccgaggacacggctgtgtattactgtgtgagaaacactgtgagaggtcggaagtgtgagcccagacacaaacctcctgcaggaacgttgggggaaatcagctgcagggggcgctcaggacccactcatcagagtcaaccccagagcaggtgcacatggaggctggggtttgtttcctgtcaggatttgggacttcctctgcttctgacagtttctctagggaaactctttaattttagatttctgtgcccaccaatgtcatctctacatttttttaatcattgtatatgaggactcgttctcacatgcacaatatgtatattgccacctatgggaatgaaaggtcctcaaccatggtcaccagcatcagagtcgtgaggaagctcaggggtgcctggtgagtcttctccagtcagactcaggacagtaacctcaaggggattcccttgtgagaactcacacattttcatgagaacagcaccaggagtcagttctaaaccattcatgaaagacccactccatgacccagtcacctcccaccaggtcaccccttcacaactggggattataatacaacatgagatttggggcaggacacaaatccaaaccatatcagatacacattgtgaaatacgcatggtggtcaggtaatttgtatttctatcacctcacagcgctaccattttattattttttttaatttactgcatgagtgagtgtctgatgagaacacctaagatctaccctttcagcaacaatcatttttacaatacagtattaactataggaccattgctgtacgttagatctccagaactcatccaacctgcacaactgaaactctgtacaatttaacacacatcacccaatttccctcacctcccaggtcctgggacccactattctactctctgctttcaagagcttgaatattttagatcccacatgtaaatgagatcatgcagcatttgtctttctgcatctggcttattcaactcagcatcatgtcctccaggcccatccgtgttgttgcaaatgtcagaatttccctcttttcaaagccaaacaaaatacagatgtatgtatacacattttctttatacattcatccatttacagtcattaaattattttacaaatctacactattattaataatcttgcaatgaacatgtctttggcaaagtaattttatttcctttgcatatataacaagaagtgggatcaccagattatatgatagctttatttttaacttatcaagtaaccaatcctaccacaggatatttccctttcccccacattcttgccaacatttgtcatctgttacatttctgataatagccatattaactagtgtgagttgatattgcattgtgcttctcatttgaattcctctgataattaggaatgttgagaactttttcgttttctgtttgccatgcatgtatcttctgaaaaaaattatccaggtttttgcccttttttatcagttcatttgttatttgctgttgaggtgtatgggttatttatacatttggacagaacttcttgtcagatccataattgcacatagtttttcctgtgctttgttattaaattcaaagaaatcagttccgaattaatggcaggaattttttttgctccatgtcatttatgagtttatggcttcaggtattatgtccatttttagttgattttttttttttttgggagacggagtcttgctctgtagcccaggctggagtgcagtggcgcgatctcggctcactgcaagctccgcctcccgagttcacgccattctcctgcctcagcctccgagtagctgggactacaggcgctggccaccgcgcctagctaatttttttttgtatttttagtagagacggggtttcactgtggtctccatctcctgacctcgtgatccgcccgcctcggcctcccaaagtgctgggattacaggcgtgagccaccgcgcgcggcctattagttgatttttttatatggagttagagaaggcctaattttatttcttttgcatatgaatgccagttttacaccattattgaaaagactgtcctttctctactgtgtgctcttggcacacaaaatcaggagagacataatgacaaaaaaaatatgagatcaatagtcctgatgaacatagacctgaaagtcctcaacaaaataccatcaaattgaatccagaagcactttaaaatgtgatacatcatggtcaggtgggctttacccctgggatgcaaggctcgttcaatatccacagtaactctgattcacaatgtaaacagaataaaagcaaaaagcatatgattatgtcaatagatgctgagaaagcttccgataggatctaacatctactcatgataaaaaccctcaacagactagacatcaaagaaacatacttcagaataagagccatctacaacaaacccacagttaacatcatactaaatgagccaattaaaacacttatctttataaatgacccagtctcgggtgtttctttacagtgcgagaatggactaagacagcatccaaataggaaaggaagtcaatccgtccatcttcactgatgatataattctatatctagaaaatcctaaaaactctgccaaaataattctagaataaacaactttagtaaagtgtcaggatacaaaatcaatggacaaaaattaccagcatttctataagccaaccacatccgagctgagagtataatcaagaacacaatcctattcgacttacagtatccacaaagaaaatgaaatgcccgggaatacagataacaaagtgaaagatccctacaaggagaactatgaaacacagcatacataaatcataaatgatacaaataaatgggaaaacatttcatgctcatggattggaagaatcaatattgtaaacattgtcataatgcccaaaggaattcagattcaatgctatttacataaaactatcatcatcattcttcacagaatcagaaaaaaatctattctaaaatttatatggaaccaaaaaagaccctgaatatccaaagcaatcctaaggaaaaagaataatgccagaggcatcatgatactgaccttaaactacaccataacgtcttgctaacaaaaacagcctgtactggtacgaaagcagacctgcaggaaaaaaaatagatcaaaatagaagacagaaataaagttgcacacctgcaaccctttgatctttgacaaagctgacaaaaacaagcaatggaaaaaaaaaactctgtgttcagtaaatggttctgggataactggattctggcaggtatgcaaaatgcaagagtgaaggagcctgtgcagcttctacctagatttcagatgtgtagagagccctgcatgcccaggaagaagcctgctgcaggagtggatccaccacagaaagcctctactagagcagtgccaaagatggggaaagatggagttggagcccccattcagagtccccactagggcacttcatagtaaagttgtgggaatgtggccacaaccctcaagaccccagaatggtagagctacgggcagcttgcaccctcagcctagaaaagcttccagcacttgactctcacttgtgaaggcagccccgtggtctgtgcctagcaaacctatagggattggctgcctgaggttttggggacccaatccttgttccagtgtgccctggttgaagtacataaagtcaagagagattattttgtagcgttaggatttaatatctgcagtgctgggttttatatgtgtgtggggcctgttggttgttcctttggccaatttatccctttgggattggaattatttacccaatgcctgcatcatcattgcaccttggaagtaaacaacttttattttttaaatttgcaagctcacagctggagggacattgccttaagactcagatgagactttgaaaatttgagttggacgttgatgaagttaagattttgggcactattgaaaaaaggtgattatattttgcaatgtaagaagaatatgagaactttgggtccgagagtgcaatgatataatttaggggttttcccctccaaatatcatggtgaaatgtgacccacaatgttggaggtggggccaactgggtggtttgggtcatggggaaagatttttcaggactggcttggcatccaccccatggtaattagtgaattcttgctgtattagctactgtgagatctgattgttcaaaagagtcttgcaatcctgctaccctctcatgtaacccctcctcacaatatgacacagccttctccccctttgccttccaccatgactgtaagcttcctgaggccctcacaagaagcagatgctggtgccatgcttctcacacaacctgcagatctgtaagccaaataagcctcttgtctttgtaaatcacttggcctcaggtattaatttatagcagtgtaaaatagactaatacactgcccaaagcaatatacagagtccatgcaatttctatcaagtaactaattaattatgtatttttaaaaatcctaaaatttatatagaaccgaaaaacactctgaatagcaaaagcagtcctaaccaaaacgaacaaagctggaagtaccacattccctgacttcaaattacacagcacaaagataataagaaaggcagcatggtagtggtagaaaaaaaatcaagagcccagatatatagccaaatatctacaaccaacagttctttgacaaaactgacaaaaatatacactggagaaacaaccctctattcaataagtagtgctgggagaattagatagccttatgtagaagaataaaatgagacttctgtatcatcatagacacaaattaactgtgaatatggattcaatgtttataaactcataaaaatacttgaaaaaatctaaaaataatcctctggacattggcctaagcaaataaaatatgactaagacttcaaaagcaaatgcaatgaaaacaaaattagacaaacaggattaattgaaccaaagatcatctacacatcaaaagaaagaaccaatatggtgaacagacaacctgtgaatggtaaaaaaaaaaaatgtgcagtctattcatcaaatatatagaatctacaagtaactcaaataagtcaactagaaataacaacttcataaaagagtgagcaaaaacgagatatttctcaaaagaagacatacaagtgttcaacagaaataaaacatgctcagcatcacaaatcatctgataaatgtaaattacagacaacatgatatagcatcttccaccagtcagaatggctattaaaaataaaacagatgtttgcagagaagcataggaaaaataatgctttttatatgcttgatgagaatacaaattggtacaacctctatgaaaaacaatacagaaatttctcaaagaactaaaattagaattaccatttgacccagtaacccctcctggtgggtatgtttctcccaaaaggaaacttctatataagaaaaagtcacctgcattcctatttttattgcaacactattttcaatagaaaagtcaagtaatctctctaagtgtcaatcagtggatgattaaataaaatatgatagatgtaaatcatggaatactatgcagccataaaaaatgaaattgtgtctttcacagcaacatgaatagagttgaaggacatttcctaaataaaataactcaaattctcttttataattggaaagcaaacaatgggtacacatgtacatagagaaaaacaatagacactgggtactgcaaaagaaggcaaggtgagaggaaagtgagggttaaaaaatcagctattggctccaatgttcactatggggtaacagttacatcagaagcacaaacctcacctttatgaaatatattcatgttacaactctgcacatgtgcaccctgattctatgaaaataaaaacagaaaacatgaacagaattgttagactgctagctagattgaccaacaaacaagaaaaatgcaaaagtagcaattctttgttttgtaaccctttctcattttctggtaccataagaaattgtagactatcgtcctatattcttttctgaagtgctaccattagccatttctcaaagaaattctggttccttttttcttttattttctttcattttttttagacagagtctgcaacgtccacctcccaagttcaagcgattctcctgtctcagcctcccaagtagctgggattacagacgtgcaacaccacacctggctaatttttgtatttttagtagagatgaggttttgctatattggccaggctggtcttgaactcctgacctcaaatgatctgcccacctcagtctcctaaagtgttggaattatgggtgtgagccactgcacccagccgctggttccttttacagaagaatagtattaaaaactcatatcttgattcttgatgtactttttgttaatttcttgtagaacatctcaagtaatcaatacaggaagtatttgttgtgtattaacccatatatatatatacccacatctaaacggtttttatttatgttcctatattatgctaaacttgcaaatccactgagataccctaagttaataccacatgaatgattttcaccttccttctatgcctttccctaacctagcactccaaccgtggggaaccccctcccaccacacaccatccattccctttgtagtccatttccaggattcctgtagagtggaacccgattgtgtaagttgtgctcttttgtggaacatcatcaagtggagtccagtgctgacgtgcagtttcttttttctttaatcttatggactacactatttctgaacctacttagtacctcttttgatttcatacattagtataatggcataagatattttctatatagtctgcattccatcctggaattcctaatcacctatttttttaaaatttcttgtggattaagattgtattagtcagtgtcccctagagggacagaacaagtaagatacacatacacacacacacacacacggagtttattaaggagtattaactcacactatcacaaggtccacaataagccatttgcaagctgaggagcaaacaagccagtccaagtcccaaagctgaagaacttggaatccgatgtttgagatgaggaagcatccagcaggggagaaagatgtaggctggaaggcgaagccagtctaatcttttcatgttcttctgtttactttttattctggccacacttgcagctgattagattgtgccacccagattaagggtgtatctgcctttttcagcccactggctcaaaggttaatctccttcggcgacaccgacacagacacacccgggatcaatactctgcatccttcagtgagatcaagttggcactcagtatttagcattacaagtccaccctttgtcaacttgaacccatacacatctcctgagattatacataatcttcaaataaagacaagaataaagtcataattatgcctaataatacaattattcttcttacaactggaaacacaccaatccccaatccaaatggtactacatatgctccactccctcaaggacacagccaggatcatctgatgacttggtgtctagatggcttcagcacttttaattttacctccaatgttagactccactttatcaatgcagatgtagcagaatattttaagacattgatatgctgaaaaattcaacagttcataaaagttgccttcccaccacagccagtggttactactgaataaggacctgccatcctctagggagaagctataatggatggggtgcactgttggtggttatggaaatcgatccatcgtggcaaatggcagcatctttctttgataacattatattctattgtgcatatataccacattgtctttattcatttgtctatctactgacagattttttccatatgtttgctgttattaatagtgtttcaataaacataggatgcagatatcttcacaaggtggtaatttcatctcctttggatatactcccagaaacaggattcctggtcatacaatatttctggctttaattcatttaggagcctttatactgctttccataattgtgaaaatgtagaatggtatagccattatgaaaaacagtttcagttttgaggtatgatctgtaaacaaataatgtttgttatggctctcaatgagagtttctactaaatatgatggaaggtcaggaaggtctctcaccttaaagcagggatggattatgcctcttatttcctaaaagcaaaagattggaagcatgcatgatggaggtggttggcaggtttcaggatgatctcataagaggagaatctgttggataaaactgttgggttttcagtcatagacacacctacactcaatatgaaatgatgaaatcaagtgaggatctagaatgtgttcgcttgaagcaacagcatattctcaaaggcacctattgctccatcacaagggtgatgaacttttgaaaccagtaaagtgtgagagcacagtaagtgataaagttatcacatttacatgaagtttgtttaatgtgccaagggctcgcacagattaatcataaataaacacaatgtattttagcatacatagatgtctagagaagaatcttcttagagaaacttcttcaggttacagaaatctgtgtaagttgtagatctaatggagaagtgtctatgaatactggtctgtttttgaagtatggaaagatgatctcttttggagtaggcttgcgattgtgttgatttcttaattgtttcttgagttgtaacaaaagaaccaaaaaaatgactaaccggagtttcatggctgtgttgataaaaatttttcataagctttctgtcaattatttgagaccagatttcctgatttttttctccaatagatacatgttcacaagatctcaggaaaccacctctcaggtgctttagtttaaaagactagcttcctagaaaaagaagattctgtctaaccatgacaagttggtttcatctgcaaaccatcaagtttgagacctcattgtcaagaatcataaaaattttaactccaatgtactgaaaatcataaatctcgaatttaatgttgataggcattgacaaaatggttcattcttggatgcgtcctatgttgctggctcaacatatcagttaattgagaatcctcacttagctccctctgtttgtagcactgagttgattgtcaatcttcagagtcatccgttgaaggagagtcctgaggttcatgggattcttgtagacactcaggggaacaaaagaaagaaacagaattgagggctgccagccatttccacatcactaggaataattaccatctaagtataaaggtctgcatcattcagaacaccctgcatgacaggctgatgcaaaaaatccaaccctacagaggctccacagcaacctttacagttctttccgggaagaaataatctccaagttaagtgagtcagtaaagctgctctgagctacagtaaaaattggattgggcccgatttgtctgagttcagtgtaattattatactcagctgctgccccaatatagactgaggatggataatttaaatgagcctggctatgtggtttgttatatatctgaactaaataaacataaagggcctgtctggactagcgtgagggtgagagatcctgggagccccagccccccatactcttatctcccttcctccaggaacctctaggttctcagggtgagaatccacaagatccattcatggctctattaccaggagaccaaaatctctgaccttgttcatacagacaaacaggcgaaggacatttttagatccttatctatgtggcgaaaggcaatctatccccattacaagccttaccagcaaccttcctttgtcatgaaaatgggtaaaattagccaataggattacatttaagaaaattttcctgtgatgttccagccagaaaacagcaaaaatcagcttcacacctggagacttcttgcatcggtcacagcccagagaaagaagatcaccatagcattaaaatgcaactgtaagaacatgtaatgcttccatgttccacgcattacgtctcaccagtttagtcaatatggattaaatatgagagtgtggcaattcgcaaactctatctgaggaggaaaatcggataaaaaatgttatgaaaaataaagcaatttgaagcctctgacttcagcaacttcaccactaatgaaatgatgtaaccctcattggcctcaaatttagttttcacggggcatctgcagggttccaaagtgagaccaggtgaattcaatgtgcatgcacttcccaagtgtccacttgtattctgtttctttacttctgtttacagaaagtagacacatattcagtcttagtaccagtgtagggagcgctttccatgagatggataccagaaaaaaatggcaaacatgggatccgttaatataaaaattagccacgatgtatatatatatatgtgtgtgtgtgtgtgtgtgtgtgtgtacacacgcgcgcgcatgtgtgagttgaatagcagagttggagtgggtttctatccacatgtacctgcacctgcaggtattctcaggtgccataatcaactgtaggaccctaaaggaaataagagtctcccctcaacccctgaagagtgtttgggttcaccgtgtgtccaatgattctgtgcctcttgagctccaggaaagggctccctggtgatgcatgagatcttttcttggagtctctctgcagagttcactgggtttcctaaaggcaattcactatttcaaaagatggtgtgaggagcatgtggtgtccctaaaggagaattctgagccagggcacaaccactttatactgagctggatacactggtaggaatatactctgtcagctcagatagaaacctccctgcatggttggggctgggctgcagggggcgctccggatacacccagcacaggctcccgccccagagcaggtgcacaggaggctggggagaggttcctcccagggcctgggacttcctttaaaaatatctaaaataagtatttcacaaagactgctgaagtttgtataaatatctattcaattgtgagcatttatcaaactggatgttgtaatgagaaccacttttacaatggggatttcaaactctgctggaggtcaggaagagatcctttcttataaataaatgcaatttttggataaacacagtcattccctaaataacgcattcacatattatggtctagaaatgatgcaagttgaccctgagacagtcaaatgtggtttcaaagtgaggtgctgtccttgaggagcttgttctccagtgggggaagctctgtcaacacagagttcagggatgtgtaggggacacatggcctctaacaggattacggcttgaaccctcagcttctacagttgtgtcacccatgtgtctgtttctcatactgggtcaggaattgggctattaaatagcatccttcatgaatatgcaattaactgaggtgactatagtatctccgttccctgagagcctcacccaacaaccacacccctcctctggagaagcccctagatcacagctcctcaccatggactggacctgaaggatcctcttcttgatggcagcagcaacaggtaaggggctccccagtctcagggctgaggaagaaaccaggccagtcatgtgagacttcacccactcttgtgtccactccacaggtgcccactccctgcagctggtgcagtctgggcctgaggtgaagaagcctggggcctcagtgaaggtctcctataagtcttctggttacaccttcaccatctatggtatgaattgggtatgatagacccctggacagggctttgagtggatgtgatggatcatcacctacactgggaacccaacgtatacccacggcttcacaggatggtttgtcttctccatggacacgtctgtcagcacggcgtgtcttcagatcagcagcctaaaggctgaggacacggccgagtattactgtgcgaagtacacagtgtggaaacccacatcccgagagtttcagaaagcctgaggaaggaggcagctgtgctgagctgaggcagtggtacagcagttttctgaacttccatagtatctcattttgcattgagttccgctttaatattagccaagaatatgggatagacgggtgctcctaagagatccttaacttgcccattttgatgggttttcccaaagacgtgagaagccacttttttcgcaaagcatcccaaagccatgccctgctccagaaacacgtgtatccatttcctggtctttgattaactgacaaactctcatcagcgcacctgggctaatttcacatcaggtagaaatatgtgctttaaagcaaggctaacgttgtaatagcaattcctgcttaataaccttcagcattgttgttgtgtgctccatcaactaattacgttagttcaaggttctcaatgggagtttctaataaatataagggatgtatagaagttcccctaattaaaacaattgtgaagacaacctcagtgttcaaccatatttcaacccttcaccacaaaggaactttcatctctcctggaagttgggttcattttcaaattagtttttttattttaatatctcaagattattgtatgtgactattttagcagaaagtgaattatgggaacttgaactaaccaactgaaaatacattcagaactaattaaacaagatgccagaatgtgattggctccaggcattttaaattcaacaggttatgtaaccaggctttaaatttgcacatcttcgtgttaccttcatgacacagtcaactcccattatgtaagaaatggtgagtgcattcccaagggtcttgcacagttataaaaatagacttgatgaggtgaggagttgtttaaattcccctctgaagaagcagcatcaacccaacaaaccactctcttccctctgtgactagagctctgtcacaggccacatggacctaaatccttgatggagattacaggactacgtaaattggactgatcgtttttatgctgttaaattaataggtgagtctgcactccagcctgggcaacagaataatcttgtctgtaaaatacaaaagaaagataaattaatagatactgactttgacatttcggataataatattttcataaaccgaatttaattatacccacattgttacctacaccttcactgaaaagttcctagttatgttgagttccatcaacactccacatgttcaaatctggacatccaagagagtctagagaataaaacgcaatgagggcagtgaaacttgcgtatattcagcacctcttaactcaggaggactcaatacaccctggaacactctgcttttctgaatggctcacaatgactccagctcactctccaacctcctcaaacatctggcctctgtttgccctaagttcacgctctgctcttagtctatgttctgaagtctttgtagaggtgaaaatgagctgtcagatggatcttccttctcactgcaacatggaatttgctatttcacttaatgaccactctttccacaatggttgatttcttttggcctgttcattactggtgattttcaagggaatctcagttgaatctttactgttttgcattttgtctccatgacaatgttgggaagtttttcttctagcagcataacatgatctagtgacctgacacatttgcagcaaacaatacctacaaattcagaagctctttggttttctttccacgaaatataattcttgctcttctgtgtatgagcacatcctagcatccctgtacacacccacgtagatgtctacacgccgatgaaatattccctgtaaataaaaaaagtatctcagtttctctcaatgttcataattctcctgagggtgaggaaggtacttctgggtctgctcaaacaaatggcccagagaccacctggtaggtaggtaaggagctcacctcgctctggatattgagtctgtctctttccctctgtcgtctcatagaaggccagcccacttgttcagctcctaagaagagagcccaggtttatccagattatacaacacaaccagcttctgatgactctcctgttacaacatccatggagatattttgtgtattatataattcaccaaactaatgtgaaatgcccaagttgcaatactgcacaccctagggtatgttcttgcaattcagcggaggagaaattctttcagagacagatggatctgaattggtaaatatgtgggtacgaattctgggcttgagtgtcattgtccagccatgtttcacaggtgtgacctgtcagggaagaaccagagttccttgttctctcagagggtagagctcacagaggtcctctctggttcccaggaaaggtaatttcactaatcttggtgatgagactatcctccagtgctgatgtactatagagttttcatctgaagctgtcactgctatccccaatgtacatcttttcacacagaaatgtttagaggtcaggccatattctcagggttacacattgagaaggatggagatatattctactaccttctcctgagatctcacacacaatctcaaatttcaaaaggtctcagaagggcagctctcaggtactatttaaaaataacccacttcctgggacaggtagcatccttctaaccatgatggatgttctgaactacagtacacattgcatggatccaggtttgtctcaattcactgtgattattacactcagcagctgtttcaatatgtctgaaggggtaaatgacaatttaggtgacctgggtgtatggttggtgttatatgaatctttaaatgtagaacagtattaactgtattccaaaatctgtctttgatccatgatcacacttgtctcccagaccagctccttcagcacatttcctacctggaagaagaggactctgggtttggtgaggggaggccacaggaagagaactgagttctcagagggcacagccagcatacacctcccagggtgagcccaaaagactggggcctccctcatccctttttacctatccatacaaaggcaccacccacatgcaaatcctcacttaggcacccacaggaaatgactacacatttccttaaattcagggtccagctcacatgggaagtgctttctgagagtcatggacctcctgcacaagaacatgaaacacctgtggttcttcctcctcctggtggcagctcccagatgtgagtgtctcaggaatgcggatatgaagatatgagatgctgcctctgatcccagggctcactgtgggtttctctgttcacaggggtcctgtcccaggtgcagctacagcagtggggcgcaggactgttgaagccttcggagaccctgtccctcacctgcgctgtctatggtgggtccttcagtggttactactggagctggatccgccagcccccagggaaggggctggagtggattggggaaatcaatcatagtggaagcaccaactacaacccgtccctcaagagtcgagtcaccatatcagtagacacgtccaagaaccagttctccctgaagctgagctctgtgaccgccgcggacacggctgtgtattactgtgcgagaggcacagtgaggggaggtgagtgtgagcccagacaaaaacctccctgcaggtaggcagagggggcgggcgcaggtactgctcaagaccagcaggtggcgcgcggcgcccacagatcccgaggccgggtccggagcaggtgcaaggagggcggggcttcctcaacagctcagtggtctgtctcctcgccagcacctcagatgtccccaggactctctttctttattatctgtggttctgcttcctcacatccttgtggcagggaagaaaggaggaagacaatttttctgtttactgttgaggtttcaccaattactagaaactttcctacaagttcctgcatgactcattttgccatatatggattctcaccatctcttgatttgtttcatcaatcgaattgtgccctatttgaaattaacttactgaaaccttaaatccaatggatctatactggaattttaatgatgtaattgaggttaaatgtggtcaaagtgtgagaccctaatgcaataaaccgttgtctttataagaagaggaagagacaccagagacctctcacttttcacgtgcacacagagaagaggccatgtggagacgtagtgcactagaaggtggccctgtgcaagccaggaagaagccatactaagaaccaattttgccagctccttgatcttcgacattcagactgtagaattgtaagaaaatcaatatttgttgtttaagccacccaatcctgttgtcttcttacgaagacccaaactgactaataccacctaactctgttagctctgtctcctggagggagaagcagccccctgaggctgggcactgcatctctcagatttccacgtgaagtaggcaaaaatagtagttctcatataaaaatgtgtcatggctctgttggccatttttgagcatggtctctgaaaccagccctggtgtgtgtgtgtaacaaatgtcccttatcttttatttggacataacaaatagacgataggtaccagctggatggagattggccactgatcatcttctgttctccttagtatgtcacagaaaaccacaccaacatcaccagcatcactgtttttcttctaccacctcaaacggactacagaaatgatccctgcagtatggtctatttcttcggctttcgaaatttgcactgaatctcttcctaaatggggagctacatggggtctgagttttgttcctttcttcccagtcttccccaagtaccaaggacagaatagacttaaaatttggccatcaatgcccccaaacaccacatcactttctaaaatccacatcctgcatccatccttctctggacacccctcatcaggctacccaggaatggccagaatctggtatcagcttatgggctgaggccacgagttatacacatgtgtgatttcagtcacacacactctacttcaggaccacacctgtgttctgaggagctcaggcacctgctgatctcagtaattctctaataaatcacacacctcttattaataaaggtccagatggccccatcagctgcagagcagtggagtaaagctcatgggtgggtccatcaggcagaagtcagacaatggaagggatggctggtcacttccattttcactgatgttcgcaatgaattttaatggaataaaacaatattaactacaaagagacagaaaagaagactggctcgtcaagatatttaaggacaaggaactttatttggggggaaagtgaaagacacttctaaatggaaatccctaaagcacatacagcagctgacagagtggccactgtgcacatgagggctgaggagatggatggtagagtccattcctgcaacatgtctctgggtgtgtgatggttagactcctcatgcatatgaatataagagctggactcatggagaaaaaaagggccatatcccataggaaaggaagaaaaaaaaacagatgggcacccctggagagagctcattagatttggtgtgtttaagatgaaaatttcttccaaaaattgtaatgttctaagctaaatatgaatctcttcaataaactgagaataggagaatggagctaggacttgagagaggaaacaaatcttgagagagcagaaagcaaatccacaaaaactgtcacatgacagaggtcagaatggagctgatgtagctacttcactattctgcagacttattgaccatgtggagaaggggcttgaacaaatggagacgttctccaaccttctgaatcagcctccttcttatgcatgagtagaaatcatagttctgggggtgaccttcccaattttcctgtccatacctcttcccccaggggtagagtgtcttcccaaccacaatggtttctcaccagtgttctcagcttctcctccattgtacttaccctgcagattaagaatttcttctagatggagttctttgggaattttctgttttctttagtttctgttgactccaccacacccccataggatacaggttttattggatttcccctggaaatagtgggggtggatccaggcgttcaacagtcctcgctgttcttcccttcctgtcagcaccacaggacagcagataagggagttgactgtggatttttcaaattcctgggaaaagcctgcaaggactagtagattcacactctaataccattagcacatgtatccaaaaagaaacctcactaaatatttccaggttagcctgttcctctctcagtgccatccagtggcacctgccctgggttcacgaacatgtgggccccagtcctctctgctggcatctctctcctcacatttcagtcttctcgttagctctgtgaaagcagctcagatatgttaaaaggttttcttcttcatttattcagtttttcaggtttactgttaaggaggtcagaataagatcatagtttcctcatttttcacatttgcacgctgagtagccactttctatataaaagccagaaactaagggaacaaatcaaatatccatatccactacaggtgaacgttaaaaaatttgacatatgattatggactaaagtacaatgcagaattagaatcaaggcatcctcattctcataaaagcatgtctacattctcaaataactctgctgagtgaaagtagctgaagaattaagagtgcacttcataaacttctaattgtataaactgcagaaggtacaactattctaaagtaacagagcagatttgaaatttgggagaaatgggtgttgaaagtaattgggtggtgagatgaaattacagagaagtgacagaaagatttaggggttaacttaattgtacacaacctgattaaagtttgcacacatacgttaccattttccaaatggtgcagtgtagatttgaattaattattaattgtacttaaagcagtaacaaagaaacaaatgaatatgttggttgaggaggagcaaaaaatagatgggtatgaacactcaaaacatctcagactcttgaaagtacacatgcttgaacactggttttctctgtatactttaggtaaagagcagaatacattaaaagaaaacagagatgtcctggcgggggtggaatcctgcaaacctcactaggcgtgtcccacactgccctggagttgtctcaggggagcagtctcctctagtggtcagagacacaggcatggataatggggctaatactgtccagctgtgtgaccttgaacacattgtataaacactgttccatatgtaatttatcttccttaaaatgtaacattgacacttgcattaaatgtattctacaaatatgtcaaaaagaagatgacgactgctaaatgattatcaaggcacaatcatataatataatgatattttcctgagtgataagatgactaccaatctcccccagggcactttgtttgctctgagccctgcgcctcctcaggattcccatcccagagcttgctatacagtaggagacatgcaaataggtttctccctctgctgatgaaaaccagcccagtcctgaccccacagctctgggagagaagcgccagccctgggattcccaggggtttctatttggtgatcaggactaaagacagaggacccaccatggagcttgggctgagctgggttttcactgttgctgttttaaaaggtgaactagagagattgagcgtgagtggatacccttgagagaaatggtggattatgtctgggagtttctgaccaggatgtctacgagtttgcaggtgtctagtgagaggtacagctcgtggagtccggagaggacccaagacaacctgggggatccttgagactctcctgtgcagactctggattaaccttcagtagctactgaatgagctcggtttcccaggctccagggaaggggctggagtgagtagtagatatacagtgtgatggaagtcagatatgttatgcccaatctgtgaagagcaaattcaccatctccaaagaaaatgccaagaactcactgtatttgcaaatgaacagtctgagagcagagggcacagctgtgtgttactgtatgtgaggcaccaggtaagaggacatcagtgtgaacacagacacagtttcctgcaatgacaagggaggaggctgggctaaaaggggcactcaggacccactgaaaacgggcagctctagggcaggtacagatggttatcatgggctgctttccttcagggtctgtggcctcctctgcatctaccagttcccctcggagcctctggacatttatgtttctgtggccacccctgacatctctggattagaaaagtttattataggaagaggaaacattctcatttgtcccaaagcagatgtaagtaatggaagcaaaaaatgcacaggaggccaggcggggctgtagatactgtcaccccagaatgtcaatctcaccactagtactggagagggaagggagtttgatggaccttccctaacaaccctgtggtccaagataagtccaggaagaccattggtgcctcccagagcacagttgtccatcagggatgtccaatgcgtcccagcagcagccatgcctcagtgtctccactgtgcacagccactgtctgggaggagctcccaggatgggtgtctttggcacacaccaggtggcgggtgttagagtgcagtgcagcagctggctgcctgttctattgggctccctgatgctggagagatgggaggtgcattcgcagggccagcaccctgtttgtgaatttttatataaaaaccctgattttacttcatttttgcagatgacatagataactaaaaacagaatctgcaaagaaattgtaattttcaactttaccccaaattcattgtttcttaattctgtgcaagatccagacatattattgccttcctcatgataatttattctatgtaaaaccgaaatcattttttctcctactctttgtttctgttcaagtacagagatcttgagcaaagtaagttgggttctttccacacactaaccctcaccttccccagagaatgagcagagattgtcctcagtctgagtctaagggaggagctgtttctggcacaatcagagcctgcagagacccccaggtgcagcttcagtgaagtcagacatttctccatgtgggcgacctccagtgcctgtgactgctgctcaggcctaattgttggttaagtattacgacaccctttaggtgatcacatctcaagcctattctgaaaatcaccatgaacagagatagttcaatggccattctcctgacataagtttctctttattacttggttccaagtatggagaaaaatgtgaccctatatttgtctgaatccaacatcagcatccacggcattacgctaggagactcactaattgagcacaagtgagctcgttattctcatagaaatgtaagtatttggaaatttcagcgtgttctccagaacctgtggctgccaacaactgtatttctcggtgcactcttggcctggtgaagccttcacagaacctctccctcacctgtgccatctctgcattctccatcacaaccagtgtttccttctggagctgcatccatcagcgcccccatgggaggtactggagtggatcgggtgcataggtcatggagggagcacagattactcccctcttctcaagagtccagtcaccatctccagatccatgtccaaaaagtacttcttcttacaggtgaactatgtgagcaacaaacacatagccatgtattttagagcaaaagacacagtgaggaaaccacagtgtgaactcatacccaagcctccctgtgggggtgcataggacagccagggttactcaggacaccaggctccctcaggacaccaaggggcactcaagaccattgtagaggcatgcaggtagctgggggctctcaggaaccatgggggaaaatcaggacaccaaagggtgcttggtacagcagggggctcaggattattgtggggattcagaaagagcaggttcaaggctcaacctcagggcatgtgcagctggtgtgaaaaggggctggatgaggcgttttgtgtcaccatcatgtttcaccaccagacaccctccactacctctattctaatgcatgtgtttgtatgattagaaaatgatattgatataaatatataaccatagctaggtgtgtcaagttgtcctctccatcttatatcagccttgtctgtaaggactaattccccataattacttgagaacctcataaattgtggtcaattatgtaggattcctctctttttctgccttccttcctccctccttctctctctcacacagaaacttatatacagccaccccacaacacacataaatctataacttttattacctgatgtattgataagtaatctaaagttacataaaaatcagtagttcactgtcaatattgtaggagaagggaaggtctaggaaggaggaattacagaacaagaggatattttgagggtaattgacttgttatctatgtggataatgataatgtctatgaccatatttgtaaaattgaacacttcgtgtggagactattatttttttatttaaccccatgccattattttgccgtattctagcatttctctaaaaatacagaaatgttcagcactcattcatgtgtatattcaggagtttctgacttttcatgtattttatttatctctgtctaattgctttgataccaaattttacctagtataattagtactacctttagcactgattataagtctcactcctccatcatctccttttttgccacacaagctgaatctagtttggactcataggagctgcttcattcaatgccagtgggagtttcaaaccctatcaacccccctataaactgtcattaagaaagtttatcaaactccaccagtcatgtgatattagttcgttttcacagtggtataaagaactacctgagacgaggagtttacaaagaaaagaggtttagttgactcacagttctgcatggctggggaggccacaggaaacttataatcatggtggaaggtgaaggcgaagcacggcacatcacacagggcagcaggagagagagggggaagtgacacatagttttaaactatcagctcttgtgagaactcactcactatgatgagaacaacatgggaaaactgccctcatgatccaataacctctcacctggtccctcccttgacatgtggggattagaatttgagatgatatttaggtggggacacaaaacaaatctatagcacatgtccagctgtgtcctggagttgtttcagggatccagtgtgtactgttgatagaaacagtgatcatcattctagctggtgtgagatggtatctccttgtggtttagatttgcatttctctgatggccagtgatgatgagaattttttcatgtgtcttttggctgcataaatgtcttcttttgagaagcgtctgtgaaaaaaaaaaagaaacagtgacaccaagctcacaccatccgttgtagttgacaacatgcaaagccaagagatctcaactgagatttagtgtgtgtgtcatgtctgatgaagtcataagctcagagcaagtgaatatggaaaagtgtattatctgcacagtgtaggtgtctgctgagtgcagggcaggtctcgcaggaaaatctaaaatggcttgaaagaagaggaaaggagactggctcagggtttttataatggtttagtggtggtggcacagtgaggcttcccactcacagatcggggtttataaggtttgaaactcccactgccattgaatgaagaagctcctgtgagtccaaactagattcaccttgtgtggcaaaaaaggagatgatggaggagtgagccttaagtaatcaacaggcatgcaccaaaagatagagcgacaacttattctaggtagcaagaataaaaataatgaaaaagaaataagggttcagtatgggtggacaagacccagatctacagaaatgagatgactttagaaatataaggaaataataatgagaaaaagaaggaggggatggggaattagggtcctggcctaatgtcttgggtagaagcttctcacaatcaaggactatcagcttattctgcaggtcttgggtcacacgtctgcttaaaaacatcagaaatgccaggcaatcaatgaggatgctcagtttagcatctcctatttgagtagatttacagttgtgtggaattcttaattgattctttttggtttgtttttagaggcaggctctcacactgttccacagcttaaagtacagttgtgtgatcatagctcactgtaattttgagctccggactcacgtaatcttcctgtattagcctcctgaatatctagaattagaggggaacgccacccctcacctgcttattctttaaaatattttttcatagaaatagcatctctttatgttgcccaggttggcttcgatttcctggtctcatgtgatttccctcactttgcttctgaaagtggtgtgattatagggaagatccactgcatctgtcctgaattgattcttcagttgtaaaacatgaagccaataattaactgcctgactgttttgtgcagtgagttagttaaaagtttctgataagattccttccaatatgattcaagagcagtattttctgctgatgttcctttcagtttccttgttgaagatcagaagacactgcggaaaagatgtagtaaaaaggcagttttaactcttcatgattggagtggatatcacataggaatccctttccgtattttgtaacacatgcatgcaatagaacaaagatgatcccttggtgtaaaatctataaacgtatgggccttttagctaccaagtcatagggtaataactgatggaccctgaggagtgaaccatgattccatagtgctagtgggagaacccttggccaaggaagtttacattttattaaaattgataatttttatgtagcgatgccattttttaaacattcccagaaggttgtgagtgggattgactctgtcttctgtgaacaatgacagtgccctccatggttagataatattttaaactagattgagctagagtggtttctgtattgaatcactatatttttttagcttcatgttagctttttgtgtgttagcatttgctttaaaatgatattaatcagccctctagtaggtagaaattcatctgagggtttcttcccttgttgtccatctcaataggatttccagaagacgtaagaaccctctctgtttctaaaaatattccaggctgggcgctgtggctcatgcctgtaaacctagcactttgggaggccgaggtgggtggacccctcgaggttgggagtttgagaccagcctggtcagtatggtgaaacctcatctctactaaaaatacaaaaattcgccgggcatggtggtgtacactcgtaatcccagctacttgagaggctgaggtgagaggattgcttgaaccctggaggcgggggttgcagtgagccgagattgtgccactgcacttcagcctgggcgacacagcgagactccgtctcaaacaaaacgacacaaaaaattccaaagttgtgcaccctctaaaagcatatgtacttaattctcatttttaatttattaaacatctctaataagttcaatgtttcctgccttctgagttgatttcctaacacatagaagaatatatcctaaatgaaagtttgtgttcttaatacaaattactagttaataacctttacttttattattgaggtattatacatcaatgttaatcaatcctctcaatgggactcttacctaaagaatatataaaatattttcctgatcatgacatataatagatgtgaacacattcttagcattcagccatgtctcttgtctattaatattataaaccacatgctaactttgattttattggtaattgttctaatttcttttttttcccacttctctggttgttttttttttaactttaagttttagggtacatgtgcacaatgtgcaggttagttacatatgtatacatgtgccatgttggtgtgctgcacccattaactcgtcatttaacattaggtatatctcctaaagctatccctcccccctccccccaccccacaacaggccccagtgtgtgatgttccccttcctgtgtccatgtgttctcattgttcaattcccacctaggagtgagaacatgtgttgtttggttttttgtccttgcgatagtttgctgagaatgatggtttccagcttcatccatgtccctacaaaggacatgaactcatcattttttatggctgcataggattccatgatgcatatgtgccacattttcttaatccagtgtatcattgttggacatttgggttggttccaagtctttgctattgtgaatagggaattgttctaatttcaaactagttaatttttatcttcatgcagctagattattatgtgtggctatttattccgagagggataaagacaacattaacaattttcactgcaggcatgtctaggcaactccctgtgcactatgaccctggggcgttggagattctatggggactcttccctacctgcctaggagagttctctgccttctacctctagcattttcctctttgaagaagtacatctaactgtcattagaatagagacaaagacaagtcttaactgcttccagctgaggagggatgctgtttggggaagatctctcttggaggtctaagggaccccaggaaaagggagccattatcccaggcttcagttgcatgaccatttggagtttgatggtctgaaaatgagaagaggcaaatctggttattagaagacatgtatgaaaaccaaacaaggtggcaaggacagcttgaaagaaaattccaaggctgctgacattcctagataactgcagctgtagttatgcctgctaaggtttgggcgcatggggcttggcttttgtcagctccctgggatttattttcccaaacaaagaaacctccaggttaggggcaccctattcattcccatcacctggcatgatttaaaggataattgcttagaattaaaatattgatccagattttttatattccccatcgctttttgtttcttctgggctgtagccagagatcattgattggcgctcaggaataagcagagttagtctaaaatgcaggcaaatacttaaacaactgaagagattagaatttaaagacaagtgtatgatatgttttgaaatacaatgtttctctttccagttttggtttttgtcggcagcaaataatgataagactgagttgtttgcaaaataaactttagtcttaaacttggcctgattatttgcataaagtgcagcaagaatattaataataattctgtaggaaaagcctgcaagcaccaggagcttcacagtctaacactatgagcacgtgcatcctcacgcaactcactgaatatttccaagccagcctgttccgatcttaaatgccatccagtggcatctgccccaggtacactaatacatgggtcctgcttctctctgcagcctcctctctcctcagatttcaggttttgtttattgtttgttttctctctgacatcaacacagatatgttgaaggttttcttttttttatttgtagttgttcagctttgttgttaatgaggtcagaataagctcatagtttacacatttttacattcccatgccgagtagctgcttttctctatcaaatccattaactgagagaacaatcacatttcgttacaggtgaacagttaaatagtttggcatatatttctgtgctggaatctaatgcagcttgaaatcaagtcatgcctcactcattgaaaaaaacatggctaaattctcaaagaattgtgctgagtgaaagaaactaaggaattaagagtaaattttacatgatacatttgtagaaattttagaagatgccactattataaattaacatggagaagatttaaatgtttctgagaatatgctattgggagtaatggggatgtgagttaaatttcagaggaataagagaaagatttagggattaattttttcaaaccttgattgaagtgctgagtaaatggttgcaaacataggtctacatttttcaaatcattcaccataaatttgaattatttattaattacactcgaataaagcaataaagaaactgatgagataatatttgactgaattgcatcaataaatagatcgatattaacacaaggaatataactgatttccaaaaacatacacatgaaccatggttcactctgcgtatttagataaattacagaaagttgtcataacagatggggaatcctgcagacttcactaggcatgggccatgctgccctggagttgtctcaggggagctgcctcctccagaggttagagcacaggcccaggtaataggactaaatttttagatgtgttatcttagacacactgcacaactgctgtgttctctatgtaaattatctcctgtaaaatataacattgaagcctgcattaaatatattgtgtaaatatgtaagaataaaagaaagttatgagagctaagtgttaatcaaggcacaagcatataagatataactatattttcctgaatgatggaattactaccagtctcccccaggacacttcatctgccctgagcccagcctctcctcagatgtcccacccagagcttgctatatagtgggggacatgcaaatagggccctccctctactgatgaaaaccagcccagccctgaccctgcagctctgggagaggagcccagcactagaagtcggcggtgtttccattcggtgatcagcactgaacacagaggactcaccatggagtttgggctgagctgggttttcctcgttgctcttttaagaggtgattcatggagaaatagagagactgagtgtgagtgaacatgagtgagaaaaactggatttgtgtggcattttctgataacggtgtccttctgtttgcaggtgtccagtgtcaggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatggaagtaataaatactatgcagactccgtgaagggccgattcaccatctccagagacaattccaagaacacgctgtatctgcaaatgaacagcctgagagccgaggacacggctgtgtattactgtgcgagagacacagtgaggggaggtcattgtgcgcccagacacaaacctccctgcaggaacgctggggggaaatcagctgcagggggcgctcaggagccactgatcagagtcagccctggaggcaggtgcagatggaggctgtttcctgtcaggatgtgggactttgtcttcttctgacagttccccagggaacctcttaaatttagaaaactgtgcctaacaatgtcttctctatgcatatgaggaccttttctccctggcacaaaatgcagattgacgctgacacggatgaaaattcctcaaccatggtcacaaggatcagagtcctgagtaacctcagggcttcctggtgattcttctccaatcagacccaggacagggacctccgtgagattccctgactggaacagtctttatggatcctggtcacagacaatagagaggctgaaccagggtcagcgtcatgtagaacgtcacagatttcacgtctgatccttctcctgacacgaaagtatgcaaatcagtatcagcaccgatctggtgcttcttttgttcctaatccatttactttcttttttcgtcgtttttctcctttttccatttgtttttcctgctttttgcaaaaggaagatgttttccctgtgagatgcaggggatgacaattttgggagatggctggaacatccaatatcctcagggccgaccatcagtaagtgcaggctagaagtctcagaaagagctgaagctgcttaatcaccgtggagttttaccttctccagttctgctctgatggaatcagggccaagcaggttatcaatgataatctacctaacatagagtcaactgattccagtttcaataacgtctgttaaaaattcacaccaccacctggattactgttttgtcaaatcaatacacagtattgtccagctaagtagacccaaagacggaccgttgcccatggagaaaaacattaacctgagttctaggttcttacagtgttaaaggtgtaaaactgattattaaaaatgaggctatttttctttttgctgttgagttgtagaagtttcttttccattttgacatgaaaactttttcagatatatggcatattatccaattctgtaagttgtagttattttgttgctttgcagaatctttttcataatctattcccacttgttcaattctgcttttttttgtaggtgatttgaatgtaaaatcctgaaaaagattgctaattttttgagtgttgagagttttacaattagaggtattacagttagatatttgaggcatttggagtgaatttttgtgtttattctaacctaaaattcttaattcttttcatgggaaaatccagttttcataccaccctctttggaagacactacaatttagccatgttatattgatggttctcatgctaaaaatcagcttgtcatcaatatgtgggtttatatctaagctctatataggtatttaagccaaaactttctatgtttttaataaatgttgaggcctggaagtgaaatgcctaaagctttcttcttgccttgttacagatattgtaccaaaatattctaaccttttactattgagtgtaataatagctgtggcctttcttaacggcttttattatgttcaagttgttttcttgtcttcctactttgttcatagttttaataatgaaactgatttttttcaaagtctttttctgtgtctgatgaaatgttactgagatattttttctttagttttttaatgtgtaccaaactgattgatttgagaatgttgaatcaagtatgcatctcaggaagaaatttgagttggtcatggtgtatgtcttctaaaacactttggagcttagtttactattgttggggattaattcatgtctactaatgatattggtctgtagtttcctttattgtggtgcctttgtctattactggtaatactatcatggtagtctcatagaaagagtttagaaggtgtatggcagactacctttaaaatagattttatcagtggagaaatggtgatagttttttcttcacttttctgttgggaagaattttatgttgtttaaaagatattcagaatgacttaacctggtttatgagctttcattctattcctttcttccattctttttgaagaactgcttacctttcctatttatttttaagtttgtttttagacatatgcaatacattttgaggtgaaacctggtggaattttttccaataaattagtaaaaataaatcatttaattgactattttattcaggttgatttgtttaatatttgctaaaggccagttctttaagctatgacacataataaatcccaaatggcagtacctcattgtttacttagcttttgtacttatatttttcagaggaagaaccactactgtaaattgtaaatagccaatacataattgtattgtatgcaaatctgtgactgtttacagtgtcatctctgagaaacataaagtttatttactatatatatataaagagtttggaaggtggactccaccaatttttgaaagagttacagaagggctgctattacttctttaaatgttaaggttcattttatgatgtaacagataacctatcatggagaatgttcaatgtgttcttgagaaggatgtgtattacgtgactcttggttggaaggttctgtaaatatcattcagataaatttgttcaatagtgttgttcaagttcagaggcacattgagaattttctttctggatttgctaaacattatggtcatgaggtattaaggtcttgtgttatttttgtattgttttctatttctttatatctcttacagtttgcttaatgcagttatatttgtatttgtacacatgtgtaaaaacaaaaatcataattgctaaatgagttttatggcacagtcacattataagtaatatttttccaaatgctaccattgccactaaagtcctcctggagtctgacgtctgctctgggcactgccttcttctcaggcgtcccacactggagcttgctatagaggaggaggcatgaaaacagggccctccctctcctggtgaaatcaagcccagacctgaccctgcagctctgggagaacagccacagccctgggattcccaggggtttccatttggtaatcaggactgaacacagagaactcactatggggtgtgaattaagctgaatttttcttgttggtattttaaaaggtgactcctagggaactagagtgagtgagagtgagtggatatgagtgagagaaacagtggatatgtttgccagtttctgaccaggatgtgtgtgtattttcaggtgttcagtgtgaggtggagctgatagagtccatagaggacctgagacaacctgggaagttcctgagactctcctgtgtagcctctagattcgccttcagtagcttctgaatgagccgagttcaccagtctccaggcaaggggctggagtgagtaatagatataaaagatgatggaagtcagatacaccatgcagactctgtgaagggcagattctccatctccaaagacaatgctaagaactctctgtatctgcaaatgaacactcagagagctgaggacgtggccgtgtatggctatacataaggtcccaagtgaggaaatatcggtgtgagtccagacacaacatttcctgcaaaaagaagaaaggagtctgggccgaaggggacactcagcactcacaaaacaggtgcagccccaaggcaggtgcagatggagggagggtaagggctgctttccttcagggtctgtggtttcctctgcttctaatatttcccctctgaacctctgtatatttatgttttgtgcccaccatgaggtccctggattagaaaactaatttaaaagaggaaatattctcatatgtcccaaaaacagatgtaagttttggaggcataaaaatgcataggagccgcgtgagtctgtagacactgccaccccacaatgccagacccaaaactagtgctggagaagggtgggagtttgatggagcttccctgatgaccccgtggtccaagctaagtccagcaaggccattggtgcctcgctgagcacagttgtccatcagggatctcccatgtgtcccagcagcagccatgcctcagtatctccactgtgcacagccatcgtctgggaggagctcccaggatgggtgtctttggcacacacaggtgatgggtgttagagtgcagtgcagcagctggctgcctggtctattgggctcctggatattggagggattggaggtgcattctcaaggccagcacgctgtttgttaatttttgtataaaaaccatgtgatttaattcattttctcagatgacatagataattaataacacaatctgcaaacaattgtaattttcaactttaccccaagttcattgtttcttaattctgtgcaggatccagacatggtattgcccttctcatgagaaattgttcgacctaaactgaaaccagttgtttctcatatactttggttctccccacatgcagagatcttgattagagcaagtttggtactttccacgcactcaccctcacctccccagataaagagcagaagttctccttagactgagtctgagggaggagctgttcctgtaccactcagggcctgcggagacccccaggtgcagcttcactgagtcaggtgtttcactccctgtgattgctgctcaggtctaattgtgggctcagaattaggacagtcttcaggttatcacagatcaatcatattctaaaaatcatcattatcacacaccgtggtaataattcaatgttcatttttctaaacagcagtttctcttttttatttggttgcaagtttgaggaaaggagcatgtgataatactttttaatctaacctcaaaatctactgaattgttctaggagactcacaaattggacaagagtgagctccttgtgctcataaaaaatgcatgtatttgggaatttcaccgtgttgtccagaaactgttaacatcaacaactgtgttttccagtgcacttctggcttgagacatcctcacagaccctctccctcacctgcactgtctctggattccccatcataaccagtgtgtcctgctagaattgtatctgcttgcccctagaagatggacaggagtggatcaggttcatgggttgtaaagggagcaaaaattacatcccacttctcaagagtccatatccagatccaagaaacagttcttacagctgagctctgtgcccagtgaacacacaactacacattttgaagcaaaagacgcaatgaagggccttcattgtgagcctagacacaaacctccctgcaggggtgaataggagcagcagggggcattcggggcagtatgggggcttagcatgattgttgggggtcaagatgagcaggatcaaggctcatcatcagggcaagtgcaacagggcagaaaaggggctgtagatgtgggttgttctcaccatcatatttcaccaccagacaccctccactacatctcttctaatgtgtctgagtgttgatatgattagaaaatggcatttatgtaaatactaatgtatacccaaatggaggtgcatccagttgtcctctccatcttatgtggaccttgtccatcaagggctaagttcctgtatttacttgattacctcatacattatggtcaaaacaggtagggtctcattttggcatggtctctcctcctcccttctctctgtcgcacaaaaacacatgaactgacacacacagagcttcccaacttcaattatctgatgtattgaagcaaattgattagtgtgcagcttttctgctttgcctgctattcatgttatgtaaaaataagaaccgtgtgtttctcagcttgttacttctctaagctaagtagcatctttgtttattatacccagagaccaaaagcgattcagctgttattcagcagcttaactggtaaacaaattgtggaaaattcatttactggaataatacccactgttacaatgaagtactgctggatacactcagtaccatgcttaaaataacaagtacctgaataagtaaaataagtcaaacaaataaaagtgcatacatatgattccacttctataatttctataaagtaaaaatgaacttaaagttacataaaaagatctgtagttgactggggacatggtacaagaagagaaggtatagaaaggagaaacgacaggagagcaaaaggaaatttctaggataattttttctctgttagtaaaagtgaggattatgtcactatttgtaaaattgtccactttatgtaaaggttcttatttgctaatttcacctcattaaaatattgcaaattttaaaatatctaatttggtagaaaaggtagtagagagagatgaataaaatacataaaattcagagagtcctgaatacacacatgaatggaccctgggtctcactgtacttttagggagacactagaatacaaaaacataatgacaggatttcagtacatgaaaggagcttctcagaccccaggaggcctgtccaactgcgtctgggagttaactcagggagcaggcatgtcctttggaaggagcaatgacaccaagctcccagcatccattgtagccgacaccatgccaatgccaagagatctcgactaaaattttctgtggatgttgagtgtgattatgccacacactcacaccaagtgagtatggaaaggatagttacctgcatccttaaggtgtctgctgagagcagggcaggtctctcattaaggtccaaagtggcttgatagagcagggaaggagactggctctgggttgttatcatggcttggtggggagcggggcagagcatcctacttgcaggaagggttttgtggggtttcaaggtcaaattggcatcaaatgagggagctcctgtgatttctaactagatttaccttgtatgcttaaaaaaagagatgatggaggaatgagcctgaagttatcagcagtcaggcctaaacacagagtctgatgacttactctaaatagcaagtatacaaatgatgagtaagaaaagagacaagactccaatatgggtggacaacagccaggtctgcagaaaatgagaagactgtttataagcaaagaataatgagtaggatatggaggaggattctggtccaatgtcttgtgtggaagcttctcatgatttgagatcatcagcttattctgaaggtcttaggtcacctgtcttcttcaaaatatcagaagtgcctgatgatatgtgaggatgcacagtttaacttcctctatttgagtagctttacaattgtgtagagttcttaattaattaattttttttttggagacggagtctcactctgttgtgcaggttggactgcagtggtgtgatcataacatagctcacggtgatttcaaattcctggctcatagaatcctcccacctcaacctcctgactagcaagtagctaggtttccagggcccttcatctacacttggccggttcttttcattctttttttttttttttaggtggagtttccctcttcttgcccagactggagtgcaatggtgccatctcagctcactgcaatctccccctcccaggttcaggtgattctcctacctcagcctccagagtagctgggatcacaggcatgtgacaccatgccccgctaatcttgtatttttatcagagatgacatttctccatattggtcaggctggtctcaaactccctacctcaggtgatctttccacctcagcctcccaaagtgctgggattacaggcgtgaggcaccgcaactggcctcttcatttttattcatatgttccttcagcagccactatgtcttcccactgatttcttcagtttctgccttttccttttgaataaggcattattcctaagggaagtcgggaggtgggcctggacagggacttggtgcattcctctctcccgtcccagttcttattggtttctccagtggctgtagaacagcagttttgatggctttacctctgcagataatttctcttgcaatgtagtgctgatggggaggtgtgtctggatgcacttcacctatagttgctgttttgctttcccagacagcaccatcccaaggggtagagggtggagcattttgtgatgtatccccagtactgaagaaaaaggcttcaatagcaggaggaattcctcaactgtatacactctgagaatttaaacaataacttctctatcatactcaaattgaaaccatccaatgaatatgtctactttaatcgtgtgctaacttaaatggcatttggcagcctctgtgccagaaaagattatcatctgctcctgtttatttccctgcaagtccttatctctcttcagatttcagatatattgtttgtcctataacatcaaaaatttgatgtatatgtgctaatttgcagatcagtaagtttagtagctgttgtaagaataataacatatttttatggggtgcttacatctccaagctgagaagcacctctatgtgtaatactaagaaactagaaatgatacaaatatcaagaagatacatagataaaaagtaatggcatgctaatttactgtaataacatccatcatgagaatcaatacattgttgatgctcaacatgtttgcatcataagtagttatgtgcgagaagccacacaaatagaacacatactatataattcctgtataattcttgaaactcaaaactaaagcattaaatatgaaggactgactcagaatatggtggggaagaaaatatttgggaaggaggaattgtagaggaacacaaggaaacttttaagtgtaatttgtttgttcattatttggatggcttttggggatgcaaaggtgagcacgagtggaataacattttgttttgtttgtttgtttgtttttctgaagagatgtggtccttctctgtgacccaggctggagtgtagtggtgggatcatagttcaatgtagcctctaacttctggtctccaacaatactcctgcatctgccatctaagtagctggaactaccgttgtgtgccaggaggtttggcttggcttgagtacttattaaaccacacactttttgcaatatttaatgtatagtaataatgtctcaataagactattacaaatcaatgaatgaataatttgttcagtacagattcatggaaaaatagacactaacatgatgagtgtctgacatttatgaaaatacagctgcatgaaatgtgcttctctttacattcattaggtaaacacaatagtgcatacacatcacaccgtgctttcattacaggaagaaagttctgaaaatgtcactggggtgaaccacacggtgctgggcttggttcagggagcagtcaggcccagtgttgtgaccttcaaccacagaatccttaaaaaaaaaaaaaaaaaaaaaaagaggctgcctcaaagtccgcatcagttcccggactcgctatgtttctggatcgtatcagtgcatccggatctccctggtggctttagtgattccttgcttgccatgctgaggtctcgctgtagattatgttgggttttctaagaccgttttgctattgtaagatccactccctgggacagagcgattccctctaaacctgatagaggttctgaactaaaaataacattaagtgaatcctggtgtgtctgaactcaagtgattgttacattaagctgctgttccaatctgtttcctcacctgggaaaagaggagccaggacatagtgagttgaggccccaggaagataactgaattctcagagggcacagccagcatcctcctcccagggagagtctaaaagactggggcctccctcatcccttttcacctgtccatacagaggcaccacccacatgcaaatctcacttaggcacccacagaaaaccaccacacatttccttaaattcagggtcctgctcacatgggaaatactttctgagagtcctggacctcctgtgcaagaacatgaaacacctgtggttcttcctcctgctggtggcagctcccagatgtgagtgtctcaaggctgcagacatggagatatgggaggtgcctctgatcccagggctcactgtgtgtctctctgttcacaggggtcctgtcccaggtgcagctgcaggagtcgggcccaggactggtgaagccttcacagaccctgtccctcacctgcactgtctctggtggctccatcagcagtggtggttactactggagctggatccgccagcacccagggaagggcctggagtggattgggtacatctattacagtgggagcacctactacaacccgtccctcaagagtcgagttaccatatcagtagacacgtctaagaaccagttctccctgaagctgagctctgtgactgccgcggacacggccgtgtattactgtgcgagagacacaatgaggggaggtgagtgtgagcccagacacaaacctccctgcagggaggcggagggggcgggcgcaggtgctgctcaggaccagcagggggcgcgcggggcccacagagcatgaggccgggtcaggagcaggtgcagggagggcggggcttcctcatcagctcagtgctctccctcctcgccagcacctcagctgtccccaggcctcctctttctttattatctgtggttctgcttcctcacatccttgtggtaggaaaggaaggaggaaggcaaattttcctcttacagtcaaagtgtcactaattactaggaactttcctacaagttcctgaatgtcccatttttccttcttaattaaaaaaaatatatattctaatacttctcaccatctcttgatttgtgtcatcagttgaattgtgctgtctttgaaattcaaatgctgaaaccttaaatccaattgatctatattggaattttaaggatggaattaaggttaaatgtgatcataagtctgagattctaatgcaatagatctgttgtctttataagaagtggaagagtcaccagagacctctcacttttcccgtgcacgcagagaagaggccatgtggagacatagtggactagaaggtgcaagccaagaagaagccgcaccaagaaccaaccctgccagcacctggaccttggacattcagacttcagaatggtgagaaaatcaatgtttgttgtttaagccacccactcctgttgtcttcttatgaagacccagacagactaataccacataactctgttagctcctggagggagaagcagctccctgaggctgggcacatctctcagatatccatatgaagtaggcagaaatagtagttctcatataaaaatgtgtcatggccctgttggccatttttttttgacggagtctcgctctgtggccaggctggagtgcagtggtgcaatctcagctgactacaaaccccgtctcctgggttcaggcaattctccttcctcaacctcctgagcagctgggactacaggtgtccaccaccatgccagcctattttttttttgtatttttagcagagacagggtttcactgtgttagggtggtctcaaatctcctcactgcatgatctgcctgcctcggtttcccaaagtgttgggattacaagtgtgagccaccgcacctggcccctgttggccattcttggggcaatgtctctgaaaccagccctggtgcctgtaccacaaaattttcttttatctttcatgtggatataacaaatggacaatgaggaccagctgcatggagactgaccactgaacatcttctgctgtctcctaagtaagtcacaggaaaacacaccaacatcaccaacataactgttttccttcaacttcctcgaacgaactatagaaatgatcccttaaagtatagtctattccttcaactttctcaatttgcactgaatcccttcctaaattaggagctacatagggtctgagttttgttccctttctcccagtcttccccaagtatcaaggacagaatagatttaaattaaatttggccgtccatgcccccaacaccacatcggtttctaacatccttgtcatgtacccatccttctgtgggcaccccacatcaggttggccaggaatggccagaaggtgtcatcaccttatgggctgaggctacaagttatacacacgtgtgatttcagtcacacacactctactgcaggacacacctgtgttctgaggaactcaggcgcctgctgatctcaggtcttctctaataaattacacacctcttatgaatgaaggtccagatggccccatcagctgcagagcagtggattaaagctcatgggtgggtcagtcaggcagaagtcagacaatgggataatagaagtcagacaatagtcactgaggttcccaatgtattttaatggaataaaacaatattagcaacaaaggggcagtaaagaagactggctcttgaaggtatttaaggaccaggaactttatttggggggaaagtgagagacacttttacatggaaagccctaaagcacatacagcagctgacagagtggccactgtgcacatgagggctgaggagacggatgataggttacgttgctccaagatgtccctgggtgtgtgatggttggactcctcatgcatatgaaaataagagctggactcagggagaaacaagggccataccccatagaaaaggaagaaaaaaagcagatgggcacccctggagagagctcattagatttggtaggtttgagatgaaaattacttccaaaggttttaatgttctaagctaaatatgaatctcttcaataaagtgagaattaaaagaagaatggagctaggagttgagagaggaaacaaattatgagagagcagaaagcaaatccacccaaactgtcacatgacagaggccagaatggagctgatgcagctacttcactattctgcagacctagttgaccatgtggagaaggggttcgaacaaacggggatgttctccaaccttccaaaacaacctccttcttatgcatatgcagtaatcatgattctcagggtggccttcccaagtttcctgttcttacctcttcccccaggggtagagtgtcttttccaacccacagtggtttctctgccatgtcctcagcttctcctccattgtacttaacctgaagattaaggatttcatctggatggagtttcctgggaatcctctgttttctttggtttctgatgaccacatcacaggccataggacacaggttttagtggatttcccctggagacagtggaggtgaatccaggcgttccacagtccttaccgttcttctcttcctgtcagcaccgcaggacagcagataagggagctgactgtggatttttcagatccccgggaaaaagcctgcaaggactaatagtttcacatctaacaccattagcacatgcatccaaaattaaaaaaaaaatcctcactaaatatttccaggttagcctgttcctctctcaataccataccgtggcacctgccctgggttcggtaacatgtgggccccagtcctctctgtaggcgtctgcctcctcagatttcagtcctcttttttgctccgtgaaagcaactcagatatgttaaaaggttttcttcttcatttattcataatttttcaggtttgttgttaatgaggaaagagtaagatcatggtttcctcatttttcacattcccatactgagtaactgctctctctctatgaaagccagaaattaagagaacaactcaagtatccatatccattacaagtgaatgttagacaatttgatgtatgattatgaactaaagtacaacacaggattagaatccaggcatcctcattctcataaaatcatggctgcattcacaaataactgtgctgagtgaaagtagctaacaaattaacagtgcacttcataaacttctatttgtataaactgcagaaggtacagctattctaaagcaacagagaagattacatattggtgggaactgggttttgaaagtaatggggtggtgagatgaaattacagagaagtgacacaaagatttaggtgtgaattgtacacaaattaattgaagctctgattaaagggttgcacacatgttaccattttccaaattatgcagtatatatttgaattaattattaattgtatttaaataaagcagtaacaaagaaacaaatgaatacatttattgaggtggagccaaaactaaatgggaatgaacactcgaaacatctctgactcttgaaaatacacaagcgtgaacactggttctctctatgtatttcaggtcaatagcagaatacactaaaagaaaacagagatgtcctggcaggggtggaatcctgcagacctcactaggcatgtctcacactgccctggagttgtctcaggggagcagtctcctctagtggtcagaggcacaggccgagataatggggctaactctgtccagctgtgtgaccttgaatgcattgtataaacactctgttctctgtgtgatttatcttccttaaaatgtgacattgacacttgcattaaatgtattctacaaatatgtcaaaaagatgatgactgctaaatgattatcaaggcacaatcatataatataatgatattttcctgagtgataagatgactaccaatctcccccagggcactttgtctgctctgagccctgcacctcctcaggattcccatcccagagcttgctatacagtaggagacatgcaaataggtttctccctctgctgatgaaaaccagcccagtcctgaccgcacagctctgggagagaagcgccagccctgggattcccaggggtttctatttggtgatcaggactaaagacagaggacccaccatggagcttgggctgagctgggttttcactgttgctgttttaaaaggtgaactagagagattgagcgtgagtggatacccttgagagaaatggtggattatgtctgggagtttctgaccaggatgtctacgagtttgcaggtgtctagtgagaggtacagctcgtggagtccggagaggacccaagacaacctgggggatccctgagactctcctgtgcagactctggattaaccttcagtagctactgaaggaactcggtttcccaggctccagggaaggggctggagtgagtagtagatatacagtgtgatggaagtcagatatgttatgcataatctttgaagagcaaattcaccatctccaaagaaaatgccaagaactcactgtatttgctaatgaacagtctgagagcagcgggcacagctgtgtgttactgtatgtgaggcaccaggtaagaagacatcagtgtgaacacagacacagtttcctgcaatgataagggaggaggctgggctaaaaggggcactcaggacccactgaaaacgggcagctctagggcaggtacagatggttatcatgggctgctttccttcggggtctgtggcttcctctgcatctaccagttcccctcggagcctctggacatttatgtttctgtggccacccctgacatctctggattagaaaagtttattataggaagaggaaacattttcatttgtcccaaagcagatgtaagtaatggaagcaaaaaatgcacaggaggccaggtggggctgtagatactgtcaccccagaatgtcaatctcaccactagtactggagaggcatgggagtttgatggagcttccctaacaactctgtcttccaagataagtccagcaagaccattggtgcctcccagagcacagttgtccatcagggatgtccaatgcttcccagcagcagccatgcctcagtgtctccactgtgcacagccactgtctgggaggagctcccaggatgggtgtctttggcacacaccaggtggcgggtgttaagagtgcagtgcagcagctggctgcctggtctattgggcctgatgctggagagatgggaggtgcattcttggggccagcatgctgtttgtgaatttttatataaaaactctgattttacttcattttcgcagatgacatagataactaaaaacagaatctgcaaagaaattgtaattttcaactttaccccaaattcattgtttcttaattctgtgcaagatccagacatattattgccttcctcatgataatttattctatgtaaaaccgaaatcattttttctcctactctttgtttctgttcaagtacagagatcttgagcaaagtaagttgggttctttccacacactaaccctcaccttccccagagaatgagcagagattgtcctcagtctgagtctaagggaggagctgtttctgcacaactcagagcctgcagagacccccaggtgcagcttcagtgagtcagacatttctccatgtgggcgacctccagtgcctgtgactgctgctcaggcctaattgttggttaagcattaggacactctttaggtgatcacatctcaagcctattctgaaaatcaccatgatcagagatagttcaatggccattctcctaacataagtttctctttattacttggttccaagtatggagaaaaatgtgaccctatatttgtctgaatccaacatcagcatcaactgcattatgctaggagactcactaattgagcacaagtgagctcgttattctcatagaaatgtaagtatttggaaatttcagtgtgttctccagaacctgtggctgccaacaactgtatttctcggtgcactcttggcctggtgaagccttcacagaacctctccctcacctgtgccatctctgcattctccatcacaaccagtgtttcctgctggagctgcatccatcagcgcccccatgggaggtactggagtggatcgggtgcataggtcatggagggagcacaaattactcccctcttctcaagagtccagtcaccatctccagatccatgtccaaaaagtagttcttcttacagctgaactatgtgaggaacaaacacatagccatgtattttagagcaaaagacacagtgaggaaaccacagtgtgaactcatacccaagcctccctgtgggggtgcataggacagccagggttactcaggacaccaggctccctcaggacaccaaggggcactcaagaccattgtagaggcatgcaggtagctgggggctctcaggaaccatgggggaaaatcaggacaccaatgggtgcttggtacagcggggggctcaggattattgtggcgattcagaaagagcaggtccaaggctcaacctcagggcatgtgcagctggtgtgaaaaggagctggatgaggcgttttgtgtcaccatcatgtttcaccaccagacaccctccactacctctattctaatgcatgtgtttgtatgattagaaaatgatattgatataaatatataaccatagctaggtgtgtcaagttgtcctctccatcttatatcagccttgtctgtaaggactaattccccataattacttgagaacctcataaattgtggtcaattatgtaggattcctctctttttctgccttccttcctccctccttctctctctcacacagaaacttatatacagccaccccacaacacacataaatctataacttttattacctgatgtattgataagtaatctaaagttacataaaaatcagtagttcactgtcaatattgtaggagaagggaaggtctaggaaggaggaattacagaacaagaggatattttgagggtaattgacttgttatctatgtggataatgataatgtctgtgaccatatttgtaaaattgaacacttcgtgtggagactattatttttttatttaaccccatgccattattttgccgtattctagcatttctctaaaaatacagaaatgttcagcactcattcatgtgtatattcaggagtttctgacttttcatgtattttatttatctctgtctaattgctttgataccaaattttacctagtataattagtactacctttagcactgattataagtctcactcctccatcatctccttttttgccacacaagctgaatctagtttggactcataggagctgcttcattcaatgccagtggttgtttcaaaccctatcaacccccctacaaactgtcattaagaaagtttatcaaactccaccagtcatgtgatattagttcgttttcacagtggtataaagaactacctgagacgaggagtttacaaagaaaagaggtttagttgactcacagtgctgcatggctagggaggccacaggaaacttataatcatggtggaaggtgaaggcgaagcacggcacatcacacagcgcagcaggagagagagggggaagtgacacatacttttaaactatcagctcttgtgagaagtcactcactatgatgagaacaacatgggaaaactgccctcatgatccaataacctctcacctggtccctcccttgacatgtggggattagaatttgagatgatatttaggtggggacacaaaacaaatctatagcacatgtccagctgtgtcctggagttgtttcagggatccagtgtgtactgttgatagaaacagtgatcatcattctagctggtgtgagatggtatctccttgtggtttagatttgcatttctctgatggccagtgatgatgagaattttttcatgtgtcttttggctgcataaatgtcttcttttgagaagcgtctgtgaaaaaaaaaaagaaacagtgacaccaagctcacaccatccgttgtagttgacaacatgcaaagccaagagatctcaactgagatttagtgtgtgtgtcatgtctgatgaagtcataagctcagagcaagtgaatatggaaaagtgtattatctgcacagtgtaggtgtctgctgagtgcagggcaggtctcacaggaaaatctaaaatggcttgaaagaagaggaaaggagactggctcagggtttttataatggtttagtggtggcggcagagtgaggcttcccactcacagatcggggtttataaggtttgaaactcccactgccattgaatgaagaagctcctgtgagtccaaactagattcaccttgtgtggcaaaaaaggagatgatggaggagtgagccttaagtaatcaacaggcatgcaccaaaagatagagtgacaacttattctaggtagcaagaataaaaataatgaaaaagaaataagggttcagtatcgatggacaagacccagatctacagaaatgagatgactttagaaatataaggaaataataatgagagaaagaaggaggggatggggaattagggtcctggccgaatgtcttgggtagaagcttctcacaatcaaggactatcagcttattctgcaggtcttaggtcacacgtctgcttaaaaacatcagaaatgccaggcaatcaatgaggatgctcagtttagcatctcctatttgagtagatttacagttgtgtggaattcttaattgattctttttggtttgtttttagaggcaggctctcacactgttccacagcttaaagtacagttgtgtgatcatagctcactgtaattttgacctccagactcacgtaatcttcctgtatcagcctcctgagtatctagaattagaggggaatgccacccctcacctgcttattctttaaaatattttttcatagaaatagcatctctttatgttgcccaggttggcttcgatttcctggtctcatgtgatttccctcactttgcttctgaaagtggtgtgattatagggaagatccactgcatctgtcctgaattgattctttacttgtaaaacatgaagccaataattaactgcctgactgttttgtgcagtgagttagttaaaagtttctgataagattccttccaatatgattcaagagcagtattttctgccgatattcctttcagtttccttgttgaagatcagaagacactgcggaaaagatgtagtaaaaaggcagttttaactcttcatgattggagtggatatcacataggaatccctttccgtattttgtaacacatgcatgcaatagaacaaagatgatcccttggtgtaaaatctataaacgtatgggccttttagctaccaagtcatagggtaataactgatggaccctgaggagtgaaccatgattccatagtgctagtgggagaacccttggccaaggaagttcacattttattaaaattgataatttttatgtagggatgccattttttaaacattcccagaaggttgtgagtgggattgactctgtcttctgtgaacaatgacagtgccctccatggttagataatattttaaactagattgagctagaatggttgctgtattgaatcactatatttttttagcttcatgttagctttttgtgtgttagcatttgctttaaaatgatattaatcagccctctagtaggtagaaattcatctgagggtttcttcccttgttgtccatctcaataggatttccagaagacgtaagaaccctctctgtttctaaaaatattccaggctgggcgctgtggctcatgcctgtaaacccagcactttgggaggccgaggtgggtggacccctcgaggttgggagtttgagaccagcctggtcagtatggtgaaacctcatttctactaaaaatacaaaaattcgccgggcatggtggtgtacactcgtaatcccagctacttgagaggctgaagtgagaggattgcttgaaccctggaggcgggggtcgcagtgagccgagattgtgccactgcacttcagcctgggcgacacagcgagactccgtctcaaacaaaacgacacaaaaaattccaaagttgtgcaccctctaaaagcatacgtacttaattctcatttttaatttattaaacatctctaataagttcaatgtttcctgccttctgagttgatttcctaacacatagaagaatatatcctaaatgaaagtttgtgttcttaatagaaattactagttaataacctttacttttattattgaggtattatacatcaatgttaatcctctcaatgggactcttacctaaagaatatataaaatattttcctgatcatgacataaagtagatgtgaacacattcttagcattcagccatgtctcttgtctattaatattataaaccacatgctaactttgattttattggtaattgttctaatttctttttttttcccacttctctggttgtttttttttttaactttaagttttagggtacatgtgcacaatgtgcaggttagttagatatgtatacatgtgccatgttggtgtgctgcacccattaactcgtcatttaatattaggtatatctcctaatgctatccctcccccctcccctcaccccacaacaggccccggtgtgtgatgttccccttcctgtgtccatgtgttctcattgttcaattcccacctaggactgagaacatgtggtgtttggttttttgtccttgcgatagtttgctgagaatgatggtttccagcttcatccatgtccctacaaaggacatgaactcatcattttttatggctgcataggattccatggtgcatatgtgccacattttcttaatccagtgtatcattgttggacatttgggttggttccaagtctttgctattgtgaatagggaattgttctaatttcaaactagttaatttttatcttcatgcagctagattattatgtgtggctatttattccgagagtgataaagacaacattaacaattttcactgcaggcatgtctaggcaactccctgtgcactatgaccctggggcgttggagattctatggggactcttccctacctgcctaggagagttctctgccttctacctctagcattttcctctttgaagaagtacatctaactgtcattagaatagagacaaagacaagtcttaactgcttccagctgaggagggatgctgtttggggaagatctctcttggaggtctaagggaccccaggaaaagggagccattatcccaggcttcagttgcatgaccatttggagtttgatggtctgaaaatgagaagaggcaaatctggttattagaagacatgtatgaaaaccaaacaaggtggcaaggacagcttgaaagaaaattccaaggctgctgacattcctagataactgcagctgtagttatgcctgctaaggtttgggcgcatggggcttggcttttgtcagctccctgggatttattttcccaaacaaagaaacctccaggttaggggcaccctattcattcccatcacctggcatgatttaaaggataattgcttagaattaaaatattgatccagattttttatattccccatcgctttttgtttcttctgggctgtagccagagatcattgattggcgctcaggaataagcagagttagtctaaaatgcaggcaaatacttaaacaactgaagagattagaatttaaagacaagtgtatgatatgttttgaaatacaatgtttctctttccagttttggtttttgtcagcagcaaataatgataagactgagttgtttgcaaaataaactttagtcttaaacttggcctgattatttgcataaagtgcagcaagaatattaataataattctgtaggaaaagcctgcaagcaccaggagcttcacagtctaacactatgagcacgtgcatcctcacgcaactcactgaatatgtccaagtcagcctgttccgatcttaaatgccatccagtggcatctgccccaggtacactaatacatgggtcctgcttctctctgcagccgcctctctcctcagatttcaggttttgtgtattgtttgttttctctctgacatcaacacagatatgttgaaggttttcttttttttatttgtagttgttcagctttgttgttaatgaggtcagaataagctcatagtttacacatttttacattcccatgccgagtagctgcttttctctatcaaatccattaactgagagaacaatcacatttcgttacaggtgaacagttaaatagtttggcatatatttctgtgctggaatctaatgcagcttgaaatcaagtcatgcctcactcattgaaaaaaacatggctaaattctcaaagaattgtgctgagtgaaagaaactaaggaatgaagagtaaattttatatgatacatttgtagaaattttagaagatgccactattataaattaacatggagaagatttaaatgtttctgagaatatgctattgggagtaatggggatgtgagttaaatttcagaggaataagagaaagatttagggattaatttattcaaaccttgattgaagtgctgagtaaatggttgcaaacataggtctacatttttcaaatcattcaccataaatttgaattatttattaattacactcgaataaagcaataaagaaactgatgagataatatttgactgaattgcagcaataaatagatcgatattaacacaaggaatataactgacttccaaaaacatacacatgaaccgtggttcactctgcgtatttaggtaaataacagaaagttgtcataacagatggggaatcctgcagacttcactaggcatgggccatgctgccctggagttgtctcaggggagctgcctcctccagaggttagagcacaggcccaggtaataggactaaatttttagatgtgttatcttagacacactgcacaactgctgtgttctctatgtaaattatctcctgtaaaatataacattgaagcctgcattaaatatattgtgtaaatatgtaagaataaaagaaagttatgagagctaagtgttaatcaaggcacaagcatataagatataactatattttcctgaatgatggaattactaccagtctcccccaggacacttcatctgccctgagcccagcctctcctcagatgtcccacccagagcttgctatatagtgggggacatgcaaatagggccctccctctactgatgaaaaccagcccagccctgaccctgcagctctgggagaggagcccagcactagaagtcggcggtgtttccattcggtgatcagcactgaacacagaggactcaccatggagtttgggctgagctgggttttcctcgttgctcttttaagaggtgattcatggagaaatagagagactgagtgtgagtgaacatgagtgagaaaaactggatttgtgtggcattttctgataacggtgtccttctgtttgcaggtgtccagtgtcaggtgcagctggtggagtctgggggaggcgtggtccagcctgggaggtccctgagactctcctgtgcagcctctggattcaccttcagtagctatggcatgcactgggtccgccaggctccaggcaaggggctggagtgggtggcagttatatcatatgatggaagtaataaatactatgcagactccgtgaagggccgattcaccatctccagagacaattccaagaacacgctgtatctgcaaatgaacagcctgagagctgaggacacggctgtgtattactgtgcgaaagacacagtgaggggaagtcattgtgcgcccagacacaaacctccctgcaggaacgctggcgggaaatcagcggcagggggcgctcaggagccactgatcagagtcagccctggaggcaggtgcagatggaggctgtttcctgtcaggatgtgggactttgtcttcttctgacagttccccagggaacctcttaaatttagaaaactgtgcctaacaatgtcttctctatgcatatgaggaccttttctccctggcacaaaatgcagattgacgctgacacggatgaaaattcctcaaccatggtcacaaggatcagagtcctgagtaacctcagggcttcctggtgagtcttctccaatcagacccaggacagggacctccgtgagattccctgactggaacagtctttatggatcctggtcacagacaatagagaggctgaaccagggtcagcgtcatgtagaacctcacagatttcacgtctgatccttctcctgacacgaaagtatgcaaatcagtatcagcaccgatctggtgcttcttttgttcctaatccatttactttattttttcgtcgtttttctcctttttccatttgtttttcctgctttttgcaaaaggaagatgttttccctgtgagatgcaggggatgacaattttgggagatggctggaacatccaatatcctcagggccggccatcagtaagtgcaggctggaagtctcagaaagagctgaagctgcttaatcaccgtggagttttaccttctccagttctgctctgatggaatcagggccaagcaggttatcaatgataatctacctaacatagagtcaaccgattccagtttcaataacgtctgttaaaaattcacaccaccacctggattagtgttttgtcaaatcaatacacagtattgtccagctaagtagacccaaagacggaccgttgcccatggagaaaaacattaacctgagttctaggttcttacagtgttaaaggtgtaaaactgattattaaaaatgaggctatttttctttttgctgttgagttgtagaagtttcttttccatttggacattaaaactttttgagatatatggcatattatccaattctgtaagttgtagttacttggttgctttgcagaatctttttcataatctattcccacttgttcaattctgctttttttttgtaggtgatttgaatgtaaaatccagaaaaagattgctaattttttgagggttgagagttttacaattacaggtattaaagttagatatttgaggcatttggagtgaatttttgtgtttattctaacctaaaattcttaattcttttcatgggaaaatccagttttcataccaccctctttggaagacactacaatttagccatgttatattgatggttctcatgctaaaaatcagctcgtcatcaatatgtgggtttatatctaagctctgtataggtatttatgccaaaactttctatgtttttaacaaatgttaaggcctggaagtgaaatgcctaaagctttcttcttgccttgttacagatattggaccaaaatattctaaccttttactattgagtgtaataatagctgtggcctttcttaacggcttttattatgttcaagttgttttcttgtcttcctactttgttcatagtttttataatgaaactgatttttttcaaagtctttttctgtgtctgatgaaatgttactgaggtattttttctttagttttttaatgtggtgtaccaaattggttgatttgagaatgttgaatcaagtatgcatctcaggaagaaatttgagttggtcatggtgtatgtcttctaaaacactttggagcttagtttactattgttggggattaattcatgtctactaatgatattggtctgtagttttcttttattgtggtgcctttgtctattactggtaatactatcatggtagcctcatagaaagagtttagaagatatatggcagactacctttaaaatagattttatcagtggagaaatggtgatagttttttcttcacttttctgttgggaagaattttatgttgtttaaaagatattcagaatgacttaacctggtttatgagctttcattctattcctttcttccattctttttgaagaactgcttaccttttccttttaatttttaagtttgtttttagacatatgcaatacattttgaggtgaaacctggtggaattttttctaataaattagaaaaaaataaatcatttaattgactattttattcaggttgatttgtttaatatttgctaaaggccagttctttaagctatgacacataataaatcccaaatggcagtacctcattgtttacttagcttttgtacttatatttctcagaggaagaaccactactgtaaattgtaaatagccaatacataattgtattgtatgcaaatctgtgactgtttacagtgtcatctctgagaaacataaagtttatttactatatatatataaagagtttggaaggtggactcctcaccaatttttgaaagagttacagaagggctggcattacttctttaaatgttaaggttcattttatgatgtgacatataacccatcatggagaatgttcaatgtgttcttgagaaggatgtgtattacgtgactcttggttggaaggttctgtaaatatcattcagataaatttgttcaatagtgttgttcaagttcagaggcacattaggaattttctttccggatttgctatacattatggtcatgaggtattaaggtcttgtgttatttttgtattgttttctatttctttatatctcttacagtttgcttaatgcagttatatttgtatttgtacacatgtgtaaaaacaaaaatcataattgctaaatgagttttatggcacagtcacattataagtaatatttttccaaatgctaccattgccactaaactcctcctggagtctgacgtctgctttgggcactgccttcttctcaggcatcccacactggagcttgctatagaggaggagggagggcccctctcctggtgaaaacaagcccagacctgaccctgcagctctgggagaagagccacagccctgggattcccaggggtttccatttggtaatcaggactgaacacagagaactcactatggggtgtgaattaagctgaatttttcttgttggtattttaaaaggtaactcatagggaactagagtgagtgagagtgagtggatatgagtgagagaaacagtggatatgtttgccagtttctgaccaggatttgtttgtattttcaggtgttcagtgtgaggtggagctgatagagcccacagaggacctgagacaacctgggaagttcctgagactctcctgtgtagcctctagattcgccttcagtagcttctgaatgagcccagttcaccagtctgcaggcaaggggctggagtgagtaatagatataaaagatgatggaagtcagatacaccatgcagactctgtgaagggcagattctccatctccaaagacaatgctaagaactctctgtatctgcaaatgaacagtcagagaactgaggacatggctgtgtatggctgtacataaggttccaagtgaggaaacatcggtgtgagtccagacacaaaatttcctgcaaaaagaagaaaggagtctgggccaaaggggacactcagcactcacaaaacaggtgcagccccaaggcaggtgcagatggagggagggtaagggctgctttccttcaggatctgtggtttcctctgcttctaatatttcccctctgagcctctgtacatttatattttgtgcccaccatgaggtcgctggattagaaaactaatttgaaagaggaaatattctcatatgtcctaaaaacagatgtaagtattggaggcataaaaatgcataggagccgggtgtgtctgtagacactgccacccccaatgccagacccacaactagtgctggagaagggtgggagtttgatggagcttccctgatgaccccgtggtccaagctaagtccagcaaggccattggtgcctcgctgagcacagttgtccatcagggatctcccatgtgtcccagcagcagccatgcctcaatctctccactgtgcacagccattgtctgggaggagctcccaggatgggtgtctttggcacacacagttgatgggtgttagagtgcagtgcagcagctggctgcctggtctattgggctcctggatattggagggatttgaggtgcattctcagggccagcacgctttgtcaatttttatatgaaaaccatgtgatttaattcattttctcagatgacatagataattaataacacaatctgcaaacaattataattttcaactttaccccaagttcattgtttctgaattctgtgcaggatccagacatggtactgcccttctcatgagaaactgttcgatctaaactgaaaccagttgtttctcgtatactttggttctccccatgtgcagagatcttgattagagcaagtttggtactttccacgcactcaccctcacctccccagataaagagcagaagttctccttagactgagtctgagggaggagctgttcctgtaccactcagggcctgcggagacccccaggtgcagcttcactgagtcaggtgtttcactccctgtgattgctgctcaggtctaattgtggctcggaattaggacagtcttcaggttatcacaggtcaatcatattctaaaaatcatcgttatcacacaccatggtaacaattcaaggttcatttttctaacggcagtttctcttttttatttggttgcaagtttgaggaaaggaacatgtgataatactttttaacctaacctcgaaatctactgaattgttctaggagactcacaaattggacaaagtgagctctttattctcataaaaatgtgtggttttgggaatttcactgtgttgcccagaacctgttaacatcaacaactatgtttctcagcacacttctggcttgagacgtccttgcagaccctctccctcacctgcactgtctctggattccccatcataaccagtgtttcctgctagaattgtatctgcttgcccctagaagatggacaggagtggatcaggtgcatgggttgtgaagggagcacaaattacaacccactgctcaagagtccatatccagatccaagaaacagttcttacagctgagctctgtgcccagtgaacacacaactacgcatttttaagcaaaagacgcaatgaagggccttcattgtgagcctagacacaaccctccctgcaggggtgaataggagcagcagggggcattcggggcagtatgggggcttaggatgattgttaggggtcaggatgagcaggatcaaggcttcgcatcagggcaagtgcaacagggcagaaaaggggctgtagatgtgggttgttctcaccatcatatttcaccaccagacaccctccactacatctcttctaatgtgtctgagtgttgatatgattagaaaatggcatttatgtaaatactaatatgtacccatatggaggtgcatccagttgtcttctccatcttatgtggaccttgtccatcaagcactaagtccctgtatttacttgagtacctcacacattatggtcaaaacaggtagggtctccttttggcatggtctctcctcctgccttctctcttctgtcacacaaaaacacgtgaactgacacacacacagagcttcccaactttaattatgtgatgtattgaagcaaattgattagtgtgcagcttttctgctttgcctgctattcatgttatgtaaaaataagaaccatgtttttctcagcttgtcacttctctaagctaagtagcatctttgtttattatacccagagaccaaaagcgatccaactgttattcagcagcttaactggtaaacaaattgtggaaaattcacttactggaatcatacccactgctacaatcaagtaatgctggatacacccaacaccatgcttaaaatagcaagtacttgaataagtaaaataagtcagacaaataaaagtgcatacatacgattccacttctataatttctataaagtaaaaatgaacttaaagttacataaaaagatctgtagttgactggggacatggtacaagaagagaaggtatagaaaggagaaactacaggagaacaaaaggaaatttctaggataattgatttttttctctgttagtaaaagtgaggattatgtcaatatttgtaaaattgtacactttatgtaaagattcttatttgctaatttcacctcattaaaatattgcaattttttaaatgtctagtttggtagaaaaggtagtagagagagatgaataaaatacataaaaatcagagagtcctgaatacacacatgaatggaccctgggtctcactgtactttgagggagacactagaatacaaaaacataatgacaggatttcagtacatgaaaggagcttctcagaccccaggaggcatgtccaactgcgtctgggagttaactcagggagcaggcatgtcctttggaaggagccgtgacaccaagctcccagcatccattgtagccgacaccatgccaatgccaagagatctcaactaaaattttctgtggatgttgagtctgattatgccacacactcacaccaagtgagtatggaaaggatagttacctgcatccttaaggtgtctgctgagagcagggcaggtctctcattaaggtccaaagtggcttgatagggcagggaaggagactggctcagggttgttatcatggtttggtggggagcggggcagagcatcctacttgcaggaagggttttgtggggtttcaaggccaaattggcatcaaatgagggagctcctgtgatttctaactagatttaccttgtatgcttaaaaaaagagatgatggaggaatgagcctgaagttatcagcagtcaggcctaaacacagagtctgatgacttactctaaatagcaagtatacaaatgatgagtaagaaaagagacaagactccaatatgggtggacaacagccaggtctgcagaaaatgagaagactgtttataagcaaagaataatgagtaggatatggaggaggattctggtccaatgtcttgtgtggaagcttctcatgatttgagatcatcagcttattctgaaggtcttaggtcacctgtcttcttcaaaatatcagaagtgcctgatgatatgtgaggatgcgcagtttaacttcctctatttgagtagctttacaattgtgtaaaattcttaattaattaatttttttttgagacggagtctcactctcttgtgcaggttggactgcagtggtgtgatcataacatagctcacggtgattttaaattcctggctcatagaatcctcccacctcaacctcctgactagcaagtagctaggtttccagggcccttcatctacacttggccggttctttacattctttttttttttttttttaggtggagtttccctcttcttgcccagaccggagtgcaatggcgccatctcagctcactgcaatctccccctcccaggttcaggtgattctcctacctcagcctccagagtagctgggatcacaggcatgtgacaccatgccccgctaattttgtatttttagtagagatgacgtttctccatgttggtcaggctggtctcaaactccctacctcaggtgatccttccacctcagcctcccaaagtgctggaattacaggcgtgaggcaccacacctggcctcttcgtttttattcatatattccttcagcagccactatgtcttcccactgatttcttcagtttctgccttttccttttgaataaggctgttactcctgagggaagatgggaggtgggcctggacagggacttggtgcattcctctctcccctcccagttcttattggtttctccagtgtctgtagaacagtggttttgatggctttacctctgcagataatttctcttgcaatgtagtggtgatggggaggtgtgtctggatgcatttcagctgtagttgctgttttgctttcccagacagcaccatcccaaggggtagaggctggagcattttgtgatgtatccccagtactgaagaaaaaggcttcaatagcaggaggaattcctcaactgcatacactctgagaatttaaacaataacttctctatcacactcaaattgaaaccacccaatgaatatgtctactttaatcgtgtgctaacttaaatgacatttggcagcctctgtcccagaaaagattatcatctgctcctgtttatttccctgcaagtctttatgtctgttcagatttcagatatattgtttgtcctataacatcaaaaatttgatgtatatatgctaatttgcagatcagtaagtttagtatttgttataagaatagtaacatatttttatggggtgcttacatctccaagctgagaagcacctctgtgtaatactaagcaactagaaatggtacaaataccaagaagacacatagataaacagtaatggcatgctaatttatggtaataacatccatcattagaatcaatacattgttgatgctcaacatgtgtgcatcataagtagttatgtgcgagaagccacacaaataaaacacatactatgtaattcctgtataataaattcttgaaactcaaaactaaggtattaaatgtgaaggactgactcagaatatggtggaggaagaaaataattgggaaggaggaattgtagaggaacacaaggaaacttttaagtgtaatttgtttattcattatttggatggcttttggggatgcacaggtgagcacgagtggaataacattttgttttgtttgtttgtttgtttttttctgaagagatgtggtcctactctgcgacccaggctggagtgtagtggtgggatcatagttcaatgtagcctccaacttctggtctccaacaatactcctgcatctgccatctaagtagctggaactaccgttgtttgccagcaggcttggcttgagtacttattaaaccgcacactttttgcaatatttaatgtatagtaataatgtctcaataagactattacaaatcaatgaatgaataatttgttctgtacagatttatggaaaaatagacactaacatgatgaatgactgacatttatgaaaatacagctgcatgaaatgtgcttctctttacattcattaggtaaacacaatagtgcatacacatcacaccgtgctttcattacaggaagaaacatctgaaaatgtcactggggtgaaccatattgtgctgggcttggttcaggaagcagtcaggcccagtgttgtgaccttcaaccacagaatcctaaaaaataataaaagaggctcccccaaagtccccatcagttcctggactcgccatgtgtctgggccgtatcagtgcatccggagctccctggtggctttagggattccttgcttgccatgctgaggtctcgctgtagattatgttgggttttctgaggccgttttgctatttaagacccactccctggcacagagcgattccctctaaacctgatagaggttctgaactacaaataacgttaagtgaatcctggtgtgtctgaactcacatgattgttacattaagctgctgttgcaatctgtttcctcacctgggaaaagaggagccaggacatagtgagttgaggccccaggaagataactgaattctcagagggcacaaccagcatcctccttccagggagagcctaaaagactggggcctccctcatcccttttcacctctccatacagaggcaccacccacatgcaaatctcacttaggcacccaagggaaaccatcacacatttccttaaattcagggtcctgctcacatgggaaatactttctgagagtcctggacctcctgtgcaagaacatgaaacacctgtggttcttcctcctgctggtggcagctcccagatgtgagtgtctcaaggctgcagacatggagatatgggaggtgcctctgagcccagggctcactgtgggtctctctgttcacaggggtcctgtcccaggtgcagctgcaggagtcgggcccaggactggtgaagccttcggacaccctgtccctcacctgcgctgtctctggttactccatcagcagtagtaactggtggggctggatccggcagcccccagggaagggactggagtggattgggtacatctattatagtgggagcacctactacaacccgtccctcaagagtcgagtcaccatgtcagtagacacgtccaagaaccagttctccctgaagctgagctctgtgaccgccgtggacacggccgtgtattactgtgcgagaaacacagtgaggggaggtgagtgtgagcccagacacaaacctccctgcagggaggcggaggagccggcgcaggtgctgctcaggacgagcagggggcgcgcggggcccacagagcaggaggccgggtcaggagcaggtgcagggagggcggggcttcctcatcagctcagtggtctccctcctccccagcacctcagctgtccccaggactcctctttctttattatctgtggttctacttcctcacatccttgctgcaggttttaacagtcactggcacccttttttcaacaaattcccacaaggcccattttaccttcttgacaagcaaaatattctaaggcttctcactatcccttgattggcgtcatctactgcatcgtgtctttctcttaaattcatgtgatgaaaccccaatcccagtggctctgtattggacagagggattttaagagggcaaataagttaactgtggccataaatgtgggaccctaatccagtaggactcttgtccttatgagaagtggaagacatcagaggcctctctctccacatgcacacagaggagagtccatgtggggatgcgctgcatgagaaggtggccctttgcaagcctggaagaggcctctcaaaaaacttaccctttctgcacccagatcttggacgtcaagactccagaacaataagaaaattaatatttgttatttgaaatagcctagtctgtggtatcttctcatggaaagccaagtagattcagagattcaattgtgttagctccgtctcctgcatggagtagcagcccaccgaggctggacacatctctcaaattattttcataaagaaaaatagatccaagatgaaaaccccaccacatttctgctgagccattcacttagcagcagtctctgagatcagccctgggggtatgttctaggtcgtgtatctcactttccactatgagaatccatgtagataatgagaaccagccagatggagtcctgatccctgcccaccttctgcttccccccaagtgacacacggtcacagaaaaccactccagcatcaccctgtgtcttgtactctctaaaatcccactaaagctgaccctaaactaggagctatttggggctggactcattctgttcttagtcttccataaggtccaggtgccgagtagagcctcagtaaagagtgagcttcaattcccctaacccacatcattcccttacatccttgtcatgcacctgtcctctgcaggcacccagggcaggttacacaggaattgcctgaagctggtctcaggtgccctgctgagaccactggttatgcacacgtatgatttcaggtcatgcaggctcttctgcaggacagacctgtgtcctgtagagcacagacacttggtgacccagggcctcctctaataactcatacatctcatgtcagtgtatatccaggtggcccctcagtgcagcacactagggtgattaccctcacaggtggctttttcaggcggtgaacagaaaatggggtgggcacgctggtcattcccatcatcggtgatatccaagtgaattttaaataaatgaaacaaaactaacaacaaaggggaaggatatgtacctgtatctgggaggtagactgggtcccagaactgtactgggagtgggtgtgaaaggcccttttgtgtgggaagccctccagcatgagtgaaagctgaaggaatgatcactgtaggtggaggctgatggagaagctggcagggtacatttcctgaagctgttcccgggtgcgtgatggttcaatggcccatgtacatgaagaggagggctggactcatgtaggatcaaggaaactaccccatggcaatggaagaaaagaaaatggagatggacacccctggaggcagcttattagctttggtggaggaacgatgggaatttattccaatgaccccagcattttcagctaaatatgagttgcattaacagacagaattatgaagggaagggagaaggagtttatagagggaaaaagcagaacagaaaaaaagaactatgcaagtctatcaaatggcagatgacagagtggagctgatgcagctacttcattcttcccggaacctaccagagaccttggcattcctgtaaggcaggtctagtggtgatgcacttgtccactttttgctttttggagaaacgtttgaaacatcctacattactgaagaaaagctttaattagtgtaatatttttacttgacagttttattggttttgttttattttcagcaacttgaatagaatcatgcacatcatgatatttgggtgaacaacaggccacatacacgataatgatctcattaaattataatactgtattttcactgcatttcttccatacttagatatgttcatatatatacatacctaccatggtgattcaactgcccacagtattcactacacttacatgatgtacagatttgttatctaggagcactatgctatcccacacagcctgggtgtagcagggtatttcacgtaggttcacgtaaacacactctatgatcctcgcatgatgacaaattgcctaaggacacattgctcagatgtatccctactgttaagctacacatcattgtatctcatctctctccatttttggtctctgataaaattctcgtgttgtttttgcattcttctctgagctcattgaacacatttataaggtttcctttgaattttctgccaggtaatcaatatacctccttttaatttgtgtcagtttctagtgctttgctttgttacagaatttggactgctttttttctctttcattattattatcactttgtacattctctgttgctttctgctcattagaaggaaaagccatggtaaccactcttcacagaatatgctcagggcaaatgccatcacctgttagcccagtccatgatagtggtgtctcttaaaatttcatactggtccaaactttttgttgttgttgttagtggcactcagacctatagaggattttaagttttcccctactctaaattaggtggcatcaaaattcatcctgcaggcagtctctgataaagtggagaaattggacaaagttttagcatgtatatggttcataaaaataatatgagtttaaggttttctcagccagttgctacatattgatattttataatcatttctttgaatgtctctggagtttatcttttgaaaatttagatcagaatatataccaggtttgaggcttcttgtctggcttaacgatctcctataggtcagcgtgtgaaaaggcacagagtctatctgaagaggagaactcagggaagccccaaaacaacagaggagacaaaactgaggactttgaggaatctaaagcttctgggacctgcagcctccagacatgctcagcaccctcttgttatccacggactaatttctttctcttttctgagtggtattttctagggttcccgtcctccactttgacactttggtatgtccatgtgtgtccattgtgtttcagccagggacacagaaccaggaaaacatcatggcttttctagagggagctgacctgggtaatcaacagttggagtagaaagtgcctttgtccatgtgtcacaggcctaagggccatgggcaggaggtcaggaagagaggatgaccagacggctggggaaaccaggatgaacaaagccactctccttcctggtgagaaggggcatgtggaagcctggtgtccctgtagggctgaaccacactcacctgcccactgctacctgccagcgaggtgacccacagagcagcagcagctcctgagtcactcacagaggctgcctcctcctccaaaccctccagtgtatgtgcttccataagtgtgagccccagcagatcccaaagttttcaatgggttcatctagctagtgtctgtcctcagccccatccccaggctcctgccctggttggtgtccacagtgtcccagcagcggtgacagtgacagccagggcctgcactttccagagcagcaagtttggaagaatcaagtcccagaaccagcctggatttggggcaaacacacaaatttcactctgaggggaagtgctggaaagtagccttgagtcttcctcagctcacctgtggctgatcctctgcatcccatcagcgatacatgagccctccccaaccccagcgtggagctgtttcaatcgcagcaggatgggaatgtgtcttctttctggggactttttaagcacagctcttatgttcctgagatttgaggtttataaaggtgtgtcagtcacccacagagtggacctgcacaagtaagacaaggacaggatccccaggagaggcacctcatatgagacgggacaggcaggtcccatcacagacactggtcctcagaaaccctgaccagctactcaccttcccaggtcacctgtgtctgatcagttcctgtgtttgctcctgaaaagatccccatcaagggtccccaggtcctgcccccttccttgatgtgcctctgggagtggggctggctgggctgtgggtctgctgtgactttccccacaggtcagcggctcagtgcaggctgcgccaactcggtggggctgggctgtggccgaccctcccagggggagcctggatgcttctcgggggcatctgcaggatcccaggttctgggagaacagggaagccacagtgtgtgcagggccccatctccaggtgtaaagtgtttgctgtcactctgttgacaagggcatatccccaggcctaggggcactgtgggtgcacaaccaatgtggtagacacagagagtaaggcacatttccctcccattactgtggggaatctaggcactgtgtgtgtgtgtgtgtgtgtgtgtgtgtgtgtgtattaggagttttgcagtgggctctgagccccgtgattttgtaggtttagaaattatctgatgagatgttcatccacaggaaccgacaagagattaggtgttctcccaaagcccctgggagctcctggactcattgtgagtgtggactgatccattgcttccagagctccacagaaggggctccctggtggtttcatagaatccttgcttggggtctttctgcagagttcactggctttcctacggccagtttagtattgtaagagatggtgtcagcagcacatggtatcacatgtcactaaatgagcattctgagccaggacacagcatcttcatactggggggagggaaatgctttgggagcccagacaggagcctctctgcagtgcaagggctgggctgcagggggcgctcaaggcccacccatcacaggctccacccccagagcaggtgcaccggaggctggggagggattcctctcaagatctgtgtcattcttctaaaaaaaatctaaaatgagtatttgacaaagactgctgaacattctataaatatcctattcaattgtgagcatttatcaaatttgatgttgtaatgagaaccacttttatactagatatttctaaccctgctagatatcttaatagtatgcagctggaggttaagcaagcttttcttttatataaataagtgcaactttggagaaacacactcatcccccgaataagacattcatgtattaaagcctagaaatactttaaattacctctgagccattcaagtgtgtgttcacagtgaagtcctgttctagggaaaattgttctccagggggagaagctttgtcaacatagagcttagggatgtatcaggaggcacatgacctctaaggggattatagcttgaacccttagcatcctcctgttggtaatacatgtgtcactctccaatctttctcatgcagtatcaggtatgaaataggatcgctcatgaatatgcaaataactgaggtaaatatagatatctttgtgccttgagagcatcatccaacaaccacaactctcctcagaagaagcccctagaccacagcacctcaacatgtactggacctggaggatcctcttcttggtggcagcagcaacaggtaagggacctcccagtcaccgggctgagagagaaaccaggccagtcaagtgagacttcacgcactcctgtctcctctccacaggtgtccactcacaggtgcagctggtgcagtctgggcctgaggtgaagaagcctggagcctcattgaaggtttcctgcaaggcttctggatacaccttcacaagctatgctatcagctgggtatgacaggcccatggacaagggcttgaggaaatgggatggatcaacaccaacactgggaacctaacgtatgcccagggcttcacaggacggtttgtcttctccatggacacctccgtcagcatggcatatcttcatatcagcagcctaaaggctgaggacacgtgcaagaggcacagtgtggaaacccacatcctgagagaaccagaaatcctgagggaggaggcagctgtgctgagctgaggcagtgacagggacaacgtggctgcaccctttgttgacatagggttatacacatacatatatatgcacccaacactggagcacccaggtatatcaagcaaatacaattagagataaacagagagatagacccaataccataatagctggagactttaacaccccactttcagcattggacagatcttccagacagaaaattaacaatgaaatcttagactaaatctgcatgacagaccaagtggacataatggatattgatggaacacttcatccaatggctgcagagtacacaatcttttcctaagcatatggatcattctcagggatagaccacatagtagaccagaaaatttgtcatttttaattaaaaagatatcatgtaccttctctgatagtaatgaaagaaaactaaaataataagaggaattttgaaaacacatggaaattaaacagtatcctccttaattaaacaatgtgcttccaaactgaactatatgctctaaaatgggttaataaagaaacaaacaagaaaattttacaatttattgaaagaaatgataatgaaaacagcgtatgaacacctatgaaatacagtgaacatagtactaagaggaaagttcacagctataagcacctatgttaaaaaagtagacaattataacataaacatcttaggaatatctctcaaaaaaaactagaaaagcaagagcaaatcaaatccaaacatagtaaaataaaaaagttaagatcagaacgttaataaataaaattgaaataaataaaacaataccaaagatcgatcaaatgaaaagttgttttttaaaaagataaaagacatctataaacctttaaccagaccaagaaaaaaaacaaagaagaccaaagtaaataaaatcagaaagaaaactggaaatattacaaccaatagtgcagaaaatcaaaggatcattagaggctactaggagcaactaaatgccaataaatcgaaatatctggaagaaaaggataaatttagagacacatacaacctaccaagattgagccaggaagaaattgaacagatcagtaacaagtagtgagagtgaagccataataaaaggtctcccagcaaagaaaaaacccgggacttgatgacttcatcactcaattatgacaaacatttaaagaagagataatacctaatctcactcaaaatattccaaaaatagataaaaagtagataaggaagggaagaattcttccaaacttactgtacaaggccaatgttacccttatatgaaaaccagataaagccataccaaaaaaaaaagaaaactacagttcaatatcactaatgaatatggatgcaaaactcctcaaggaattcttagcaaaccaaattcaataacatatcaaaagagcattcatcatgaccaagtgtggcttatcccagagatgcaaggatggttcaacctatgcaaatcaatcaatgtgacacatcgtatcaacagaatgaagggcagaagacgtaagatcaggccttaccttgttctcctcactcaaagtctaccattagttctttggtcctcttgaccagtcctgctgtacttggtctcccgtgattctgttcccaggtcctgaaacactgggcttctgcacacctggagtctctctctttgaacatggagaccctgtatcctcagagagggatgatgcctcattgtggctcccatgccccatgcaaacaattcttccaacacagtcatgatttttcctgttggaaattgaaaggggatgtgggaattgatgtgtgtgtgtgtgtgtgtgtcctcaggcctgttgggcctgttgagaacacagcagggctctatgtacaacaggaaagcaatgttttctctataccatctattttcttataaagtgttcataggtaatcaaaaggaaatgaatcacagtttataagatgttgtggactggactgatgttgtcactcaaggctactatgggggctccaggaaaagaaacctagaaaaggataagactgtgagcaaagaagcaaaacctgggaagcagcagggagagggtgagcaggggtgactcaactggggagggataacaccacttaccacagagggtgaaaactccgtgctcagcaaagaggagaacttactcagcatttcccctaatcctccctccagaagcgcgactgccaggaaagttcacaatgtatcatctccagctgggaacccaaaagaaacaggagattttagggcataggtcctgggcacaaggtgtttccctggttcctaccccttccctctctgtccagcaaaactgcttgtttctatcacttgccttcctgtccttggggtaagaatggatgctttgacactcagcagagggatgctctttcagaggaggaatgagtttgtgttatctgatgtctgagcaggacactcacctctgggaagaggctccaagacagaaggtcgccgtggttcctgccccttatatgtgaggggctcttgacacatgcacacttttcctcaaactctgtttataccccagcaacaatgctgggtgttgtcagcctctctcctccccagatactgctctatcatcagcttgagcacagtttccccatgaaaggcattattctctctctcaagaagatcaactttttacatgtcttcgatggatgacagtttttctgtgtgagaatctagaaataagaaatggggtaatggggacaagtgagctctctgtgtgactcactaggaagtccactgttattccaggtgtcctgtcccaggtgcagctgcaggagtcaggtccaggacccatgaggccctcagacacttccctctgcctgtgctgtgtctggattcttttttttaccatggatattatttgagatgaatccaccatcccgtgggcaacaggctggaatggctggggcacagttactagactggatcatcaaggaatacacatcatgcaccctccacccaggtccatgtccccatcaacagtgactcaaccaagagccagttctctgtgaagctcagctccatgaccacctaggacacggctgagtattactgtgaaagactcagtgaggaggtgtccttatgagccctgacacaaacctgtcagggcacttaggacctccaggaagactcaagaccaccaaggggactcacgaccactggggaagggcaggttgcagtaagcacagggccagccccagagcaggtgcaggtggagatgagaggctggtttactgccagggtctggggctgcttctccatttagatgtttccttcagagaccctcccttatttcatgatgctctgcttagctgtaagtctctgaaatatcacagttttgttgtaccaggaggaaaccttctctcaggtgctaaatgtagaacaatctctctgccagtggttgccagggtcacagccctgtggaagctgaagggtacccagtgagtcttctccagtcacattcaggacaggaaccttagtggggttccctgaggagaacagtctttaggaattctaacctcagccaagagaggctgggccagggtcagtgtcaggtagaacctcacaggatttacgtctgacccttctcctgacactaaagcatgcaaatcagtatcagcactgatctggggccccttttgctcctagcccattctatttcttgttagttgtatttgttgttgattttccttttgctgttcctgatccctgtaaagtggagatgtggttcctgctgtaaaaattccagggctcaagccctttccctgcagctcaggtggggctcagactgtggctcctgcaaccacgtgggagaggctgatgggactatcttctctcccgttgctcagaaccctccagtgtgttgtgtggagactcacctgggaatgcaagtggccaatagttgtgaaaggtatgcgcttgtttggtcaaagtggaatgtggatgtggaatttatcctgtgttgtgcaaactaacacaggttcaccttcctcacctgtagtgttagaaagagtgtgaaagttgtaagaatcaaaacagagccacttgtgttaacaccctgacaaatggacctaggaatgaacatgaaggagggttcttaggcccatattcctgataacaaaaactatcataaatagactctgcttagccaccatcttggatagaagcccaccacaaccttattaaaaattacacttgcaagaacatcagctcagaaactggctgttcaaccttacactgatgccaccattgctattgattctacaactatatgataattatctcaaaacaacttttgtaacccacctcattttcacttcataaacctgtggattgacatgttggagttactgctgcatttgtagataatgataaataataaggccttttaacaatgtttgaagctgctattctctgatgtctcttctaaaataaagaatttccaagtggatgacaatgaaaaaattgttagaaatatttggtggtaaggcatctttaacatcctgttgaatgtttctgcatagcacatcaatcccttaaaatactttgctatatctgcatttaatgaatgagtctaatattgaggtgcaattgaaaatacctgggcctttgatgaatcagctcatagggtgataatgtctgggtccttgagaaagcagaccctgtgttgtaagttttagtagaagtaccttttgcaaagaaagttcatgtgtttctgaacattatgctacttttaacttaagaatgcaatatatgatttatttttacttcaaactgggtatatacccagtaatgggatcgctgggtcaaatggtatttctagttgtagctccttgaggaatcaccacaatgtcttccacaatggttgaactaattttcactcccaccaacagtataaaaatgttcctatttctccacatcctctctagcagctgttgtttcctgacttgttaatgatcaccattctaactggaatgagatggtatctcatcgtggttttgatttgcatttctctaatgactagtgatgctgaacattttttcatttgtctgttggctgcataaatatcttgttttgagaagtgtctgttcatatcctttgcccactttctgatggggctgtttgttttttccttgtaaatttgtttaagttctttgtagattctggatattagccctttgtcagatgggtagaatgcaaaaattttctccgattctgtaggttgactgttcactctgctgatagtttcttttgctgtgcagaagctccttagtttacttagatcccatttgtctattttagattttgttgtgattcatacttggttaatttttaattgcattgttttcttctgattagttgtaagtatacctgcatattgatcaaaaaagccgtttaacaaatcaaaaggaaacatttaacaaatacgtgacttggaagtattttctccaagtctgttgttgtcttttactcccttgtcagtgtgtattgcagaaaaatatgtatgtgtgtgtgtgtgtgtttacaaattaaagaaacaggtataatttcatttatccatagatcacgtctttggcattacatctgaaatctcatcataaaatatactaatagtgatttttttttccatgtctctaatctcaggccacaatctactcatgagtgtttaaacatcacctacttgattagaggactatcaccctaagatatttggaatatttctggaaggagatgtgttctttttcccattatttctctatttagtcatttattaatatccgtattggtttatgaatgtctatttcatactctgaagtaaatccatgctatattattcattttattgttcaaatcaccacagctttattatgtgcttggaactcatttagtttggatgctgcatccttacagcacacctcatcattttgtttttgaacactttcctgtttcctggtattacaatacattctaagcccattttctatattaactttttcatacatagaatcagacatttttctaaagattgcttctttctgatgttaaaatatagtattaaaataaaatttgtgatactgggtatatgtgttgttaatgtggtataagtacttttaggacctctcaaccaactggcctagtaaatgtgcatgtttatatgaactcatgtttaaggacacattgaaactatttatgtatcttatattctgtaactttattacattaaaaatgagaatacactggtctcctcacccaactatgttaccaccatatcgacctttctaggcttccttgactgtccataatcacccactgcaaagtgaggaaccccatcccatcatatgccattgtattacttagctgcacaatttcaggacacatgcattgcagcatcagaaatgtaaagctgtacccttcttggaaccatttttatctactagaatagagtgcttatgtgcagtttctttacactttaaacttatagaatttcctcattttcaaagttccttagatcagcaacttcgttttccactttcttcatgaagtcatttcaattacactgtataatttctttatttgaattctgtaaaagccaaaactacagtcaagtaaacatagagaggatattccaggaatttacagagtgggtatcaaataagttaaaaaggcaatgtttaagaagagtaaaactatttttagtgatatgcaatggttgagacatgacacaattaatttgtctaagctcataattttgtgatgaaaaatataaacctaaatatatacaatttaaaatgatgtttagcagtacattatccctaggatcaaatgcagactgtataaaattatctaataacttatttggtgaggatgccatgagacacatgcaacaaagaatgaactaattttccttatttgcatataagatgttgacattcactaaagatctttaatttaaaaaaaaatcaattttctatgtgacccaggttttttcttccagacaagcaaataacccacaggattattttctttccttgattgagaaagattttccccaaacttcagctcagttcaggcatatactgtccctaaatgggcatttaccctcagatgagtccacacacctgtcaacacgtggagtcttctgtcagacaaacacacctttactgatgtggattcttccctcagacaaaaacacatgtccccacatggacactttcctcagactaccatgtatgtccttacatttacgctttcctcagaaaacagacttttcctcatgtggactcttgtctcagacaagcaaatatgtctccatgtgaactcttcactcagataagtacacatatgtccacatttactgtttccctacacaggcacatatattcaatgttgaattgttttgtggcaaaatgatctcaagataatggtaattataaaccccctccctaataaagtgtagatctgtattttttttgttgtaacctaactttgccttattgtcaaaaacagtaatttgcagctctaaatgcaccagttagagacaggtgtccattttctctggaaatgtatttttattttcttactggacatatttgttgataatgttgctactatgaagatacctgaacagtatccacattaaagaataaaaaagagtaatgggcagaataaccctgtgcatccagacccagaaatcctttgaccctgccctcccgaaatgtagacacagaggatggatgagcagtgctgagcagtgtacccatgaccacaaacatgaagacatggaaatgtgtccccactcctcctcatgaaaggcagctcatgccctcttccttcaggccctggtatggagccaccccatgtctctgcccttccttagtgtccacaccatggggtctgcactgatctggattcccttctcatccccctcaatattagtgtgccttgtgaatcaggtccagctgtggctgttctcagtctgtttcctctgtattcacagaagtcctgtgtgatgtttactgatggagtcagaaggagaaaaatttaacagcccagcagttcactgagactgtcctgcaaagcctctggtttcgggtttactgggtgcagcatgagcttggtccagcacgcttcacaacaggaattggtgtgggtagcaacagtgagagatcatatgggagttctaagggttactctccatgagtacagataaatcaacattcccaagtgacaccctttcaagtgcagtctaccttacaaggaccaacctgaaagccaagggcaaggccgtatattacagtgagggacacaggggagggaagatctgtctgagcccagacacaaaaatctctgcagagagacaggagggaactgcgtggtagatgctgctcagaaccaccatggggtggccaggaaacaaggggtgcttaggacctctagggagcgctcaggacgccaggggggtgctcagaaccactaggggacgctcaggacactaggtggcgctcaagacaacactactgcactcatgtcaccacggggtactcagaaccaccagggggcgctcagaaccaccagagggcgctcagaaccaccaggtggcgctcagcaccaccagggggcgctcaggacaccagggggcgctcagaaacactcggggacgctcaggacaagagggggtactcagaaccaacagggggcgctcaggaccaccaatgggtgctcagaaccacaagggggcgctcaggacataggtggtgctaaagacaacaattctgggctcaggtcaccagggggcgctcagaaccaccaggggacgctcaggacatgcaggttctcttaggaggcagctgcacatcaggagcttcagaggctgtgatttcctttcagaccctggaaattcctgacctggtcaagcaaaagtcttccccaggatgtctgatttttccttttaattccatgatttcttttacctacaaaacactaacttagaacagggatgtaatgcaacttttattgctgcgtattttctgagtaatactagcaatgatctctcgggacaattattaaaataggttatttatatattttaattattaaaaataatactattattaaaatagtaaaattttttaaatcacacttgtaatcccagcacttggggagactgaggcagacagattacttgagctcaggagttttagaacagcctggcaacatggtgagatgctttctatacataaaagaagaaatagctgagattggtgcaaccagctacttaaaaggctgaggagggaggattccttaagcctgggaggttgaggctgcagtgagctatgattgtgcctccacacaccagccttggtgacagagtgagaccctgtcttagaaaaaaaaatgcatatcctcaatacagactatttccatgaatagagttttgtgtttttgtgctgtaatagtcaaacaattgtatatgttttctaactttaactcagcatatgcatggtgttttgtttctttttctttcatctgctgtttgtggaaaataaacagcactttaaaggctctgtttctccactttgtttggcttccagtgtcctgtttttcagactgtttctccaccttcccttcttctttgaaagccatttatcttcctcagtctccatgcagaaaaagaaagtccctttactttctgtcttccaagtctggtgaatcagttcccttcttttcataatcactgaagccaaccaagtttagaagtataacagttctccttagaatacgctcatctacctgcactctctgccctcctcatccttttctaggtccctccagacatcaccctcatcccataccctcccttccttaagtaccacagagtgggctcttcacctcctgctgccctctatgtgctcagccctggggctcactagtcctttgattatgaagtccaaatccctatgtgcttgcacactctcacgccaccctctaggaagctgccattgtgagagagtcctgaaaagcatgggctgggtttagtttcataatgcatattatggtcaattagttattctatttgaacattctatttaattaatagatagagttaattaaatagagttattctatttaattctattaaactattaataaattagttattcaatttattaataacaggccaatatttaaaataaataccattgcacgtttaagtgacatatttgacaataattgcatttacatacagttttaccaaaacatgtatcgaagtgtatttgtttttttaaatattggaataggcagacatacacataggaaaacattattttgtactacaatctcaaactgcaaacacaatttaaatgccattaaataattagaataatatgaaacaaatgggcatggtgttttggtgtttaaatatacattcatttcacctgatcatacttatgtgtctttgctgggctgctgtgcatgtatgtgtatttgtatgaccatgaagctttcagatacatcattaaattacataaagtgttaccatgcacttccctcttttaggggacaaagtaaatctttcagggcaatcgcagggaaaatgtgtggttggatcttccacacagagtccctaccatgacattgccaagtagagctatggaagggggctaccaacctccagaccccagaatggtagatccacaggcagcttgcagctcgagtctggaaaagccacaggcacccagctccaacccatgagagcagccttatgggctgcattagggaagtcacaaaggtagggctgcccaaggccttgggcacccacccttgcaccaggtcacaagacatggagtcaatgattattttagagccttaagattgaaggactgtccgactaggttttggccttccataaaaatctttacccaatttttgggccattttctctttttagcataggactcctcacccaatttctgacccatcattgtactttggatgtaaataacttatttttgatttttcagtctcataggtgaaaggaacttttccttgagtctgaactttggattttgaattaatgccaaaacaagttcagattgtcagggaccactggggagggattattgtatattgcaatgtaagaaagacataaggggcagaatgatgtggtctggatgtgtgttttctccaaatcttatgttgaactgtgaaccccagtgttggaggtgaagtctgctgggaggcatggcattaggggcatatccctcatgagttacttcgtgtcatccccttggtgatgaatgagttatcagttcacatgacagctgattgaaagagcctggtaccactcccttctcttatcttcccccctattgtcatgtgacactcttgctccccttcatcttctgccttgactgtaagctttctgaggcactcagcagaaacagatgtcagcaccacacttgctgtacagcctgcacaactgtgagccatataaaacctatgtcctttataaattatccagcctcaggtatttctttacaattcaataatggacgaacagaagaagtatttaattgtgcagcaaattaggggtgtggaatcattaaaatggacttaacgcctgtagaggtaaagacacaagagtctctctctctctctctctctctctccttgaacccttctctgtctttacatacacacacacacacacacacacacacacacacacacacacacacgctccacgtgaagatgtcatgtgaccaaatagcaatatggtggctgctatgagccaacagtagaagcctcaaaataaaacctatcttgccagcatgtttatctttgaatttccagaattgaggaactgagataaaattaaggttgtgtaagttaccaagtatgattgtttttaatgtttgaactgactaaagagaatttgggatgaagaagtggggttctgatgttacaattatttcaacactgtggaaagtgccttggaattgggttatgtgtaaaaggctggatagttttgacatgcataaagaaatttatatattaagtgtcattctgatagattaaaatgagtagagtgctattggaaactggataaatggtgatctttgttataaagtgacaaaaaaaacttgtctagactatgttgtgatatttagtaaaagagaactttgagcagcaaaattgaatatttagctgagaacacttctaagtaaaatgttgaaagtgtagtttggtttctcctgggcatttataataagaaatagatgaattgaaaatgaaattataagggagaaaatatccaaaacttaaaggcttggaaaattctcaatctatctgtgttgcaaaaatcagaaagtgcgttctgaagagaacagtgagtatgaggctgtaatatcacttgataaagaatttatggtattaaaagagaataaatgcaggttttaaagaacaaggatggagatgagacaaaatggacgaatactgtcagattcttcagatttaagaggatggagctacttggttgcaaatgtgcaccattcttccagaacaaagaaaaataaaccttgaatttatttagaagtaatcatgaccactaccttggtttcaacagaccagaccatccatgcttaaaaccttgaggaaaagacctcctaccactgcctggaacttaggaactcccagtgagccttgtgtgtagggctgcatggggtctttgggatgggaccttaacccagcagttacccattggtgcctctacttaaagcattggaattaattctgctgctgcaatgagctgggaaagaagaagcttggcccagagaagattccacttgagccttaaggtctatggtaatttgttttgttatgtgttgtacttgctggggacacatcacccctcctttcttttctatttttctctttgggggagaaaatgtctattttatgcctaactcaccactgtattttgaaatcaaataacttgtccagcgctatggactgaatgtgtatgcaactccaaaattaatattgtggaaccctaatccccagtgtggtgtaattggggtgtgggccatttaaggggtgatcaggtgaaaaggttgaagccgtcataaatgagattagtgctctaataaaaagtcacgggagagcttttctctcttgcttccctgtcatgagatgatacgataaaattacggccatctgcaattcaggaaggaaacctttacatacacatgattggctgtcttgggcttcccagcattcggcactgcacagaataaatatgtcttgttaaagtcatgcactttatgacactttgttaaagcagccccaataaaataagatatctggttttactggctcagagttggagagaaatttgtttcagaaataattctacctcaaatcttactcatgtatggtttagttaatatttaaattatgttttaaacttgtttagagttgatgatgaaatgagttaagagtttggggactgttataatcaaatgaatgaactgcgaatgtgtaaatgccatgcatttgggggatggtcttttctattctgggtctttcatgcctacgtgtgaattgaaggattgcttttcttatttctgtgaagaaggccattattattttgatagataatttatctaatctgtaaataactttgggtagtatgaaaatttcaatactattaattcttccaatccataaatgtggagtatctgggatatatgtcctatttatgtgtgtccatttcattttctattaccaataatttatagttatcctctagaaatctttctcttatttggtaacatttattcctaggtatattttgcagctattgtaaaaggaaaggcttcatggatttcattctcagatgttttgctgtcaacatatagaaatgccaccaattattgtatgtagatgatgaatcttacaactttacttaatttgcttatgaattctaatagtttgtgagaaggctttagttttctttttttaatataagatctttttgtctgctcacaggaaatctgacttccacaattccaaatttgaggtcatttccttttactgttaactaaatactctggctagcatttcagtactattctgaataaaagtgataaaaatggttatttttgtcttcttccacttcttagatgaaaatttcccggtttttccatgcttcgtgtgatgaaagctgtgtttttctcatatatgcgctttattttttgagatatccttcttgtatacctaatttttgataatttctatcagaaatgaatgttgaattttattctatgattttctaaaatatcttgactacacaataacacagtaatatgcaggtcaatacatatcaactgaatttcacttaatatcatcccaacttctaatatttattttttagtattagaacatgcctgtttccatattatatttgctcacaggtattggtacatattttagctaatttgtcattattttactctaagaaataactcaaaaaatcatttttattatgaattgaaaggtaacatcggcaaaattagcccaatcttaatctttcccagactttgaaacattattgaagacaatgagaggggaaagtcagctttagttgagcttctaagaggtaagtgaggtaaaaacccagggcttattggctacgactttgaatgttactgtcttcttttccataagccacatccagaccattttctaaatctaagaaaactaattttatctcactgcttcttagtcttgtttcctgcagctgacaaccaaaactgtcagcgatagagcccagtgtaaatcaccagcctttaattattgcagaactatgattttacaacaacattgtgagttacataatgatcctactttatggccgcggtgcaaatgcttaacttccactaaatcacagagctcagaatggctagcatggaggtgtatatgtatatgtgcattgttctagaaatttccaattactgtatattattgtttgcagtaattaggtcaatctgaactgacaaaagtctccatggccttataagcacagagaccacctccacggcaggtggaaatcaaggctgggaacagtctaccagctgctcccctgggattcctccaattaccctgtttaaagcctctgctcactcatgcgctggaagagggatgtcagagatgcagtctactcttcctaaagggctgacagggcataaagacaagactgattatccatggaacattcctataggaatgcacctatgtgcagacacactaataagctgtgtgtcttgcagtgtgtaaatggctgagatgccatttacacttctttacacaatacatttttaaatgttttgttgatgtattctctatcattcaaaaaaatcatcactttccccctaaacaaagaggatttttatcagaacacttatgggaagccccttgctctcccagattcccaccctcatttctcctgaaggaagaaagaaaaccatctctattgatttccactctcatcctctaggactaaaaccagaaagctgcatgctccctgggtgagccttagagaagaccctgtctgtaggagcaggaatctcagagccttggctgagaggcatggtcctgaaatgagatggagtcccccatggagatcccacgtggacgcccacacctgagggctcactgctcctcaccacagatgcactcccctactgagtcctgagacctgagtgcaccccatagagtaggactcagatgagggaatgcaaatctccaccagctccaccctcctctgggttcaaaagctgagcacggggcctcgctcagtgactcctgtgccccaccatggacacactttgctacacactcctgctgctgaccaccccttcctgtgagtgctgtggtcagggacttcctcagaagtgaaacatcagttgtctcctttgtgggcttcatcttcttatgtcttctccacaggggtcttgtcccaggtcaccttgaaggagtctggtcctgtgctggtgaaacccacagagaccctcacgctgacctgcaccgtctctgggttctcactcagcaatgctagaatgggtgtgagctggatccgtcagcccccagggaaggccctggagtggcttgcacacattttttcgaatgacgaaaaatcctacagcacatctctgaagagcaggctcaccatctccaaggacacctccaaaagccaggtggtccttaccatgaccaacatggaccctgtggacacagccacatattactgtgcacggataccacagagacacagcccaggatgcctcctgtacaagaacctagctgcatctcagtggtgctccctccctacctctgcagaacaggaaagtgtgactgagatgccatttcctgccagggcttgtgtttcctataccaaccagactcagagccctgtctgttttcctattctgtactattaaatggcatgttccctgttagtgattcacgcaagcagaggctgtatcctgtttgacaaagattgagcatgaaagattcccattacctgggccacatgcatcactgatatgtggccacttatttcttgagctcatatccttccaaggggctgaatacaaatatctataacataggccatcttaaactgcaggaagtaatgttggagaagaatgtggagataaaagagcaggatgattaattaaaatccagataccatctttttttgcagagaaaaatttacactaataaagtaattttatgaaacaacaagaaagatggaatgtgtcctcatcatggagtgtctcacttgcagtgcacaaataaatttctaaaaattttatagggaagatgtgatagatgaggctgatttccacacagggagtgattaaatacccaggtaagtataaaatccaacacttggaaaggaaaatgcctcagcttgacatcagaaacccagctcagtaagtctgaggagcaatgcggaaaagaaatgaaaaattcgacaacacttttcttatgaaatccctagctcatgtttgaacacgaaaacagaattgtccacaattttaggacagccatcgcatgacaacaaaccactacaatgataggagcatcactgagtcaacggagttcaagcagtgagcagatcagtactgaggccccaggagaaccaaggctctttggtacattttacagaacccagaaccgagccacataatctatggccaagtgatctttgacaaagttaacaaaaattaaccaacgtatacaccagggaaaggacaccccattcaataaagggtgctggggatattggatagctatatgcacgcgaatgaaactggacccccaccctcaacatgtaaataattaacacaaaatagattaaaggtttaaatgtaagtcttcaaactgtaaatgtattcaaataaaacaccaggacaactcttctggacaaaaagcaaacaatagacaaatgggacttaatgaatctaacaagtttcttcacagcaacagagtgaacagacaaagtgcagaatgatagaaaatatttgcacactgtgcatctgacagagtactaatatacagaattaacaagaaactcaaaccacaacaacaaaagaaaacaagaaccaaataaccccattaaaatgagcaaagaacatgagtagacatttttgcaaataacacataaaaatggacaatagatatataaaaatgctcagcattactaataatcagggaaatgcaaattaaaactagtgagatataccattcacaatggctgttattaaaaagtcaaaaataacagatgttggagaggatgaaatgtaaagggaactcttagacactgttgatgagaatgtggacgagtacgacctctatagagaacagtatggattcagtatgatattgactgtgcatttgtcataaacagctcttattattttgagatacattccatcaatacatagtttaatgagagtttttagtattaaggggtgttgaattttattgaaggcctttgctgcatctattgagataatcatgtgttttttttccattggttctgtttatgtgatggattatgtttattgatttgcatatgttgaaccagccttgcatcccaggtatgaagccaacttgatcatggtggatttgaaaaccggcacaagacaaggatgtcctgtctcatcactcccattcaacatagtattggaagttctggccaaggaaatcaggcaagagaaataaataaagggtattcaaatagaaaaagaggaagtcaaactgtctctgtttgcagatgacatgattatatatttagaaaaccccatcatctcagccccaaatctccttaagctgataagcaacttcagcaaagtctaaggatacaaaatcaatgtggaaaaatcacaaacattcctatataccaataatagaaaaacagagagccaaatcatgactgaactctcattcacaattgctacaaagagaataaaatacctaggaatacaacttacaaaggatgtgaaggacctcttcaagagaactgcaaaccactgcccaaggaaataagagagggcacaaacaaatggaaaaacattccatgttcatggataggaagaatcaatatcgtgaaaatggccatactgcccaaagtaatttatagattcaatgctatccacatcaagctaccattgactttcttcacagaattagaaaaaaactactttaaatttcatatggaaccaaaaaagagcccatatagcctagacaatcctaaggaaaaagaacaaagctggaggcatcacgctacctgacttcaaactatactacaaggctacagtaaccaaaacagcatggtactggtaccaaaacagagatacagaccaatggaacacaacagaggtcccagaaataatgccacacatctacacccatctgacctttgaaaaacctgacagaaacaagcaatgtggaaaatgatcccctatttaataaatggtgttgagaaaactagctagccatattcagaaaactgaaactggatcccttccttacaccttatacaaaaattaactcatgatggattaaagacttaaacatgagacctaaaaccataaaaacccaagaagaaaacctaggcaataccattcagtacataggcatgggcaaggccttaatgactaaaacaccgaaagcaatggcaacaaaagtcaaaattgacaaatgggatctaagtaaactaaagagcttctgcacagcaaaagaaactatcatcagagtgaatgggcagcctacagaatgggagaaattgtttgcaatctatccatctgacaaagggccaatatctagaatctgcaaggaacttaaacaagcttacaataaaaaaaaaacaaccccatcaaaaattggcggaaggttatgaacatacacttctcaaaagaagatatttattcagccaacaaacataaaataaagttcaacagcattggtcgttcgagaaatgcaaatcaaaaccacaaagagataccacctcacaccagttagaatggcgatgattaaaaagtcaggaaacaaaagctgctggagaggatgtaaagaaataggaacgtttttacactgtggtcggtagtgtaaattacttcaaccattgtggaagacagtgtggtgattcttcaaggatatagaactagaaatgccatttgtcccagcaatcccattatttggtatatacccaaaggattataaatcattctgctataaagacacatgcacacatatttttattgcagcactgttgacaataacaaagacttggaaccaacccaaatgcccatcaaagatagactggataaagaaaatgtggcacatatacaccatggaatactatgcagccataaaaaggatgagttcatgtgctttgcatggacatgggtgaagctggaaaccatcattctcagcaaactatcacaagaacataaaaccaaacaccgcatgttctcactcataagtgggagttgaacaatgagaacacaaggacacagggaggggaacaaacatcacacaacagagcctgtcggggagtggggggctggaggggatagcattaggagaaatacctattgtagatgatgggttggtgggtgcagcaaaccactatggcctatgtatacctatgtgacaaacctgcacattctgcacatgtatcccagaacttaaagtatagttaaaaaaaaagagagagagagagaaaggaaacagtatggagactttccaaaaaatgagaaacagtactggcctttattctaccaatcccactactgggtagctacccaaagagaaagaaatcatatttcaaaaagatacccacacttctatgtgtaccacaaatctattcccaatagcacatatgacaacctgagtgtccaccaacagatgattttataaaagaatatagcatatatgcacaatttaatactagtcagccacaataaggaatgaaactgtgtcttttgcagcaagatgcctagaactgggggacattataattagtgaactaactcacaaacagaaagccacatatcacacattattacttataagtgggaggaaaacagtgtgtacacaaggatatggagagagggattatggacattggagacttagcagaatgggagggtaggagttgggagcatgatgaaaaatcacctaatgggtacaatgtacgttacttgggtgttgggtacactaaagccaataccactgtgtaatatttccatgtaacacagttgcacccatagcccttaaatttatacaaataaagataaaaacaattacaatttaaaatataaaattattaatagttgaccaaagatcttgaaaattaaaatttaaatcatgatcaataaatgaaattaatatcagttgaacttcatttaacttaaaatccttttgtactcaagtgattttaagaaaatgaatgtcaagttttagatgaggagatttgcaaatcatatcaccacctatgtaattatagtaagaaccctcaaaactcaacagtgaataaaagaagaggcaacccatggataaaataggcaaaggtttgtgcaggcatttcattaaagaagatgtacagattacacataggcatataaacaggatctcaacaggatttttcatcacagaaattcaaatcaagaccacaataagatacccaaacaccctttttagaatggctgaaattaagaagaaagatggatcataccgatgctggtgagcataccaggtttctagagtctaaaacattgctaatgggaatgcaaaatgaaacagctacacaggaaaataattcttagtttcttgtaaaattatatatgcccttaacacattacctaaaaatccccctcctgtaatacagtaatacatggctgtgtattactgtgaaagaggcatagtgtgaaaacccacatcttgaaaccctgagggagaaggcagctatgctgtggctgaggagattacagggattatttgattaaagacttttttagaaagtgaggttaaatcagccgggcgtggtggttcacacctgcaatcccatcactttgggaggccgaggtgggtggatcacgaagtcaggaatttgagaccagtctggccaacatggttaaactccatctctactaaaagtgcaaaaaattagccgggtgtggcggtgtacacctgtaatcccagctactctgggcgctgagacaggagaatctcatgaatcggggaggctgaggttgcagtgagccgaaatcgacccactgcaccccagcttgggtgacagtgcaagactccgtctcaaaaaaacaacaacaacaacaaaaagcgaggttaagtcattgaaaaataggaaaatataaatgtgtatgcactctaattatttgggaaattttccatacaacttgtattctgtaaacaaaattcagggagtggaaaacaaatcaaattaataaaactgatataagaattcctctgaagatattagtgtgagcactaacacacacttttgaatgggtgttgtaaatattttggaacacacctcttaggtcacattttaattctacatttatgtaaattatataaaatatcgaaattttttaatgtctccattttgtgcagttataattttggtttcatgccagcaatgcatgatagattccgttcttccacatcctcgttgccatttggcactataagcattgtgtattttaaccattctaatctattggtggtgatagctcattgttgtttaaatgcacatgtctctaaaattttatatttaattattttatataattgtgatgaagtgtttgttatggtatttggctcatttttgatagcattgtttatttttgatcagttgtaagtttctttacatacccattatataagtcacttaaaaaagtacttagctggtcatgaaccccaggatgagatgcagactgtatagaaatctctagcaatgttactcagtgtgggcagggatggcatgagatacggggaataaagaataaagtaactttctccatttggatataagatgtgtccattcactagagagttttctttcagaaggttcccatgtgagccagtttccttcctgacaaggaaatcacccagaggattctcataatctcttaagtgagaaaagttttcctcaaactccagctcagtctagctcacactgtctctaaatgggcaattactttcagacatgtacacacatctgtcccaacgtggactcctccctcagacaagcacacacattgcaatgtggactctcccctcagaaaaccacacatgccccacaatgactccttcttcacataagcatatatgcctgatgctgaactgctgtgtagcaaaattagctcagaatacaagcacttatggactctagccataacaatgtgtagatctgcattttattttaaattctaaatgaacattttgccttcttgttaagaacagtggtttacagctctacatgtagagactacaggcagatatatgtttcctctgggaaaagtttattttcatgtatttactgggttattttgttgataaacattcatctataaagacacctgaaaagtgccctcattagagaaaaagaaagtgtagtttgcagattaactctgagcatccaatcccaggaatcctttgatctgccctccctgaaatccacaggcagaggggggatgatcgctgataagtagcaaacacatgtccacaggaagggagacatggaaatgtggtcactcccacactcaagaggagcagctcatcccctgtccgtagtggtcctggtgaggagccaccccacacctgtgccttcctcagtatccacaccatggggtctgtgctgatctgggcttcccttctcatcactctcaatattagtgtccttgcggatcaggctcagctgtggctgctccagatgaggctgttctcagtctgttccctctgtgtttgcagaagtcctgtgtgaagttcaccgggggagacagaggaaataacggtgcagccgggggctatctgagtctctcctgcaaagactctggattcaccttcactgattgcagcataagcttggtccagcaagctccaggaccagggttgatgtgggcagcaacagggagaaattgaagaggaagctctcagtggtgccctccatgaatacaaagaatcttcacagtccccaggacacccttacgtgcatggtctcactgatatctttacttcttttatcacttttgttatgtaaatcacaatgaatagtgtattcctcatctattatacatttgttaagtcttttttggtgtctttaaaaaaactgataactttatagtatgtaatatccttaagtcctgaaagtgttttttgatgtctaccttgtcttaaatttatacagctactatagcttttcttggttcatgttttctcatatttatcttttctatttgtgaatatgtagagaaactttcttgtacatagctaatagttgtgtattgcttttttattttggcagtccttaaatattctaattttttatgatactttaagttttagggtacatgtgcacaacatgcaggtttaaacaaacaacctcatcaaaaagtgggcaaaggatatgaacagacacttctcaaaagaagacatttatgcagccaaaaaacacatgaagaaatgctcatcatcattggccatcagagaaatgcaaatcaaaaccacaatgagatatcatctcacaacagttagaatgacgatcattaaaaagtcaggaaacaacaggtgctggagaggatgtggagaaataagaacacttttacactgttggtgggactgtaaactagttcaaccattgcggaagtcagtgtggcgattcctcaggtatctagaactagaaataccatttgacccagccatcccattactgggtatatacccaaaggattataaatcatgctgctataaagacacatgcacacgtatgtttatagcagcactattcacaatagcaaagacttggaaccaacctaaatgtccagcaacgatagactggattaagaaaatttggcacatatacaccatggaatactatgcagctataaaaaatgatgagttcctgtcctttgtagggacatggatgaaactatctattgcttttttaaatcaactataataaattctattttttttttttgagaaggagtctcgctctgtcgcccaggctggagtgcagtggtgcgatcagggctcactgcaagctctgcctcctgggtttatgccattctgctgcctcagcctcccgagtagctgggactgcaggcacccaccaccacgcctggctagttttttgtatttttagtagagatggggtttcaccgtgttagtgaggatgctctcaatctcctgaccttgtgatccacctgcctcagcctcccaaagtgctgggattacaggcatgagcaataaattctatttttaaaccaacaatatttttttccgttaatttttgtttaaattaacattttgtaatgatgcttatttctctattaacatggtatttaattacctttttataaatattgtatagttaccataagatttacaataaaaattgtatgtaattagattctaatgtaaatcctgtgatggccttgatatgaagaacacagatagtgtaactgtgtgctttgaattcctccttctcgccactctttcttgtttattctgtttgcacttacatatgctgtaaaatagaatatgtaattttttattactttatacagttatatcttatagcaattacaaatgttaaagagtacaattcatctagatttttccatttttacaatctttatttctttgtagagatttctattttgagtgcatatcacatggctactcgcagagaatctttgtaaaatgtgccctgaaacatgaatgtgctgacaacacatattctccagatctttttttctgacagaattttatttgccattcacctttaatgaaattttaatgcatgtagaatttcagtttgcatttcacctgtaatttattttcttgtaattattattagtttttcctggagatgatcacacattacattctgctgggcctttattaaccatgtttctgcgaacctagtcaggcttgggtttcaagtgtatggttgccgtggctatcagagttgaaatcagcttctcctgttcacaaaaacttcaggttcctctggtgatacctgcgtttgtgtccctgtttggctttggatcttcacatttcattctccccaaagaaaggctgtctctttcagctgtggcaggtgcatcctgctgacacatttacttggtgactttttgtgggatgaaggggcttggacacaggggcacgttttccaaccttctggctgagcctccttcttagctatgggtggtgagactggctctgatgcatgatcttccaagtgttcctgttccttcccttcctcagtgtcacagtgtctcttcccagtcatgctgttttttcatcagtgtcctcagcttctgacccactgtccttaccccacagattctggatttcattcctcaggaaacagacgggaggtgattctgggtagagtttccctgatgtcctctgtttccttgtgttctagttgattctaccagtgcccacaggacacaagatttaataaatgtctcctgcatataatgaagggggattcagcattgaacggagctactgttcttcctccccagtcaacaccacaggacagcaggtgggtgagttgtctggggatttccccaattctgtaggaaaagcctgcaagtgccaggagtttcacactctcacaccattagcacacacgtcttcaagcaactcattaaacatttccaggttagctttttcctatcttcaataccatgccatgagtggcacctgccccaggtactctaataaacgcaccctagttctctctgcgggcccctattttctcatatttcagggatttttttctctgtgacatcaactcagatatggtgaggggtttattttttgtaattcttcatgttttttgttaacgaggtcagaataatatcattttctcaatttttacattctaacgcttagtatctgatttctaaataaaattcagaaactaagacaacaaatgaagtatccattatttggtgcattgttaaacaatttgagaaatattcatgtactgaaatagaatgaaccactgaaatcaaggcatgcctcattcacataagaacatgagggcattatcaaataattttgctgagtggaggaagctaaagaattcaccatcaatttcatgtgatttcatttgtataaatcacagaagatgcaatattctaaattaacatagagaagatctgaatttctctgaaaatagggtgggcagagtaacaacgtggtgaaataaaattatagacaagttagataaaaaaattagaggttaacttaattgctaaaacatgattgaagtgctgattcaatgactgcacacatatatcaacattttccaaatgcttcactatcaatttgatttcattattgattgtttttttaataaagcagtaataaaaatgaatatattggctgagaaagagcaagaaatggataaataccgacacttgaataatcaaggactcctgaaaatacacacatgtgaacactgattgtagatttcaggtaaacactagaaaaggcaaaattacacaaagttgttatgacaggagggacatcctgaaaacctctctaggcatgtcccacaccaccctggagctgtctcaggggagcagtctcctccagtgtttagaggcacaggcacgcataatagggctaactctggccagatgtgtgatattggacacattgcacaactgctctgttctgtatgtaatttatcttctctacaaatgtaacattgacagttgcattaaatatattctgcaaatatgtaaaagttaaataagctgatgtctgctaaatgattaccaaggcacaatcacataatctgaagttatattttccagagtgataggattacctccagagttttccaggacactctcatctgctccgggcactgccttctcctcagccgtcccacccctgagcttgctatatagtaggagacatggaaatagggcccactctctgctgataaaaaccagcccaaccccgaccctgcagctctgggagaggagcccagcccccgaattcccaggtgttttcatctggtgatcagcaccgaacacagaggactcaccatggagtttgtgctgagctgggttttccttgttgctattttaaaacgtgatctatagagaactagagatattgagtatgaatggatatgagtgagaaacagtggatacgtgtggcagtttctgaccggggtgtctctgtgtttgcaggtatccagtgtgagatgcagctggtggagtctgggggaggcttggcaaagcctgcgtggtccccgagactctcctgtgcagcctctcaattcaccttcagtagctactacatgaactgtgtccgccaggctccagggaatgggctggagttggtttgacaagttaatcctaatgggggtagcacatacctcatagactccggtaaggaccgattcaatacctccagagataacgccaagaacacacttcatctgcaaatgaacagcctgaaaaccgaggacacggccctctattagtgtaccagagacacagtgaggggaggtcagtgtgagcccagacacaaacctccctgcagggccatgcgggtggtttcctttctcagctgcaggaggcgggcttattgttgcaggactctggagacttattaggttgtgatattttactatggttatttatcatgaacttttttattgggaattgtgttttattaatttttattttatatgtaaggttatttttttaaaatacataccttcaagaaataattcttcctaataatttgcacttgttctttttagagttttgttaacatctgttgatatcagctactacatagctatagggacattaatttacatctatagacatatgtgtaaatacacaaacttatacatatatgtggtcttttatatttaatgttataataaaattattataacaattataaaatacatcctaaagaatgaaacatatatagtaatccatattcctttcaatcattgcctatagtttacataaattgatgtctatttgtaaccttaaacatagtgtattggtcattttcaaacatccaagaacaaatttcaaatgtccttgtcacacacacaaaaataaaaatttgaggatttgaggtgatatatatgtcaatcagctcgattcaattattccatattgcattcataaatcataacatagctttattcactataaatacatacaaccaaaatttctcaattttcaatgaaattttaattatacatattttatctgtcctaggtcatgaatgtttttctccctgtccggatgtgattagattgtcctgagaaacaaattcagcttcctgcctcctgaaggcttcaggaagcagctcctagatggggtgaagcaggcaacccgtgtgtgtccacaggacccggagcctctctctccttggattaggccccctcctcaggattacagggctcttcagttttctcaacatgctgttataccagagaagcacaaaacacttaatttcattatatttttcttcaatttttcaaaacaacacaaaggtaataattttaacaataaacatattacaacctactatacatgagacccttcctgtgcttcgaggtttcttctcaggactttgtatgtattacatgttttcagtttttttctgagatggaatgttgacgtctccttattacagattattcttttaatttgtctcttagaataattttttccagagctcctgcccgcccgcgcctggcggaatggagcggcgccagggctgagccaggcgcgcaggggccgccgcacgtgccgcgcggggagcggatgcccagcgggcggagagccagcgccagaggccgggtcggagcggccgctggagcagcgtcagaatgggagaacagcccatcttcaccccccgagcgcgggtcttccagattgaccccaacaccaagaagaactggatgcctgcgagcaacaggcggtcaccatttcctgtttctatgatgtcacaaggaacagctatgggatcatcagtgtggacagcgccaaggtgaccataaacaacacaattacacagaatatgaccttcaccaacacgtcacagacgtctgggcagtgggccgacagcagagccaacacggtgtttggtttggggttttcctctgagcagcagctgacaaagtttgcagagaaattccaggaggtggaagaagcggccaagacagccaaagacaagacccaggagaacatggagccctcgagtaatcatcctgagaatcagggcgtggagccccatcttctactccggcatccagtgtcaacgggacggacgatgaaaggcctctcaggccgctgcagccgacacgcacctgcagtctgggaaccacaagctgaaggcggcctcgacgcagagctgcccacgggaagaggtgggagatggagctgcagacccggcgggagaccgacttccggctgcccacggcgctgcaggagtcgacggccagtgcggagcagaggaagaggccgtgagtcagagtgcgactgtgtctctgagaagatggaggcggcagagagaggatcaaaacctggaagataaagtgcgttccctaaagataggccctgaggagagcaaatcccgacagcgccacctggaggcgcttcctggtggcgctggaccggaagatccaggcctgcataacttccgcccaggcctcccaggctgggcaccaacaactagggctggcagaggcccgggatccccaacgtgagtcctaagtatgtgtgcgagaccagatggcgctaggacgttccctgtgtgcgttgcttctgtaaatgcaggcgccgtgtgtcgtgtttccaaaccagttgtgccatccactcactcctttccagaatagaaatctctcgcttctctggccttgtgaggttgtggacaactggaagattctgactgaggaaaccagaaccaggtctaccttcaacatttacgcagtcaggccagggatgtttatatcgttcataagggttgttggaaccatatgaactgaaaaaaagcattttctcatccaaatattgatattctttacaccaggccatcgggctccttttatccgatagcattcagagtatttgaaggtcctccaggtgccagccttgggggcacagggagaacaacattcctctccgaaaacatggggaagctttaaaataactgtttagtggagacttgcccagagatggaaaacaggtttctggtgagtacattttctggtttgggaatcacctgcatccccgatcctgccccgtgccccccagtttgtatggttgtgacaatgttccatttctttgttttaatttctgagcagttgactgtggtgcgggaacagcacacagtgagggtgcctagcacaatgcctggcgcaaagtaggtgctttataaatatttgttcaattaaaaaaaaagagggaggctgaggcaggagaatcacttgaagctgggaggcggaggttgtggtgagccgagatggcgccacttcactccagcctggcaacagagcaagactccatttcaaaaaaataaaataaaataaataaaataaataaataaaataaaaaatattttttccaagccccactcaaaaccatggtattgttagaggtgtaatagttggaccaacattgaaaatacattccatttagttcatgggcgtgcaaatatccttttttctttaaaaattgttctcagttgtaatattacaaaaaatattggtaatttataccaatgacacaggttaaaatgttgtataaataatttaatgacgtttgattggaaaaaatacatgtgccacatgtcgacaattttttccttctctatgaaatatatactcattaataagtttcagatgttacagttatctttttgatttctgggatttaattttagtaggtatacttgaatgcattttattaattcctataatgatgttgatatttcatgtaggattttaatactaattttactatttactgaattttaaactattctacatgttttatttatataagaaaaaaattacatatgagaaaaaatgcgtagacctgaaatgtatcactagagagtttctgtcaaatgtgaatacctttgttcccaacacctaaggtagcctgaagagcaagtccttccccacaacatgcgtctttttctgtgcttgcggtcagctcctgcatggggaaatgttttgatttctgacactatagatccattttttttctgttttgaactttatataaatgcaatcaaacattttagaccttaatttggtaatgggctacattgctattttttgaggttatttcctgctatttaaggtattaaattagatcaacatattatcatttattcaagtaatggactgactctgatatgaaacctcaaagttttcacatatatatggagagagagagagagagagagagatgagggagagaggttttatatctgagtcagtctgttaaataagtaaatgacagtattttgatttattttcctgtaaatcgactttaaatttgtttccagtttatgaatattataaacaaagctgttacaaatgtcttagtgtaagttttcctatgttgtcttccttttattgagaaaatatgaagtatgtatttattataagcttaaattttttcagttttattgaggtataattgaaatattttaataatgtatagctttaaggtgccccacttgacgttttgatgttgtattagtccattctcacggtgctataaaaaatgcctgagactgagggatttgagaaaaaaagtgtgtttaattggctcacggttctgcaggctgtacaggaagtgtagtggcttctccttctggggagagtcaggaaagttaggatcatggcagaagacaaaggggagcaggtgcgtcacatggccagaccaggagccacaggaagcagggaaggtctacacactgttaggcaactagatcttatgagaactcacacactgtcatgagaacagcaccaggagtttgttctaaaccattcatgaaagacccaccccatgtcccagtcatctcccaccaggtcccaccttcacaattgaggattataatacaacatgagatttggggcaggacacagatccaaaccacatcagatacacattgtgaaatgctcatcatggccaaggtaatttgtatatccattttctcatggagctaccattttatttttttaaaatgtactacatgtgtgtgtatgtgtgtgtgtctcatgagaacacctacgatctacccgttcagcaaaaatcacatttacaatacagcattaaatacaagaacattgcagtacattagatctgcagaactcattcaccctgcacaactggacctctacccttcgaccgacatcatctgatttccctctcctcacaggcctgggacccactattctactctctgctttcaagagcttgaatattttagatcccacatgtaaatgagatcattaagtctttctgcatctggcttattccactaagcatcatgtcctctagccccatccctgttgttgcaaatgtcagaatttccttcttttcaaagcctaataaaattcagttttctgtgtacacattttctttacacattcatcaatctgtggtcattaaattattttacaaatctacactattataaataatcttgcagtgaacatgtgtttgacataataattttatttcttttgaatatatgacaagaagtgggatcaccagagcatatgatagctttatttttcaatataatgaataaccaaacctaccacaccatgcttttgaagtcttagtcatattttatttgcctaggccaatgtcccgaaaaatttctcctacattttcttcagtttgtacatttaaatattgaatccatattcaattaatttttgtctatggtgaaaaactagaagtctagttttattcttctatgtgtggctgtctaagtttttcagcaccacttactgaatagagggttgtttctccattgcatatttttgtcagttttgtcaaagaacaggtggttgtagaaacttgtctttatttcttggctgtctattcttttacattattattattgttattgtttttagtagcagtaccatgctgtctttcttactgtatctgtgtagtataatttgaaatcagggaatgtggtgctttcagctttggtctttttccttgggatttcttttgctattcaggctgttttttgattccatatatatttaaggattttttttaaaacatgtaatcaattatattggttacttgataaaaattgcattgaatatgtatcttgctttggacagtgtattagtctactgtgcattgctataaattaatgcctgaggccaagtgatttacaaagaaaagaggcttatttggcttacagttttggaggctgtgtgagaagcatggcaccagcatctgcttcttgtgagggcctcaggaagcttacggtcatggtggaaggcaaaggggaagcaggcggtgtcctgtggtgagagggggcacagaagaggggaggagggtcgctagactgtttttaacaatcagatttcaaattagctaataaagaaataattcactaattaccatggggttgataccaagccatacctgaaggatcttttccccacaatccaaaaactcctactaggacccacctcaaatattttggatcacatttcaccatgagatttggaagggacaatcacctaaactgtagcatttcactcttgtgtcccctggtctcaaatccttgtaagattgcaaaatcatctttttttaaaatagttcccaaaagtgttaacttgatcaacctccaactgaaaattacaaagtctcgccagggtcttaaggcaatttccctccagctgcgtgctggcaaaatgttttaaagagttatgtacttccaaggtgcaatattgccattgggtaaatattgtcaatacaaaaggaataaattggccaaaggccccacacacacctaaagcctagcaggacagatattaaatcttaaagctacaaaataatctatcttgactttatgttcttagtcagggtacaccaggacaaagtgggtcccaaaatcctcaggcatctcatccttatggctgggcacattccatggggctaataacacaggccagagtcaagtgccagaagtagttccaggttgggagtacaagctgcctttggatctaccattctgggatcttgagggttgtggctgcatttctgtagctccactatgaagtgccctagtggggactctgaatggggttccaaccccatctttccccatctttggtactgccttcgtagaggttgtttgtggtggatccagtcctgtagcaagcttcctcctgggcacatagggttctctacacatcttctgaaatctaggtagaaactgcccagcctccttcactcttgcattctgcatatctgccagaatccagttatcccagcaccatttactgaacacagaggtttttttccacattgtttgtttttgtcagccttatgaagtatcagacggtttaggtgtgcagctttatttctgtttcctattttgttccgtttcttctgcatatctgctcttgtaccagtaccaagctgtttttgttaccatgtcattatggtgtagcttaaagttgggtatcatgatgcctctggcgttgttctttttgcttagcattgctttggctattcagggtcttttttggttccatacaaattttagaatagattattttttctaattctgtgatcaatgatgttgatagttttatgtaaatagtactgaatctgtaaattgctttagacagtatgataatttttacaatattccttcttctaatccataagcatgaaatgttttcccatttatttgtgtcatgtatgatttatttatttatttatgctgtgttttgtagttctccttgtagagatctttcaccttgtttgttacctgtatttccaggcatttcatttgtgtgtgtgtgaatattgtaagtgggataagactgtgttcttgatttcactctcagcttggacatagttgggtatagaaatgttagtgattcttgtacattaagtttgtatcctgagactctaccaaagttgtttatctattttagaattattttggcagagtctttagaattttctatgtgtagaattatatcatcagtttggacagatatatctacttcttttcccatttagatgttgtattagtctatttgcacactataaagaaacacctgagactgcataatttataaagatttttaattgtctcatggttctgcaggctgtacaggaagcatggctggggaggcctcaggaacccaacagtcatgacagaaagggaagcatcatgtcttacatggctggagcaggaagagagaggaggtaggtgccaagtacttggaaaccacatctcctgagggctctgtcatgggaacagcacaaaagagggtgaagcatccccatgatctaatcatccctcaccagtccccacctccaacactgggaataacaatttgacatgaaatttgggtggggatgcaaatacaaaccatatcagctccgttttattttttctattgcctggttgctctgactacgatttccagtagtatgctcaataggagtggtgagagagggcatccttgtcttatttcagttctcaaggggtttgagcttttgctcactcagtataatgttgagtgtggttttgtcatagatggctgttattattttgagttttttttttttttttttgagacggagtctcgctctgtcgcctaggctggagtccaatggcacgatctcggctcactgcgacctctgcctttcggggtcaagcgattctcctgcctcagcctcccatgtagctaggattatggttacgggcatgcgccatcacgcccagctaattttttgtatttttagtagagacagggtttcactgcgttagccaggatggtctccatctcctgacctcgtgatccgcccgcctcagcctcccaaagtgctgggattagaggcgtgagcccccgcaccaggctattttgaggtattttttgatgcctagtcttttgagagtttttatgagtgaatgttggatctcatcaaaagctttctcagcatgtattgagaaaatcatatgttttttgcttttattttgcttacatggagaatcacagttactgaattgtggatgttgaatgaaacttgccttccaggggtaaagcctacttgatcatgacgtatcacattttaaagtgcttctggattctatttgttagtattttgttgagaaattttaggtctatgttcaccaagaatattcatctgatgttttcttttttaattatgtatcttcctgattttgtatcccaaggacacacaatgaaggaaggacagtctcccaacaaatgatgtaaaaactggacatccatatgcaaaataaataaaattagaccttctctaacaccatatacaaaaatcaacaaaaataaacataacatgaaaccataaactcatagacaacatggaaaaataattcatgtcattgattcagaaatgatttatttgaagttaatcccaaaagcaagcccagcaaaaaactacatgcaattatatatctgacaagaagttctatcaaaatgtataaataatccatacaactcaatagcaaatatcaaatgacctcataaaaagagcaaaaacctgaatagatttttttcagaagacacatgcatgaaaaacagagcataaaaatgtcctcaagatgactaattgtcagaggaattcgaatcaaaagcacaatgacatatcacctcacaccacttaaaatggctattatcagcaagacaaaagataagaaatgttggcaagaatgatccacagccataaagagagctttgattggccaagagactgatttcagtaactttctcctgtgaagagaccactgaccatggacttgtcctggccaatttccagaggctgtgcactgtgtgtctttctgcccctgcacaaagcccttttgatatgcaggacccaactgtaattcatttagttcttaagtcctcaccccaaagcaaagctgaaatgcatgtatcatgtgtgtttgcttattagacatgagagcctccactccatgtgaatatccatagctccttctatagcctgctgagtgtgtacactcgaccaatccatttgcacaaatttgtttctcatctttccctctcttaaagtgcctgctcacagtctctgtgggaggctttccttcccagcctgttaagatggccatcctgcagcttcaaccctttctgagaaataaagtctcctttctaaatttataaactgggtgattcttccgttgaaagcacaagctgttgggaagagttatatggcaattccataaatgcctggaagacaagtgtggatagggtagggtaagaagtcctgggggctgcacaccccactctgatggaatttccctccagaaacttctgggttctcaagatgagaatccaaacagattccctcatggctctgtcatcaggagaactatactctgataagtatgcccagaacttcctccagacagaccctatagggaaaaaatacttttcaagatctttattctgtgaggggaagggattcttttccatcccagacagcttcatcttagccttcctgagtcatgaaaaggagtataattaataaaacatctggggtcagattcaagaaaataatctgtggatgctgcagccaggagggggagtggaggacggaggaaaatcagctgtaccactgaatactccttgtaaatggtacagcctagagaaagaatagcaagaaatcattggaattcaatttccagaacatatactgctcccctacccaccacatcacctcaccaccaatatgattaatctggattaaagagaaaagtgtggaaaggcacagactccatctaaggactagaatttagggaaaccaaaggcagtgggagagaaaaagtcaaggacagtaaagtgacttaaaacctcttagaccaacagcttcaggaacaaggtcacatcctctccctcactgaaattagatttacctctcatggggcatctgcagggtgcgcaggtgagaactggcaaagagaacatgaaggcactttccaaatctccattagtacctagctcgctttagctgtttggaaaaagcaaaaccacaacaaacataaccaggactaggatcagtgttggaagcacttttcactggcaagacactaagaaggagggcaaattcgaggccagttactatgcaaatatgccactgtgagtgtgtgtggtggtgagctttgagacatagggtctgtgggtaaagttataatcgataaaatcttcaaccacagaatcctaaaaaaaagagccttccccaaagtcccatcagttcctggactcgccatgtgtctggaccgtatcagtggatccggagctccagggaaggggctccctgatggcttttatgattccttgcttgccgtgctgaggtctccctgtagattatgttgggttttctaaggcctattttctattgtaagaggtggtgggggaaacaatttctgtcactgaaagagcattctgagccagggcacagccccttcctactgagcttgagattctgggaggaaaaagttctctgacaggaggaaaaagttcccagacaggaacttccctgcagggcaggagctgagcggcagggggcgctcagggagcacccagcacaggacccagccctggggcaggtgcacaggaggctggggcagggttttctctcaggaattgaatgttccttatttcaaagcaataatgacctaacatttaaataagaatttagcaagtactgatgtgcctgtaagtattttattgtatacgcagcctatacctaacccaataatttaatgcaaaccggatttaaaaggagaaatgtctaggtctttcaaatgtatttctagttaggaattgaggggtggttttattaattcaatgggtgttactgtccggagacacactcatcccagaagttagatgtgcagagggcaaggctcaggaaaagttcaggtagacagtgagccatatgaacagggaatcacattgaggaccatgtcctgtgagattctgggtttctgtgagaggagttctgtcttcatggacttctgggcatgtcagaggacaaatattaaacaaagttcagggcagggagctcagcatcccactgtggcgtggtccacatgtcacctatcttcttcctcagggtggcgtggcctgagctatgaaaaacctgcctcatgaatatgcaaatgcactgctgtctaccgaggtaaatacagatctttccttgcccagagaccatcacacaacagccacatccctcccctacagaagcccccagagcgcagcacctcaccatggactgcacctggaggatcctcttcttggtggcagcagctacaggcaagagaatcctgagttccagggctgatgaggggactgggtccagttaagtggtgtctcatccactcctctgtcctctccacaggcacccacgcccaggtccagctggtacagtctggggctgaggtgaagaagcctggggcctcagtgaaggtctcctgcaaggtttccggatacaccctcactgaattatccatgcactgggtgcgacaggctcctggaaaagggcttgagtggatgggaggttttgatcctgaagatggtgaaacaatctacgcacagaagttccagggcagagtcaccatgaccgaggacacatctacagacacagcctacatggagctgagcagcctgagatctgaggacacggccgtgtattactgtgcaacagacacagtgtgaaaacccacatcctgagagcgtcagaaaccctgaggaatgaggcagctgtgctgaggctgaggagatgacaggatttatgaagtttaaatctgtttagaaaatgggttgagtaattgagtaaaacagcaatggaaagatgtgtacactgtcattatgtaggaaatagtattttcaactgtcaccctataagtaacactcacagagtgggaaaggcagccatcaatcaagctgatgcaaacattcccatgggggctttgtggggacatacattttataattggatctataaatcattagaaacaggattgcttgatctcatggtaagactaaatataatttccaagaagtggccgaaatttcttccaaaatgtctttgcccttccttttacattgaatttattttaaaggagttttaggatcacaacaagtttgagtagaagaaacagagttcccatgcactcctgccccccgacgctcagccttctctgctatcaacaccctgcaccagtgtcataaatcggttacagaggatgaatctccacagacacattggttgtttccttttctggtggtccctggtataacaagcctcaactatcttgaagcaccccaggttcaagtggattcttcaagtgggttactgggaatgatgccaggtagaaggaaagtgggtgggaccattcctctttgcactctttcctcaaggatccataaaatgtacatttacatggagctcctctttctcctggttttatatgcctcttccccaatggtaaggtttcccagtgtttacagcgggggtccccagtccccgtgctgtggatccgttaaggtgtgcagtgcgttaggaactgggccacacagctggagatgagtgggggcgagccagcatcgctgcctgagctctgtctcctgtcggatcagctgtgcattagattctcctacgagccgaattcactttttttatatatatactttaattctagggtacatgtgcataacgtacaggtttgttacataggtatacatgtgctatgttggtttgctgcattcatcgaattctattgtgacctgcacatacaaggggcctagactgagcgctccctatgagaatctaatgcctgacgattgcagggggaacaagttcatcccaaaaccacccaccgccatcatccatggaaaaattctcttctaccaaactgttccctggtgccaaaatggttggggacactggtgtagaggcaggtctgtaccttggaaagccagcagcttctggtgaatcccataattaatgtcctttaatgagaagtggagactttggtcatgagggccttcgtgaataatgccctacagttggattcaaaacattgtaagctcttggggggtgtttctggataaagccctttgtgcagaaaatgcagacacatccatgggatccatgcaggaaaaaagcttcctttacaaagtggtttggcacctggaaggagctctcagggttgggcactgtaccctttgctggctgcactttagccagaggcttaagcctgattggtcttgcagtgggagagccttcctggggtcaaaggttacaaaaatgcctgtcatcttccagctgagcaagcccatctgcgtgcttgtcagtgtcaaccccatgaagggtgcactctggaagatgacaagatgcacacaaacctcctcccactgattatccactaccacacactcagctgcaacccgtgctccagaaacggacaggggcctgcaaggataaacagaatggaagtattttattacctgggaaagcactgccaaatgccacgtttcaggaaggttaactcataagtgttcaggaagtgactgaagggcagtggtgggtgaggtgacgggactgcctcagggctgcacatgaggagggctccctcccacacagccttttcctccaggagctgcaccaggaactcacagaggatcaggaaggattctgagaacattcttctgtggcgctgactagaggggcaaaataaattataaaaaataaatcaattctaaatataatatgatgtttgttattagaaactatttctggatcctgtgggaaccctgacataagccaccattctctgtgaacaaacatttaacctctccttccatggggaggtcgacgagcttggattggttctttcatggatagtatcccccaaactcctctccactccctgcgtatccccgggtctctcagtgacaagttctcctcagtggaatttggttgatgtagtgagatcttcaaatttcctgtcgtctgtgttctcatgttctccccttatctgagattaagaaacgcacctgcatgtagtaaattatagcctactgtctctcatggacaaaataatggccacgccaaccaaccttgtggctgacagcaaccactggcggccaccatcccctccacagcctgtgttggaacatcacctgagagattgtgttagcaactttccttcagaatcatcttaaaaactttgtgtcccatttcacatggagacgtcatttttccatttcatcttcatagagaaatagaaggagaagaataccaaatacacttcctatctccagattattcaaatataattgtccctttatcaccttctgatttctggtcttcacagaatactctacaaatttttctcactggcgttataccaaaagttgtgaagcaccagatactgggattaatttaaccaacattattattctaataattcttagaatttagaattacaattatcatcttttcgtatacggataaactaacctatgcctttgaaaataagcccttacatgagagtgaaaagctatagatttggaggatttccttgcaaatccaatatttggaaaacggattttatcacaaatatacaaattaacttacaattgaacaacaaaaccacagaatttaattttaaaatgggcagagacctgaatagaaaccatatccaaaaaacaaacataaaaagtgatcaacttgattttcattaggtgtacttatgtttaatatttaaaaagttctactaaactatgagaatgggtaaaaattacaaggtagacaatatcagatggtgatgaggaagttgaaaaacaggaactttcaccccttgctggtgggaatgccgaaatggcacatagaaaactacagttaataatttattgtatatttcagaatagctacaagataagatttggaatgttcataacactaagaaataatcagtgatatagatgaaggatatcctagttatccagatttgatcactgcacataaaatgcttttatcaaaatatcagttgtaccacctaaatattttgaaatattgtgtatctatataaatcaaacattaaaaaacaccaatgcagtggaatccagctaattgcagattcccattagatgggatgtgctgcatgatctgtaaactaatcagaatctgtgggtttgtaaaggactttagaaatcaactaggctgcttgtttctaaagataagtctccctagtttaaatattttcttaatgggtggcgattttgaacatagaagaaatagtaatatttgtgtcttgtaagttttcttcttctcgtgtcacgagaaaaggtttgcagggaggaatctgggaccatctttcaagtctcaacttcactgtgattacctcagtaagtattttctgatacccctgactaagataagtctcgtatctgtcctagaaactaaaagtagaattctaagcatctacctgaccagatggacccttcctcttcaccaaggagttccagagacacttttaaacctagctccggccgtgttagaaatagaggatcagaaatgcctcattataccctcctccctttggaattcaagcacaactaaccagcatttttatgaaaacagagcttaaggctcagaaaacagattatttgtagcagtaagataccaaattctaaccttattcgagaatatcatcacaggacagagagcaggcattgaaaggaatcaaaggcttttaccctaaaatatattcctttgacatattttaaaatagccaggcacagttatcttttgtgagagagatttacattctgtagagaatctccttccctttccaggtctttttcttataccgaggagattagctgagggtctagcttcttttaaaggtcttaggagaaaacatttcccagctattgcctctaaaggtggtcacataagagacttcatctacatagtaagaatcttgttctccaaaacctgttatcttaacctagaaacatttttctaccggtttcaggtctttagaaaaaagcttaaatctttcaatcaattgtcaatcagaaaatattcgaactcactgtaagttgtaatccccgccacacactgcctcacttctagctgttttgtctttatggaccaaatcaacatatatctcacatgtattgtttggtgactgtctctctagtacactaaatttaagctgccatcaagccactttgggcacatgttctcaagatcttctggggctgttcacagttcatggtcctcacattcgcctcagaataaatctctctaaatattttgcaaggttgctttttcatcagtagttctaacagaacctactctgtggtttttgttaaaagcattatattaatatagtattagtaatattagtattagttataacacatgttggaaaattcttatgaagttatgcatagactaacaatgggatcaagtgtaaatgtttcaaagtatttaagcaagttatttcaaaatttatcttctgcagatacttctatcagattcattatatcagctaattacttgctttatgatttttgcattttattgtagatgatcacaccctatattttcttggcctttattgtagaaaattgtgtgaaactagtcagggctacatttgcaagtaattgtcgcagtggctgcctgaattgcagtgggtttcctctgcagccaccagtcactcagattactccaatgacaccttaattttgtttcctgcttggctttgggccttagtcttgtgctctccagacagactctgtctttcatctcccctaggtcaggccagagccacatggacctgatgattgtcaatatggtgggaagggtcgcactgaacgggcactctctgtccttctgagggagccatactgcaggcagacatggcagtcctggctcagggtgtgtccttccaagtatccctgcccttccttcaggtgtgatgctgatccatgcatcttcctcccattcctgggtagagggtctccttgttctttccccaatcttctcccagcagccactatgtcttcccactgatgtcttcagcttcctcttttctgcccttcccagcagatgagtctgttattcctgagggaagagagaggaggtgggagatgaggctgttattcctgaaagaatggacagagctttggagcttttctttcttctaccccagtttctacgagttcctccagtgcctgtaacacagagctgtcagtggctttgcccctgcatgttaattctttggtcatgtagtggtggtgagggagctgggtctggatgcatttcagccacagctgctgttccacttccccacacagaaccgtctcaggaggaagaggttggagatttttctgatgtgtcctcaatcctgggagaaaagttttcaatagcaataggaatctctcagttgtatgtccgctgagaatttaaacaataacttctttataatactaaattttaaacaatccaatgaatatatctaatttaattttgtattagcttatgtgacatttgctggcctctcccccagataaggtcatattctcttcctgtttgttcctgcaagtcactgaatttcacaagatgtaaggtctcttgattatactataacatcaataatctggtgtactaaagaaaatgtgctaatttgcagcttactaaaattagttgttttagtaaaaataatatatttgttatagcatgcctacatctccaggctgagtagaagctttgtttgtaatactcagaaactgcaaataacacacatattaaggagctttctaaataaatactatgggtgaattctttaactggaatactgttcctcattagaatcaacacattctttatacacaaccaaattactgactcacaagtaattatactgagcaagaagccacacaaatgaaattgaaaatataagatttcactttaacaaaatcttgaaaaatagatctgaattaacaaagatgagaggttgactcagtatggtgagagggaaataatggggaggcaggaatgagaggaacacagggaggcttttaactgtaatcatcgttatctcgattgttattttggatacacaggtgagcacacgtgaaattacgttttttttccttcggagacatggttttgctttgtcgtccaggctggagctccgtggtgagatcatagctctctgcagcctcagaccctgggtctccagcaatcctcctccctctgccctatgtagctgggactacaggtgtgcaccaccatgctcggcttcagtgcgtattaaaccgcacacttcaattatgcagtatttattatatagcaataatgcctcaataagggtattacaaataagtggatagataatttgttaaagattgatggaaagatagataccaacatgagaaatgtatgacactcaagaaaataaaactgtaggaaacttgcttttctttatatttgttaggtaatcaccacagtgtgtacacatcacaccatgttcccattacagagaaaaggttctgcgaacctcacgagctgtgacccctgtgtgctgggcttggttcagggagaagtcaggtccagtggtgagaagcacaggcccagatgcccaggctcactctgaccaaatgtgagcactggggacattgtaaaacccacctgtgcttttgctgataatttttcatctttaacatggaaataatattgatactatataccatggtttctctgcgtatgtaaaaataaaagatgattggtgctaactttaaaaatatgcagtttatgtagatctatggtacctcaataaaactgttttaaaataaaaattacaaaattataagattttcaggttttaaggtttaagtttatcacaaaacaaactgacaataggaaagcacaatttcccaatgctttcaatatcacagatctccccgaggacattctgacatgctctgagccccactatctccaaaggcctctcaccccagagcttactatatagtaggagatatgcaaatagagccctccgtctgctgatgaaaaccagcccagccctgaccctgcagctctgagagaggagcccagccctgggattttcaggtgttttcatttggtgatcaggactgaacagagagaactcaccatggagtttgggctgagctggctttttcttgtggctattttaaaaggtaattcatggagaaatagaaaaattgagtgtgaatggataagagtgagagaaacagtggatacgtgtggcagtttctgaccagggtttctttttgtttgcaggtgtccagtgtgaggtgcagctgttggagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaaagacacagtgaggggaagtcattgtgagcccagacacaaacctccctgcaggaacgatgggggggaaatcagcggcagggggcgctcaggacccgctgatcagagtcatccgcagaggcaggtgcagatggaggctgtttcctgtcagggtgtgggacttcatcttcttctgacagtttctctagtgaacctctctaacctcagaattctgtgcttactaatgtcatctctacgtattttttaaaagatcattttaatatgagcacctattctcacacgcaccaaatgcagattgacgcttacagagatgaaaagttctcaaccatggtcaccaggatgagagtcctgaggaaattcaggggtgcctggtgactcttccgcaatcagtcctgggacagaaacctcagggacagcctttatgagttttgatcacatctaacagagaggatgggccagggccagagtcatgtagaacctcacaggttccacgtctgacccttctcctgacactaaagccaatcagcatcagcactgacctggtgctccttttgctcccaatccatgttctttctttggagagtttcttctcccttttttatttgcttttcctctttcctgaaaaagaaacagatggtccccttggtccacattccagggctcaaggcattttcttggagctcaggtggggctcaggctgtggctcctgcagccacgtgggagaggctgatgggacttccttctctccccattttctcaggaccctctactgtgttgtgtgtaggctcatctgggaatgcagttgaccattaatactgaaggggacaaactcatttgatcaaaatgggatgtggatgtggagttaaccctgttccgtgcacagtgtcagagtcgtctgcttcagaagtagtgttagaaagagctggtgaaatttatcagaatcaagatggagccacttgtgttaaagccctaatgaatgaagctggggaaggccatgaaggagggttctaacacacatattcctgataataagaactaccataaatagactctgcacaaccataaccttgcacagaagccaccacaacattaaaagaattacttctcccattgtatctgcccagcaactccctgttcaactttacaccgatgtgcccctgttattgatccttctagcccaggacaattgtcttaaacagctgatgtgaccctcctcatttttcctttattctttatcttcctataccaacctgaatgcacccatacatttcaattgcaatacacttcctagaatacatattattatattttagagtctctctctctctgttattcagggttgacaagctacagatggacatgccactttctttttttatgactttttttaaaaattttattattcttgtactttaagttttagggtacctgtgaacaatgcaggtttgttacatatgtatacatgtgccatgttgttgtgctccacccattaactcgtcatttagcattaggtatacctcctaatgctctccctccccactacccccaccccacaacagtccctggagtgtgatgttcctcttcctgtgtccatgtgttctcattgttcaattcccacctatgagtgaggaaaaaaatgatgagttcatgtcctttgtagggacacggaagaaactggaaaccatccttctatcattctcagcaaactatcgcaaggacaaaagacatgccacttttctgtgagatgtggaggatgacagtttttggagatgtctgggaatacccagtgtccagaagatcatccatcaataagtgcaggctggaggtcccagagagaggcaaagctgctgaaacaccatggaatttcattttctccagttctgctctgatggaatcaggcccacctgttttgcttgtcttaagtaaattcacagcaccacatatattagtgttgcagtgaataactacaaagtctatcctaaccaagtgtaccatcaaatttaccattacccagagggaagaatctttaacatgagatctatgttcataattttttaaggtgaaaaagtgatcactatccaatcaggcaaatatgattttgctaatgagtggtagatgttgcatgtatttttggatgtcatccctttttcagatgcatggcttgcaattatattttcccattctgtaggttggaattatttccacactttgtagaatctttttgttgtgatgtagttccacctgtttaattctgcttttgttgtctgtgcctttaatgtgaaatataggaaatcattgttaatatattattttctgggtcggggaaattttacaattgcaggccatatgtttaaatatctggcccattcagagtgatttttgtgtttattctaacccaaaattcttaactctttgcatgtgtacatccagtttttctaacacattcatagggagagacttggtttatctgttttatattgtgggttcttatgctgaaaatcagtttgccattgatacatcagtttatttctgagctctttctacatatttatgccaactccatcctgtttttattattctacttttgttattacttttgaaatctggaagtaagatgtaagtttatttttgcctttttacagatgctatagcaaaatattttaacctttcactcttccatataaaagtatggctttaaataatgacttttattatatacaggttatattcttgtattcctaacttttagaggttttattatgagatcttgaattttttaaatgttattttctatgtctggtgagaagttaactgatgcttttcctttattctcttaatttaccacatcagatttattgatttgaagatattgattcatcagcgcatctcaaaaataatttggagcttgtcatggtgtacaatccttttaaagtcttatagaacttagttgactatgaattgggagtagcttgtttatatatactaagaacatttgtcagaagctctttcttgtttattcccagtttgcacttacatatactataaaacataatatataaattttttattcctttcatagttatataatatagcaattacaaagataaaaactgcacttcatcttgattttcccattttgtacagtcttaatttcttcgtatagatttatgttttgaatgtatatcacacggctactagcagagaaagtttgttaaaatgtgcactgaagcatgaatgtgctgacaataaattgtctcaagatctttttgtaatgacagaattttatttgcctttcacttttaatgaaaatgtaatgcacatagaattccagtttgcatttcacttgtaatttattttcttgtgtttattattttgttcatggagatgatcacacattacattctgctgggcctttattaaccacatttctatgaacctagtcagggttggatttcaagtgtatggttgccacggctatcagagttgaagtcagcttctcctgttcacaaaaagttcaggttcctccagtgatacccacttttgtgtcccggtttggctcttcccatttctttctccccagagagagcctgtctctttcatctgtggcaggtgcatcctgctgacacttttacttggtgattgtttgtggggtgaaagggcttggacacagggggatgttctccaaccttctgaccaagcatccttcttagctatgggtggtgagaatggctctgaagcatggtcttccaagcgttcctgttccttcccttccccaagtcagagtgtctctttctagccacagtggtcttccatcagtgtcctcagcttctgacccactgtccttactccacagactcaggatttcattcctcaggaaagagacgggaggtgtttctgggtagagtctccttagtgtcctctgtttccttctgttctagttgattctaccagtgcctgaaggacacaagatttaataaatgtctcccacatatcgtgaagagggattcagcattgaacggagctactgttcttcctccccagtcaacatcacaggacagcaggtggctgagttgtctggggatttctccaattctgtaggaaaagcccgcaagtgccaggagtttcacactctcacagcattagcacacacatcctcaacaactcatgaaacatttccaggttagctttttcctatcttcaataccatacaatgagtggcacctgccccaggtactctaataaatggacctagttttctctgcaggctccccattttctcagatttcaggggtttttttctctgcaacatcaactcagatatgttgaagggttcattttttgtagttcttcaagtttcttgttaatgaggtcagaagaagatcattttctcatttttttttttacattcccgtgcttagtatctgctttctaaataaaattcggaaactaagacaaaatatcaaatatccactatttggtgcattgttaaactatttgagaaatattcatgtactgaaatacaatgaacaattgaaatcaaggcatgcctcagtcacataagaatgtgaggacattatcaaataattgtgctgagtgaaggaagctaaagaattcacagtaaatctcctgtgatttcttttgtataaattgtagaaaatgcaactattctaaattaacatggagaagatctgaatttttctgagaaaagtgtggtgaggtaacaagatggtgaaataaaattacagagaagtgagagaaaaaaatttggaggttaatttaattgctaatagcacgattgaagtgctgattcaaaggctgcacacatataccaacattttccatatcgtacactataaatttgaattcactattgattgaatttttgaataaagcagtaacaaaaatgagtatattggctgaggaagagcaagaaagagatgaatattgacacttgaataatcacggactcctgaaaatacacacatgtgaacactgattgcatatttcaggtaaatactagaaaaagcaaagtcacataaagtcgttatgacaggtgggataccctgcaaatcacactaggcatgtcccacactgccctggagctgtctcaggggagcagtctcctccagtgtttagaggcacaggcacggataatagggctgacgctgtccagatgtgtgatattggacacattgcacaactgctctgttatgtatgtaattcatcttctctaaaaatgtaacattgacacttgcactgaatatattctgcaaatatgtaaacattaaataagatgatgactgctaattgatcatcaagtcacaatcacataatctgaagttatattttcctgagagataggattacctccagtgttttccgggaccctctcatctgctctgggcactgccctctcctccagcgtcccactagagcttgctatatagtaggagacatgcaaatagggccctccctctgctgataaaaaccagccgagcccagaccctgcagctctgggagaagagccccagccccagaattcccaggagtttccattcggtgatcagcactgaacacagaggactcaccatggagtttgggctgagctgggttttccttgttgctattataaaaggtgatttatggagaactagagacattgagtggacgtgagtgagataagcagtgaatatatgtggcagtttctgactaggttgtctctgtgtttgcaggtgtccagtgtcaggtgcagctggtggagtctgggggaggcttggtcaagcctggagggtccctgagactctcctgtgcagcctctggattcaccttcagtgactactacatgagctggatccgccaggctccagggaaggggctggagtgggtttcatacattagtagtagtggtagtaccatatactacgcagactctgtgaagggccgattcaccatctccagggacaacgccaagaactcactgtatctgcaaatgaacagcctgagagccgaggacacggccgtgtattactgtgcgagagacacagtgaggggaagtcagtgtgagcccagacacaaacctccctgcaggggtcccttgggaccaccagggggcgcccgggacactgagcacggggctgtctccagggcaggtgcaggtgctgctgagggctggcttcctgtcgcggtctggggcggcctcgtcgtcaaatttccccaggaacttctccagatttacaattctgtactaacatttgatgtctctaagtggaaaacgtttttgtcctttttgtttctttgtttttgtaacaagaggaaacatcctcagctccacagaagccagggtgtcactttggggacagaaataatcctttcatggtcaccaggataagagtcctgaggaatcccagggaaacctggagagtgttttccagttagactcagggcagagacctccatgggaatctctgattagaacaggccttgagctctgacgggagccaagagagaggctcgcccagggtcagagtccttaaaacctgatggttttcacagctatcccccctcgtcttgtaaactcagactgattcagttgaccctctttctgctaatccatttccttctctgtaggtttgattctcacagttcgctttcttcttctcttccctgaaaacagacgatgtgttttctgtagtcaaaatcccagggctcaggtctgcaggacctgggtaggctacggggactttctcactcaccattgtctggacactcttgtcttctgtgcatggaggcatttggaaaatgaagtggacattagccatgaagggaataatactagttttctccaataggatattgatgtagagctgatcttgtgcttctcacactgtctcagagtttggactttcacctgtgactttgagaagagctggggatgggcactccattgtgctgtgagctctgggtaacgataattgtagaatctgcctaggcagtctaaggtcaatactactggtcatcaggaaagacagctggaattcctgggaagatctgcatctgccgtccaccatggagtcccatcgtcttctgttatgctctctttgaatcagtcccacctagattatctagaacactcttcctgacttaggaaaaataatggcaggctccactaacacctgtgttatgccatgggagcaacacctaagctagtgtgtgaatgagtagatgagactgtggtctagtcaaggtgacaggtaaaattgattgttgccattatgatattttattttatatttggcaatatagtcatgctcctattataaatattttttgagacggagtcttgctctgttgccagcctggagagtgcagcagcacgatctcggctcactgcaacctcttccacctcccaggttcaagcagttctcctgcctcagcctcccgagaaactgggattacaggtgcacgccaccatgcctggctaatttttgtatttttagtatcgacagggtttcaccatgtgggccagtgtggtctcgatttcctgacctcgtgatctgcacacctcggcctcccaaagtgctgggattacaggcatgagccaccacacctggcctagttttattaatgtctgtccataccagcaactacatacctatggggacattaatttacatctgcagacagatgtgtaaatacacaagcctatacatacatgtgtagccatttatatttaacattataataaaataattctaaaatattttctaaagaattaaacttaatgatgagctaaatataaattagagtaatctataattgatttcgatcattctctatagtttgcataaatggatgtctatttctaagccttaacatagtgtattcgtcattttaaaacagtcaagaaaaaattacaaatgttcttgtcacaaaaaaagataaggatttgatgatttgaggtaatatatatgtcaattaacttgattcaattattctgtattgcattcacaaaccataacatacctttgtgccccataaatatatacaaccaaaatttctcaattttcaatgaaattttaattatatatttttaaatctgatgcctctccttggattaagccacctcctcaggcttacagggctcttccattttctcaacatgctgttataccagatgagcacaaacacattaatttcattatgcttagctttaatttttcaaaacaacatgaaggtgataattttaccaatagacgtattgcaacctactatgcatgagaccctttctgtgcttcaaggtttcttctcaggactttatatgtattgcaaattttcatttttttctgatatggaatgctgatttctctttattacagattatcagtttatttttcaaatttatctcttaaaattaattttttcaaagtcccactcaaaccagggtattattagaactttgaagtgtaatagttggaccaactttgagaatacattcaatttagttcacgtgctctcaagtatcttttcttctttaaaagttgttgtcagttgtaatatcacacaaaatattagtaatttatactaatgacacaggttaaaatattgtataaataatttaattacatttgattggaaaaaaggaatatatgttcctcatatcttgacttttttttcttctctatgagatgcatgtttattaattattaagtttaagatgttacccttgtctttttgatttctgggatttaattttagtacatatacttgaatgcattgtattaattcatataataatgttcatattttggatagggttttaatattaattttgttattactgaattttaaactattctacactttttcattttttgtttttatgcgataaaatttacatataagaaaatatgcatagatctggaatgtatcactagagagtttctggcaaatgtgaatacccttgtccccagcacctaaggtagctgaagagcaagtccatccccacatcgcgggtctttccctgtgcctgcggtcaactcctgcatggggaaatgttttgatttctcacactacagatccatttttttccgttttgaactttatataaatggaatcaaacattatagaccttttttttgaaaggggcttcgatatttttgagattaattcatgctatttaatgtataaaattagatcaacatattgtcatttattcaattcatggactgactctgatatgaaacctcaaagttttcatgtatatatggagacagggagaggaaggagaaagattttatatctgagtcagtccattaagtaaataaatgagaatattttgatttattttcctgttgatgtactttaaatttgtttccattttatgaatattataggcaaagccgttacaaatatattagtgtaggttttcctatattgtctcatttttgttgagaaaatatgaagtatatatttctttttttatttttgattactatttatttatattttatattttactttaagttctgggatacatgtgctgaacatgcaggcttcttacgtaagtatgcatgtgccgtggcggtttgctgcacctatcaacctgtcatctaggtttgaagcacctcatgcattaggtatttgtcctaatgctctccctcccctttcctaatgcttttcctcccctgacacatcccagtgtgtgatgttcccctccttgtgtccatgtgttctcattgttcaactcccacttatgagtgagaacatgtggtgtttggttttctgttcctgtgttagtttgccgaggatgatgatttccagcttcatccatgtccctgcaaaggacatggaaatcattcttttttatggctgcatagtagttcatggtgtacatatgccacattttttcatacagtctatcattgatggacatttgagttggttccatgtctttgctattgtaaatagtgctgcaataaacatacatgtgcatatgtctttatagtagaatgatttataatcctttgggtatatagccggtaacaggactgctgggtcaaatggtgtttctcgttctagatccttgaggaatttccacactgtcttccacaatggttgaactgatttacactccccctcaacagtgtaaaagtgttcctatttctccacattctcaccagcatctgttgtttccagactttttaatgatcaacactctaactggcatgagatggtgtctcattgtgattttcatttgcatttctctaatgaccagtgataatgagctttttttcatatgtttgttagctgcataaatgtctttttttgagaagtgtctgttcatgtccttcgctcactttttgatggggttgttttttttttgtaaatttgtttaagttccttgtagattctggatattagacctttgtcagatggatagattgcaaaaattttctcccattctgtaggttgcctgttcattctgatgatagtttcttttgctgagcagaagctctttggtttaattagatcccatttgtcagttttggcttttgtcgtaattgctttggtgttttagtcatgaagcctttgcccatgcctatgtcctgaatgatactgcctatgttttcttctagggtttttgtggttttagattttacatttaagtctttaatgcatctagagttaatttttgtataaggtataaggaagggatccagtttcagttttctccatatggctacccagttttcccagcaccatttattaaatagggatcatttccccatcgcttgtttttgtcaggtttgttgaagatcagatggttgtagatgtgtggtgttatttctgaggcctctgctctgttccattggtctatataactgttttggcaccactaccatgctgtttttgttactgtagccttatagtataatttgaagtcaggtagcatgatgccttcagctttgttctttttgcttaggactatcttggctatacaggctgtttttagttccatatgaagtttaaggtagttttttctggctctgtgaagaaagtcaatggtagcttgatgggaatagcattgattgtataaattactttgggcactatggtcattttcacaatattgattcttcctatccatgagcatggtatttatttattataaaagtaactttaattttttcagttttaatgaggaacaattgaaatatttttaaatgtatatgtttaaggtgcaccacttcatgttttgatattgtgttagtccattctcacactgctataaagaaatgcctgagactgagtaatgtgaaacaaaaaaatagatgtttaattggctcatttttctgcagactgtacaggaagtgtagtggcttctccttctggtgagactcaggaaagttagaatcatagcagaagacaaatagtagtagacacatcacatggccagagcaggggccacaggaagagagggaggtctacacagttagacaaccagatcttatgataactcacacaatattatgagaacagcgccaagagtcagtgctaaaccattcatgaaagacccaccccatgacccaagcatctcccactgggtcccagcttcaggattgaggattataatacaacacgagattcaggccaggacgagttgcaaactgtatcagatacacattgtaaaatgctcatcatgatcaaggtaatttgtgtgcctatcatcccacatacattttttttttaaatggagtgtgtgtgtgtgtgtgtgtgtgtgtgtgtgtgtgatgagaatatctaagatctaccctttcagcaaaaatcacttttacaacacagtattaaatacaggaacattgctgtagattagatctccagaactcattcaacctgcacacctgaaattctgtaccctttaaacatcacccaatttccctctcctcccacatcctgggacccattattttactttctgctttcaagagcttgggtgttttagataccacatgtaaatgagataatgcagcatttgtctttctgcatctggcttattccacttagcatcatgtcctccaggcccatccgtgttgttgcaaatgtcagaatttccttcttttcaaagcctaataaaattcagttttatgtgtacacattttctttatacattcatcagtctgtggtcattaaattattttacaaatctacactattataaataaccttgcaatcagcatgtgtttaacataataattttacttatttgaatacataacaagaagtgggatcaccagatgatatgatagctttatttttcaatttattgagtaaccaatcctaccacaccctaaaaggattctcttttcaccacattcttgccaatatgtgttatatgtcttgctgatgatagccattttaagcagagtgaggtgataactcatcatgattttgatttgaattcctctgataattagtaatgttgagaaccctttgaggctctgtttttcatgtgtgtgttttctgaagaaaaacctatccagtttttgccctttttatcagatcatttgttatttgctattgagttgcatgagttatttatacttttggatagaacttatgtcaggtatataattgcacatagtttttttcctgtgcttttttctattaaattcaaagaaatcatttctgaatcaatgacaggaagtttttttccatgtgttctatgagtttgtggcttcaggttatgttcatttttagtttatttttgaatacggtgttagagaaggtctaattttatttcttttgcatatggatgttaagcttttacatcatatattgaggagactgtccatccttcactgtgtgttcttgggatacaaaatcaggaagatgcataatttaaaaagaaaacatcagatgaatattcctggtgaatatagaccgaaaagttctcaacaaaatactagcaaatagaatccagaagcactttaaaatgtaatacctcatgatcaagtaggctttacccctggaaggcaaggttcattcaacatccacaattcagtaactgtgattcaccatgtaagcagaataaaagcaaaaaccatatgattatctcaatagatgctgagaaagcttttgataggatccaacatccgctcataataaaagccctcaacagactaggcatcaaaaaaacttacctcgaaataataagagccatctatgaccaatccacagtcaacattatactgagtgagcaaaagctcaaaaccctttagaagtgaaagaagaccaagatgccctctcaccactgctattgaacatagtactagaaaccctagtcagagcaaccaagcaatatcaaaataaaaggcagctgatatggtttgtacttgtgtccccactcaaattaaatgtcaaattgtaatacgcagtgttgagggtggggcctgatgaaaggtggttagatcatggggatgagtctctctctcgtgctgatcccatgatagagccctcaggagatctggtttcaaagtacgtggcacctccctcgtctttcttcctcctgctccagccaggtaggacatgatgcttccctttctgtactgattgtcaggatcctgaggcctccccagccatgcttcctgtatagcctgaagaaccatgaaacaattaaaaatctttataaattacacagtctcaggtgtttctttatagtttgcgaatggactaatacagaatccaaataggaaaagaagaactcaatgtatctctccaaactgatgatataattctatacctagaaaattctaaagaccctgccaaaataattctagaatagataaacaattttggtaaagtgttgggatacaaaatcaatgtacaaaaatcactagcatttctataccccaactatgtccaagctgagactgaaatcaagaacacaatcctatcccacttacaatattcacacacacaaaatatgaaatgcctggaaatacaggtaacaaacaaggtgaaggatctctgcaaggagaactacaaaatacagcagaaataaataaataaatcgtacatgacacatgactcatctgacaaagggctaatatccagaatctacaatgaacttaaacaaatttacaagaaaaacaaacaaccccatcaaaaagcgggcaaaggatatgaatagacacttctcaaaagaagacatttatggagccaacagacacatgaaaaaatgctcatcatcactggccatcagaggaatgcaaatcaaaaccacaatgagataccatctcacaccagctagaatggcgatcattaaaaagtcagggaacaacaggcgctggaggggatgtggagaaataggaacacttttacactgctggtgggactgtaaactagttcaaccattgtggaagacagtgtggcgatcctcaaggatctagaactagaaataccatttgacccagcagtcccattacttgctatatacccaaaggattataaatcatgctgctataaagacacatgcacacttatgtttattgtgtcactattgacaatagcaaagacttggagccagcccaaatgtccaccagtgatagactggattaagaaaatgtggcacatatacaccatggaatactatgcagccataaaaaaggatgagttcatgtcctttgtagggacatggatgaaaatggaaaccatcattctgtgcaaactatcacaaggacagaaaaccaaacactgcatgttctcattcataggtgggaactgaacagtgagaacatttggactcaaggtggggaacatcacacaccggggcccgtcatggggtcgtgggagtggggagggatagcattaggagatatacctaatgtaatgttaatgggtgcagcacaccaacatagcacatgtatacatatgtagcaaacctgcacattgtgcacatggaccctagaacttaaagtattatttaaaaagaaagaaaaaaactattaatttttctgaaccatgaacatggaatatttcagatatattttcaatttgtgtgtgttcactttattttttattatcaatcatttctggttttcttttagaaatctttcacttatttggtaatatgaaatataatttttagctattataaacaaaatgctttattgattttttgctgtttgcatttagcaatgccaccaatttttgtatgtaggtgttgtattctgcaaatttacagaattttttatcaattataacagtttttccagcaccatttattaaatagggaatcgtttccccatttcttgtttttgtcaggtttgtcaaagatcagatggtcgtagatatgcagcattatttctgagggctctgttctgttccattggtctatatctctgttttggtaccagtaccatgctgttttggttactgtagccttgtagcatagcttgaagtcaggtagcgtgatgcctccatctttgttgttttggcttaggattgagttggcaatgcaggctcttttttgttccatatgaactttaaagtagttttttccaattctgtgaagaaagtcattgatggggatggcatcgaatctataaattaccttgggcagtatggccattttcacgatattgattcttgctacccatgagcatggaatgttcttccatttctttgtgtcctcttttatttcattgagcagtggtttgtagttctccttgaagaggtccttcacatcccttgtaagttggattcctaggtgttttattctctttgaagcaattgtgaatgggagttcactcatgatttggctctctgtttgtctgttattggtgtataagaatgctagtgatttttgcacactgattttgtaccctgagacttcactgatgttgcctattagcttagggagatttggggctgagacaatggggttttctagatatacaatcatgtcatctgcaaacagggacaatttgacttcctcttttcctaatcgaataccctttatttccttctcctgcctgattgccctggccagaatatgtagaaagctgaaactggatcccttccttgcaccttatacaaaaattaattcaagatggattaaagacttaaatgttagatctaaaaccataaaaaccctagaagaaaacctaagcaataccattcaggacataggcatgggcaaggacttcatgtctaaaacagcaaaagcaatggcaacaaaagccaaaattgacaaatgggatctaattaagctaaagagcttctgcacagcaaaagaaactatcatcagagtgaacaggcaaccaacagaatgggagaaaacttttgcgatctactcatctgacaaagggctaatatccagaatctacaatgaactcaaacaaatttacaagaaaaaaacaaacaaccccatcaaaaagtgggtgaaggatatgaacagacacttctcaaaagaagacatttatgcagccaacagacacatgaaaaaatgctcatcatcactggccatcagagaaatgcaaatcaaaaccacaatgagataccatctcacaccagttgggatggcgatcattaaaaagtcagggaacaacaggcgctggagaggatatggagaaataggaacacttttacactgttggtgggactgtaaactagttcaaccattgtggaagacagtgtggcgatcctcaaggatctagaactagaaataccatttgacccagcagtcccattacttgctatatacccaaaggattataaatcatgctgctataaagacacatgcacacttatgtttattgtgtcactattgacaatagcaaagacttggagccaacccaaatgtccaccagtgatagactggattaagaaaatgtggcacatatacaccatggaatactatgcagccataaaaaaggatgagttcatgtcctttgtggggacatggatgaaaatggaaaccatcattctgtgcaaactatcacaaggacagaaaaccaaacactgcatgttctcattcataggtgggaactgaacaatgagaacatttggtctcaaggtggggaacatcacacaccggggcccgtcatggggtcgtgggagtggggagggatagcattaggagatatacctaatggtaaatgacaagttaataggtgcagcacaccaacgtggcacacgtatacatatgtaactaacctgcacattgtgcacatgtaccctaaaacttaaagtataataaaaaaaagaaaaaagagacccaattgttgacaaagttatgaaaaagatagtttttaaggagtctttaagtaatattgtattttctgcaaacagacaatttgatttcccctattccaaatttcaggacatttcttcttttttcttgtcaaattgttctggctagaattacagtaccatgtagaagtggtggaaaagagcatttttgtcttgttcaacatcttagagaaaaggctttcagtttttccagccttggtataatgcaagctgtgggtttcacatatctggactttattattttgagatatgtttcttgtataccaagtttgttgagaatttctataaggaatggaggttgaatttttttctatgactttcttaaagcaattaatcataaaataataataagcaggtcaatacaagatccataaattagtggaagctagttatttgcactgctgccatagagtaggatcactacacaactcatggtgttgatgggaaactataattctgcaataattaaagactagtgatttacactgggctctattgagagatttggttgtcaactacagaaatcgagatgaaggggcactgagaaacatttcgcttcatatcatctcaacttctaatatcaatttttagtactaatacagtcctattttctcagtatactgtctcacaggttatagtatatgtcttagaaaattaagggttgtttcattctaataattaactcagaaaaattcatttcctattatggatgacaagtgtaaattcatatcttaataattacccacactccaaaacactactacaggcaaaggcaagagaaaggcaggtatagatgagattctctgaggtcagttatgtaaatacccaaggactattgtctatgaccttgaatgtcactttcttcccttccatgagctacatccaggatattctgtgaatctgagagcgttgagcatgtttaattattttatctcactgccccttagtcttgctttctccagttgacaaccaaatctctcaacaataggcccagcgtaaatcaccagacttcaattattgtagaactatggtttcccaacaacattatgagttacaaaatgatactactttatggcagcagtgaaaatgatgaacttccactaacttatgaatctctgaatggctagcatggaggtgtgtatgtatcagcgcactgttctagaaatgttccgtttctgtccattattttatgtagtaatgaggacaacgtgaactaaagggagtatccatggccttataagcacagagaccacatccagtgcaggtgcagagcaaggctgcaacagtcagcaagttgctctctgaagagtcttccaattcccttgcccaaagcatctgctcattcatgggctgagaaaagggaagtcatgcatgcagtctactctctctacagagctgacaggggacacggacaacatcgattattcatggaattttcccataggaatgcagctgtgtgcacacacacataatacatttttaaatgttttttttatttatcctctccaattttaaaaaagtcatcaccttttctcctaatcaaagaggattttgaccagaatgcttggtgggagccccctgctctcccagatgcccacccttatttctcttgaagtgaagaacggcagctctcttgatttctactctcatcctctaggactaaaaccagaaggttccacgccccctgggtgaacatccaagaagaccctgtctgtagcagcaggagcctcaagccttgactgagagctatggtcctgaaatgagacagtgtcccccatggagagcacacgtggacgcccacaactgagggctcactgctcttcaccacagatgcgctcccttactgagtcctgagacctgagtgcaccccatagggtagggctcagaagaggggatgcaaatctccaccagctccacccttctctgtgttgaaaagccgagcatggggacctagttcagtgactcctgtgccccaccacatggagctttactccacgcttctcctgctgactgtcccttcctgtgagttcagtggtcagggaatccttcaggggtgaaacacctgttcttttctttgtgggcttcatcttcttatgctttctccacaggggtcttatcccaggtcaccttgaaggagtctggtcctgcactggtgaaacccacacagaccctcatgctgacctgcaccttctctgggttctcactcagcacttctggaatgggtgtgggttagatctgtcagccctcagcaaaggccctggagtggcttgcacacatttattagaatgataataaatactacagcccatctctgaagagtaggctcattatctccaaggacacctccaagaatgaagtggttctaacagtgatcaacatggacattgtggacacagccacacattactgtgcaaggagaccacagagacagagcccagggtgcctcttgtacaagaacccaggctgcttctcagtggcgctccctccccacctctgcagaacaggaaagtgtggctgagatgccatttcctgtcagggtctgggtgtcttatcctatctgactcagagccttgtcttcctccctcttctttagtaataaatggcatgacccctgttagtggttcatgcaagcagaggctgtatcctgtttgacaaagattcagcatgaaaggttcctgttacttgagccagatgcatcactgatatgtggccaccagtttcttagactcataccactttaagggaccaaatacaaatgtccatagcatatgccattcttaaactgcagaaatgatgtcaaagaagaatgtggagataagagagcaggaggaattatgaaaatctggatagcatcttctcttctagggtggaaggtatgctagtaaagtaatttaatgaaacaatcagacagatgcaatatgtcctcatcatggagtgtctcacatgggcagtgcacaaataaatttctaaaaattccataaggtagatgtgatggatgaggcttatttccacacagggagcccacaaatatccagagaagtaaaaaatctgacacttggaaagaaaattgcctcatcttgacatcagaaacccatttcaacatgtccgaggggcaatgtggaaaagaaatggaaacttcaaaaacacatttcttatgaaatgtctagctcatgtttgaacataaaaacagaattgtccatgattttagaaaaaccaacccatgacagcgagtcactacactcagaaacaccactgagtcaacagacttcagtctgtgagcaggtcagtactgaggccccaggtgaatcaaggctctcacgtacattgtacagaacccagaattgagccacacaatctataaccaagtcttctttgacaaactttacaaaaattaacaaaaaaatacaccagagaaattcaatatatgaaattcaatatacccattcaatatatggtgctggggaaattggttagccacgtgcagaagaacaaaactagacccccaccctcaacacatatatactcaacacaaaatgaattaaagacttacatataagacctcaaactataaatctactcaaacaaaacaccaggacaactcttctgggctttggcctaggtaaagaatttatgactaagaccccaaaagcaaatccaagaaaaaaatagacaaatgggacttaattaacctaaagcatttttcacagcaccggagtgaacagacaagttgcagagcgaaagaaaatttttccacaccacacctgtgacagggaactaatatgaagaatttgcaaggaactcaaactactctacaacaacaacagcaacaagaaccaaataactccgttaaaattagcagaggacatgagtagacattttcaaaagaacacataaaaatggataataaatatataaactacgctcaacatcactcatcatcagggaaatgcaaattaaaaccacaataagatatcatcttccaccagtcacaatgactattactaaaaactcaaaaatatcagatgttggtgaagatggaaaggaaagggaactcttagacactgttgatgaggatgtggatgaggacaacttctatggaaaatggtatggagatttcccaaaaaactagaaatagaactcccctttgatccagcaatcccactactgggtttactacccaaaggaaaataattttttatttccaaaagatatccacacttctatgtttatcacaaaactattatcaacagcacatatgtcaacctgagtgtccaccaacagatgattttataaaagaatatagcatatatgcacaattcaatactagtcagccacaataaggaatgaaactgtcttttgcagcaatatgcatagaactggaagacaacataattagtgacctaactcacaaacagagagtcacatgtcacatgttattatttataagtggaaggtaacaacgtgtccacaaggatatggagagagaaatgatggacaccagagacttagaaggatgggaggtggaaggtgggagcatgaggagacattacctagtgggtacaatgtacattatttgggtgatagtacactaaaagccaagaccactatggaatatagccatgtccaaaagtggcattcgtagtccttaagtttatacaagtaaatgtacacacaaataaaattaaaaatataaaataattaacagttgaccaatgatcttaaaagttgatttaaaatataatcaataaatgaaatgaatatcagttgaacctcattaaatttgaaaacgttttatactcaaatgactataagaaaatgaatgtcaagtttcagatgagaaactgtttgcaaatcattagccaccaacataagtataataagaaccctcagaactcaactgtgaaaaaaagaaacaacccatggatagaataggcaaaggtttgtgcagacatttcatcaaataagatgtacagatgacacataggcatataaatgggctcgcaacaggattttccattcgaaaaattcaaatcaagccgacagtgagacactactatacaatttttagaaattaagaagaaatacagataataccaatgctggtgagcatatcagggtccaagactctaaaacgttgcaaacaggaatgcaaaatgaaactgctactcaggaaaataatttatagttttttctaaaatcaaacattttcttaatatatgacctaaatatcccactcctgaatatttgtgtcagagaaatacaatcttagattcacaacaaacttccatttaaatgttcaatatattgtgctcacgtgtgtgtgtgcacgatagaaacaaaaagtaacatgaatgtctcaaaatttgaataggtaaaaagtaggaagtgtctattaattgaataccatcagcaataaaaaataacaaaatgactgatacacaaaccattacaggtgaactccagacatgatgctaagtgagagaagccagtctcaatgatcaaagggacacatctgtaagcaccacggtcatcctcaggtgtcagtggtttgggctgggctctctgtctctttcctgaccagacccagatgttgagctccgccacttgcagatggaaaattctactattttcaacaatgcactgaggtttgaactgcttcacagactgaacgaaacaaacacgggctcctttgaacagtgtgcagcatttgttccaaccacaagagaatgtctcccagctctgccccttctcagttttccctgcaagccagcagccctgcagtttagcctgcatctcccatgcatgcacccatctccttccaagggccttactccacaacctccacttattttgagtgcactgactggctttgaacttttccacattctgttgttattgaagttaggatgtttagagccatattaaggatcatattttatgactgaattccagtgccccctctctcctgggacagagcacgtaaccaacattctgcatgtggagacaaagatgagcttttttcttcctcagcctaggagatgagcgctcagtggagggttggatagaagcttcccaccttctcagcactccagttctggtggggagaacctctgccataggagcagagctagaaaccagggaccgaatgttcccagtgacactggacccagggtagagcctccatccacgagtggggctccatggaagaagcgagtctctggctctcagtagcttttgtccagaactgagccttaggatcgtgtactgtgggcagagtcagagggccaatgtcctggctcctggggaacagtttcctctgaagggagctgggtagaaggtgtcctgtcttcttggctacatctgtttgcagtggagtttacatcatgctgagttgggatgtggaaggaaggaggagcatcttagatcaattatgatggctagacttactgaattttgtagattttcttgaataaatgtttcttcacttgctgtatgctgtgagagcctttccaaaccctgtattttttcaaaataattttcactggtctcatgagggcatggattcattgagcccctcatgctatcaaagagaaatagaactttttttgttcactttttagagaacatccatgggttataaaacaatgggttgacttctcttccaaaactttacagataccgtcaattttcctcttgcttgtaaggttttatccagaagaatgctgtcatcattttttctgcttttttggaaggaatgccccttctactcacctcaaattgcctgcatgtatttctatttttctttggttttcagcagttttaataagatttagctaaatgtgtgtggggggagcagggagtgtcattctgctgttctgtgttctctgagatgcatggattcacggtttactctgtctccattttggggaacacaattagaaaaaatgtcagtgtgagcccagaaacaagcctccctgaagtgggcagaggaccacctgggggcgctcaggacccactgagcacaagagccagccccagggcaggtgcagacgggggttaagatctggtttcccgtcagccctgtggcttcctctccataaaacagttccctcgggggcacgtctctggattccttatcttgttcttactgtgaagtctctgaagaataaacatttgttgtaacaagagaaaaattttctcccatgcaccaaaggcagagtcacctacagtcaattagtcctgtttctcaatgttaataaactatcaatgtttctgaaggtacattgtacagaacccagaattcagccacacaatgtatagccaagtgatattgacaaacttaacaaaatatacaccagggaaaggacgtcccattcaataaatggtacttgggaaaatggatagaaacatgcagaagaacaaaactagatccccaccctcaacacattagtcaggtctctaaaatgcaggagtacatatctaaaatttattattttattgtgcatttttacgtgttccagaaggtgggagaaatttctttctgtgaagagcatcccaaagtcaggcactcctctagaacacgtgtttaatccttgtctttggcttattgatgagctctgttggctgcaataacttctgccatccgggctgactttgcatcatgtagaggagcaaattctgaatgaaagtttgcactactcaattgagtgcataacctacagttttgttactgatgtatgattcatcagagatgatatcagatcaaggatttcaatgagaatctaatctaaaagatgtaaacaaattttcctaatttagataaaattactgtgagcacactgctagtattcagccatgtctcctatcacattgaatctacactaagtttgacctaaaagctagcacttgttctcatgttccaatatgttatttttattttaatgtattcagattactatgtgttgctattttacccaaagtgaaggaaagcaattttaactgactgaaaatgagaaaaagcacaacctaatgaaatggaagtcaggacatgagtgtctccagccttgtctatttcaaaaattcacgtacgcagggggatttctttcctcaattttacacagagaaacttccaaaatgtttgtttcctctcccatggactctatcatcagtttctatgtcagtttgcttagaattttggcctccagctccaaccaatttggtgcaaaaacatgatttcattcttttttatagctgcagagtattgcactgtgtataagtaccatgttttctttatgcagtctataactgatgggcgtctaggttgattccctgtattaggtaatgtgaattgcacagagataaacacatgagtggatgtgtctttgtgttacaatgattggttttctcttgggcatatacccagtaatgagattgctgaggggaatagtagctctgttttaagttctttgagaaatctctagactgactgaattgttttctctgtgaatggtgataattatgtcaatatttgtcaaattttgaatgtattgtttgaagattgttatttgtcaatattacctcattaaaactattaaaaatggaagtgtataatttggtagaaaaggattaaaagaaagataaaaataatacaagaaaagtcacagactcctgaatccacatgtgaattagcactcagtttttctatattatttataaaaacactaagatacagccaaataatatcatgatatccttataagaagagtgtttcgtaaacctcactgggaatttctagctctgtcctagagttaatttagggagcagtcggatccagtcctgagcaacacaggccagacactgagacttaccacatcttaccagatgtgagctcttagacacgtcacatggcctctccatgcttgggggtttaccttcacatctgtaaatgaaggaaacattgactgccacagaacatacttcatgtgcatctatacagtagaaatgctaataagaattaattgtttatgaagtgtaatcactctgggacacagcccactcagaggcatcccttccagaacccgctatatagtaggagacatgcaaatagggccctccctctgctgatgaaaaccagcccagccctgaccctgcagctctgggagaggagccccagccctgagattcccaggtgtttccattcagtgatcagcactgaacacagaggactcaccatggagttgggactgagctggattttccttttggctattttaaaaggtgattcatggagaaatagagagattgagtgtgagtggacatgagtggatttgtgtggcagtttctgaccttggtgtctctgtgtttgcaggtgtccagtgtgaagtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattagttggaatagtggtagcataggctatgcggactctgtgaagggccgattcaccatctccagagacaacgccaagaactccctgtatctgcaaatgaacagtctgagagctgaggacacggccttgtattactgtgcaaaagatacacagtgaggggaagtcagcgagagcccagacaaaaacctcctgcaggaagacaggaggggcctgggctgcagagggcactcaagacacactgaaaacacggttaacactgggacaagttgctcaggaaggttaagggctggtttcctttcagagtctttgctgtttctgtatctaacagtttccccaggaaccctgtctagatttgcgatcttgatctgcttaaactgtctctgtgtcatttttcttacctgtgactttaggggagctgatcgtggacactccagtgtgtggagatttcctggtgacagcaattgtgtgttctgtctaagcatgtctagggccggtcatcaggaaggacaggaaggacaggctggaattcttggaaacagctgcacctgccatccaccagggaactttattgtcttctgttctgctaaaattaaatcaggcacaccaagtttaactagcactatcttcctagcttaagaaaattgatggcaggtttcaataacacctatattaaaccttcagagcaacacctacattagtgtctgatttgataattgagactatgttctagccaagcagacacataaaactggtgattgccatgcttagttcatatttcatatttatcaatagaatctggctggtgttataaacagatttgccaacacatgtgtgttagtgtttgtcttcggagaggcacattctatgactggattaagtttgtgtacaggttcctaaggaacctgttcatgcttttgagaggaaatgcagagggggtggaaggcggctggggaagctgaaggtatacgagggaagtcagtccctgagtgaaggagagagggaggagaactgggtagaactttcctaaacttctgtgctggtctaggaaggtccagcaagatcactgagtcagattcgtgtcaaagtttcccatcggggacccccgtgactcccagcagtggctctgctcagatcagcacagagctcgttcttctcctgagagtggagcagaggatgtggctccagcaccagccatggcatggacgtcagagagcagccccaggcacctgagtcgggtgcattgtgccccctgcaggtggacggagggaggtgctgactcagggcccacacgctgtgggttctatacagaacacacacttttacttcatttctgtggatgacatagaaacaaacatgcagtctattaacagcggtgattcctacatttgccccaattgctttattccttgattccgcagaatatcctgacgcagaattgtctttctctcgtggaattgcgacgtgtttaggacgtgtgttccccactttcagtgttctgctccatgaacagagatcctgagtagagtacagctgaccctccttccacactgttcctctcctccccacaggaagagcagataattacctgaggctgaatctgaggtgggatctgtcctctgaacctcagagcctgcagagacccccggctgcagattcatggagtcaggtgtttgtacatgtgggaaacttgagctgttcttttgtcagtgaacactccttagaactaattgtgggttcagaattaggacacccattgatctatcacacctcagctcattctgccactcagaatctccagaaattcaggaaatggttcaatttacatgtttgtgacacattgttctcatttcatttagttgtgagtttggtcagcaaaagtgctaccatttatgtgtcccaacctgatgaagctaacttgcttcaccagatgttgggagctcctgaattttatcctaagcccctctctctccacttcatgtgaaattcggtttgacctggaattctggtgtgttgatttagccagatttccccatactgagtgtctgattttcctggatatctgatcagtttccttgtccttcaccataacttgggtgacatctgatcaccctgggctaacttcaacaaaaatcctggcaggttgccttaagcaggatttacctcactcctgatgtttcttcttgattttccatcctttgccccaaccctgctgcatgcctataaatccccacgttctcactctgtatttggagttctgctgaatctctccctcattgcaaaatcccactgccctggtccctacacctatcatgagggccctggataaagtcttccttactgtgctgtagaaagtgtctttgtatatacattttttctttaacaaatctgcctttagtatttcctaattgatcaaggaacctcaaacattgaatgaaagtgaggttttccattttactaacatatgtgtatctgtgaatttcaatttcaatgtgtggtgtccagaagtcctgagcaccaacagttgtgcttctctgtccaattatttgattctgaaacctgggagtcatcccaacacaggtaaatatgtgattttttttttttttttggtttttactgtttagtgactgacttatttcacttacactgaagcttcatgaacacaatgatgaaaagtagagagaggacttgtttgaaaatgccagatttatggtagactttaccacccacgtgtgtctggaggtcttcttaaggttccaagaacaggacatttttcccacaacaagacaaggatgagaacctctgagctgtgaggatggaggacaggcagggccatgtgtggacaaggacgggctgctgctatgtccagggtgttctctactagcaaccactccatctccttcctcactctgtggtatttgtcagatgggaaacatgcctagaatttatctttgacatctggatggaagcccaggcaagaggcatttgacagcttattcgtgagcctacttctttaaggaatgccagatcccttgctctccttcctagttcttaacccctttaactcccttcccctcctgcacccatccactgcctatttacagccacgtccccacacccttcactgtagcaccattttcttgggctcctgggaaacacaacagctttggtttaactcacagctcaggcacactcacgggtcctttcagaggctctcaacttccctcctacagtccctcagctcctcctggggtcctaacttggccatctctatcctctctgctgagcctggccatacacaatccatcccatctggatatgtgtatagcagtgggttaactcagcaggcatgaatagttcaaaccctccacgttcctaaaaaggtaaataactaaaaaataaaaacaaaagtaaacctttgttcatttatggctgtctgttacctcctgggatgagatctccgagtccatgaaatcttacacctgataaaagtgtctgcagatgtctgcagccttgggacatgctgtacgagtttaatcacagtgatttatagtgaacgcctgcttttgttttgctggggagggctgtggtctgagtattgtggtcagttacccaggtgttccatagtctatgattcattccccaaacacagccctggacaagaaaactcaggggcactcccctgggtgttgacacttcacacatgtcatcttacctcatagctggagcattacacatgtgcagaaggctccacagtgggaggacccctgagagcttgtgcctggattctcctgagcttcactctttgtgccttttttttccatgtattttcaattgtatcattttgctgtaataaactgttcctgtgaatacgagttttcatgagtcctgtgtttttactgagttttgagcctgagggtggcagatgcaacttctcaatgcagttgtatcagaagaaggatttcctagagagatcctaagtgacacatggctgaagtattgttcagaaaacataagtattcaggtgtggaatggcaaaatctgatacttgggtggcaacagaattacccggtctgagacagcagctgaactgaagtagatgtctggagataaatgcaatttagaaacgataactcatactcccaaagagctggctcaatcgatacataaggaaaaataaaatgataaaaaataacctaaatatgcaattactatttgtgagaacatccgggagagtgattgcagggaaagtggcctgcgccgacctcagattttggccaatgtcatttctggctgatgggctccagggcactacctaagggagcaattatgctgcaatgacagacagaagcttcgcaagctctctccacccagaaggtggttcaggtggtgaagtgcggggactggtgagccacaaaacactgaaatgagggaggaaagtgagaaagtgaaaggcttttgagctttttctttagcttaataatttttgttaattattaacaaaataattggacaatgactaatgtaaaagtggaccgtgttttgagtcccttagaacggaggagaatgcagcggtcaatgttgtgcccagagattactatagaacaatagtaggtggttgaacatgctccaaacacaaagcctcttgttgctgatgggacagctgccctcgtctactgcacaacagcttctccaaagtgtgtttaccctgagcattgagattgcctttctcttgtaagtgaaaaaatcggaaaactccaaataaaggaggagttgtaacgctctatgtgtaagaaattctaatgtggatttatgataactgggatatgcatccacttatctttttatctgtaaaaattcatgggtgaaagtgcaattttgttacatggatatattgttcagtgatgaagtctgggctttgaggagagtcatcatctggatggtgtatattgtacccagcaagtaatttctcatcccacacaccactcccaccatccaaaccttccaagtttccaatatttattatgccacactctatattcatgtgtgcacattatttagttcttacttatatatgacatgtggtattcaactttattcttctgagttatttaacttaagatagcagcctacagtttcatccatgatactgtaaaatacataatttcattttttattattgagtagtaattaaatgtgtgtatatatattcacaaatatatataatgtatttgtgagggtgtgtatgtgtgtatatatgtgcatatatacatatacaacatgttttctttatccaatcattcattaaaaacacttagtttggtaccgcatatgtgctattgtgaataaggcaacagcaaacataaatgcagcatctatcgaatataaaattcatttttctttgagtcgataccaagtagtggatttgccgaattaaatattagttccatttaataagagaacttaccaacatctgtttcttgtttagtttagtttttatttttgactttttaataatagttattctgactggtttaatatggcttctcgttttgacttcaaattgcatttctgtgatgattaatgacattgattgttttttcatatcctggttgatgatttttatggcctcttttgaaaaataaatgtctgatatttgctcactttttaatgtggctatttgtgctttttgtgttgctttagtttcttgtagattccaaatattagctctttgtcagatgtagtgtttaaaaatatttttcgtcattctgtaggttttctgttaactttgttgattatttattttgctgatcagatgttttgcttcttatttgtattaagtccaaataacctattttggtttagttgtgtttacttttaaggtcatagtcatgaattctttgcctagcacaatgttcagaaaaacacttcctaggatttcatttatgactttcagactctcaggcctcccagtcaagtcttttatccatattggtgtaatgtttgtatgtagtgagacatatgggtccagttttattcttctgcaaatagctgttcagtttttcctgcacaatttattgaacaaggtgacattttcccagggtatgctttttgtctggttggtcacagtcagttggctgcaggcacatgactgtatttctggaatgtctattctgttccaagtatctatggttctctggttgattgttacttgtgtataaaaatcctactggcttttgtatgcttttttatcctttattctaaaacttcactgaattaattcatcaattctaggagtacttctaaagaatattagtttttaagtacaaaatcatattgtcagcaaacacacacaaaaaactgacttcttcttttccaatttgggtgcctttatttctttctggtgtcttatttctctggctaggatttcaagttctatattgattaagagtggtgaaagtgggcatccttgacgtgttctgagtcttaggaggaatactttcaacatattgctactcagtataatgttgtatgtgagtttgtcatatatgatttttattaatttgaggtatgttttccttctattctaattttgttgagggttttttatcataaagaaatcctaaatgttatcaaatttttttttctggacctattgacatgattatatgttttttgtttatgtggtggatcacagttattgagacatgaacgttgaactatccttgcatccctgaaatgaaacttagcagattgtagcatattatctttttgatatgtagttggacttgattttcttgtgtcttgttgaggatttttccatctatagtcatcagtgatattgatctgtagtattcatttttgggtccttgcatggatgtggtatcaggctattagtggctttgtagaatgagttagggagaaaaaccctctcctcgtttttttggaaaaagtttcagtagaattactagcagatctttttgtatattggacagaattcaccttttaaaataatatgctttacggctttgatgttgagatttttttaaattactgcttcgatgtcactaatttttgttggtcctttcaggatttttatttcttcctatttcaatcttgggagattatatatttccagacatttatctattcaccctaaattttctagtttatgagcctggagatgttcatagtagactatgttgatcattatatttctatggcatcagttgtaatcttttcttttttgtttctcattctgcttatttaaattgtctgtctactttacttgcctaatctagctagtggtctgtaagttttgtttatcatctcaaaaacccaatgttttattgtattggttctttgtatttcttggttcttaactttatctagttctgctctggtctttgttatttgttttcttctgctgtgtgtttggtttgatgttgtttttctagttatttgatacgtaatgttaggttgttaatttgtgatctttctttttgatgtggtcatttaacattataatcttatcccttagcacagcttttgctgtaaaccagaggttttggtatgctgtttctctatttttattcatttcacaacatgttacaatctttttaaattttatcattgacccaaagttcattcagttgcaggttgttaaattttcattgtgtgtgtagtcttgaatattcttctagggtttgatttctggctttatattactgtggtctgagaagatatttcatttttaaaaagttattgagtcttttatttctggcatagtatataatccatgtttgaaaatattccttgctaatgggaataatgtatattctgcagtcattaggttaaatgttctgttaatgtctgttaggttcatttggtctagagtccaatttaagtctagtgtttctttgttgattttctgtcttaatgttttgcctagtattatcatttgggcattgaaatccatcacaattgtattgttacctgtgttcttccttaggtctaatagtatttgttttatgaacatgggttttctggtgcagagtgcatatatatttagaattgtcatttttaatcaatcattttatcattatataatgactttctttgtctttacttactggtgtttatttaaagtttttttatatgatatagatagtcttgcttgcttttggtttccaattgcatgaaatatattttttcaccctcttgatcttgaatctacgtatttttaccaattaagtgagtttcctgtcagcagcataaatttcaaaactcttttttattctttccactaatctatatattttaggtgaagaatttaactcatttatattcaaacttaatacagatatgtgaggtctggcttctgttgtcatgttaattattaactagtggctttgtagtcttaattgtgtaatagttttatgagtgaattttataattttgtgttgtttatgatggtgagtactgacctattgcttccatgtctaggtctcccttgagcatttcttgtaggtgcggtctggtgtaaataaatgtccttggcattttcttaccttagaaatactttatttctccttcatttatgaagcttagtttagaaggatacaaaattaatttctgacatagaattttttctttttttttctttaagtagtctgaaattgggagtccaatctcttctatcttataactttatgctgagaagtacactgtcagcatgatagaatttcagataaattattagacacttttctattgtgaattttaggatttttttcttcctatttactttagatagtctgaggactatagatcttggtaatgtctgtcttccagtgtcttctcatgtagttttctgaaccacttttatctgcatatgcaaatatctagcaagactagtgatgttttcctcaattacttcatcaaattggtcctctaaaactttttactaattttctccctcaggaatatccatgattattggctaagttgttttacataatcctatacttcccaatgattttgttcatttttttgttattttcatctgactgggttaatgcgaaatatctgtctcttaggtttgatgttctttcttctttttagtgtagcccattgtgaaagttttaaactattttttgtaattaaaattcaatgaagtctttactccctgaagctttatttttaaaatattaaagtcttaagtaaatcttgaattgttctgatttttttttttttttttttgacacggagtctcatactgtcacccaggctggagtgcagtggcgcgatcttggctcactgcaacctctgcctcccgggttcatgcaattctccttccttagcgtcccgagtagctgggactacaggcacacaccatcacacccagctaattttttgtatattgagtagagacagggtttcactatgttggccagactggtctccaactcctgacctcgtgatctccgctccttggcctcccgaagtgctgggattacaggcataagccaccacgcccggcctgagttattctgatttatttgtgttggttctcaaatttcttttggatttaattgagattccttgaggtcaacattttgaattatttatctgacatttcaaatatatcatgttgtgtaaattctatttctggagagttaaggtgatatccggcgtcttgtaattgtgttttttcatacttccacaattgcttacctgcttgcttttcattggctaaactatctcttactgtttttgaattcattttgattttcatgaaaatttcattccctttagaatgtgaatataacgtatattatgtgggtcttttgatttggttcttggtttactcattggcaaaggctctgtaagagtttcttgtatatagatagtcattatttagtggctttctgaaactatggttgtagtaataatctactgggcctgtgagcaggctcactgcctcctgcaggccctaaatagtggaggcctcagaaaccatttcttatttgcaatgcacttgtttcagcacattttatattgggatgttaagttcacctacacattagtatgtgtccttacagatttgagctgactgtggtagaagcagatgagtacatgcttgatatctgtacacagggagaagctctctgttgcctcaggcgatggactggtctatgaagtgcacagtgacttgagttctctgatcagcccctgagtgggggatgaagctggacagagatgagccaccgagcctggcaagcaaaagcgccagccttgatggaaatggcgagctgaggggcatctactcagtgtggtttcttttgttattaagagctttagtgtggtggctttttcaaattcccgttgtagtagtaacatactgagcatgtgagcaggcccgcggtcttttgcggggttggaatcacagaagtattgagaagctaatctcattttcaactgctgtacactggtggtattgagtttgtatgaggtcatgcagtttgaacgtcaggccagtaggtggtgctcgcaggtaagagccggctatggtggcagcagaagggtttatgctttaccggtggttaaagtgggaaatttgtcatgttccagatcttagagaaaagacttttagctatttctcattcattataatgctgcctgaaagtctctcgaacataactttttattatgtcgagatgtgttctttctatacccattttttacattttttttcctgaaaggatgttgagtttcatcaaatgatttttcagcatcaattgaaaaaaactatatgtcgattaaagatctaaatgtaaaatctaaaactataaaaactctggataataacctaggaaatacaatttaggacattagaactggcaaagacattatgaagaaaatgcaattttaacaaaatcaaaaaatggcaaatgagccctaagtaaactaaagagcttctgcatagcaaaagatactatcaacagagcaaacaggcaacctaaagaatggaaaataaaatatttgcaatctatacatctgacagggtctaatatttatagcatacatgcaattaaacaaacatacaagaaaaaaagtgcccaaaggacatgaaaagacacttataaaaagacctacatgtggccaacaagcataggaaaaaatgctgactatcactatcattagagaaatacatattaaaaccacaatgaggtaccatctcacatcagtcagaatggctaatcttaaaaaaataataacagatgctgctaaggttgcaggaaaaagggaacatttatacacttctagtgcaagtataaattagttcaaccattgtggaaagcagtgccatgatccctccaataacctaaaacagaagtttcatttgacccaacaatcctacaactggacatatacctaaaggagtataaacgtataggttcattccagcactattcacaatagcatagacatggaatttacctaaatgcctgtcactggcataatggatagagaaaaatgtgatacatataaccatggaatactatgcagctaagaaaagaatgaaatcatgttctttgtaggaatatgatggaactggtagtcattactcttagaaaactaattcaggaacagaaaaccagatactatatgttctcacttattttttggagataaataatgagaaatattctctcagggcctgagtcttccatattcaaaaaaaaattctaaaataagtgttcaacaagttgccgacatgcctttaaatatcctgtttcatctggaccccttatatcactcaataaagccatgagaactatatttaaaagtgggattctatgataataaataacttaacagtaagaataggaaggatatggatggttttactaatttaatgggtacataactgtggtatacactatattcctatgaataagatattctgatttcagagctaagtattgtttcctacgttgtgtgtgtgacttggttgtgttggatttgagagtgtagcacgtgcacagaccatgtggatcagaaatccacatgtaaagatgacaatctatggatgtgaactacaagtatgtaagtacttcaagtaattctatttaatggagtttgaaataaaactcaaacttattcaaaacactaattacttggtatttattttgagatctatgagtttatcaagaaattcaaattcctatttctatttaaactcccgattcctactctcagtgggagggaaaactcacagccaatcacacatcacaggacaaatctgtaaacgaagagtcattcctctgaaggtcctgggtgttcaggactctcaggcaggtgctgaggaccctgtcttgggagtgcccagcagatctcagaaccctacatggggcctgctggacactcatgtgggataactagtcgccacttattcagagttaccagtgagctttgactgttccgaatgggaccagcatggagtcaaggtgcctgctcaatgtcagagacagcgatggtctcagaaacaatccaggtaatctctaggccaataaaatgtggattcacagtgagaagtacatcctggaggtggagcttgttcttcagtgggaagagtgctgtgcacagaaagcttagaaatggggaagggggtgcgtttcctcaggcaggattagggcttcgtccctcagcgtcccactcttgtatggctgatgtggcatctgtgttttctttctcatactagataaggctttgagctgtgaaataccctgcctcatgaatatgcaaataacctgagctcttctgaggtaaatataggtatattggtgccctgagagcatcactcaacaaccacatctgtcctctagagaaaaccctgtgagcacagctcctcaccatggactggacctggaggatcctcttcttggtggcagcagctacaagtaaggggcttcctagtctcaaagctgaggaacggatcctggttcagtcaaagaggattttattctctcctgtgttctctccacaggtgcccactcccaggtgcagctggtgcagtctggggctgaggtgaagaagcctggggcctcagtgaaggtctcctgcaaggcttctggatacaccttcaccagttatgatatcaactgggtgcgacaggccactggacaagggcttgagtggatgggatggatgaaccctaacagtggtaacacaggctatgcacagaagttccagggcagagtcaccatgaccaggaacacctccataagcacagcctacatggagctgagcagcctgagatctgaggacacggccgtgtattactgtgcgagaggcacagtgtgaaaaaccacatcctcagagagtcagaaaccctaggggagaaggcagctgtgctgggctgaggagatgacaggggttatcaggtttaaggcttttttgaaaatgggttatatatttgagaaaaaaataacaatagaaacaagtacacactctaattttaagagatatattcaattcaagaattgtagaagccgaattcacagtgggaaaggccacactcaataaagttgataaaaacattccaggaaggtgctactgtgaacaagttttcaaattagatgaataaataatttggagcaatgttatttgatcatgaggtgagacagtatgattcttaaaaagtggaaaaaattctttcaaatgtttctgccactctttatcataaaattaattttagagcagttttaggattacaatgaaattgcacagaaggcatgagaattcccatgactccctgccctacacaggcagagcctcctccactatgaccatccagcaccacagtcacaaatcagttacaatggaggaatctccaaggacatttgattctttcttttttggtgatgccctaatataacaagcctaatttatctcggaataccacaagttttgttcagtggatttctaggaatcatattagttagagggaaagttggtgaggctcttactatttgaactcattcttccaaaatccacaaaacatatattaatttaaagcttatcttacttctggtttacaggatccttcccagagagtaagatttttaagattttagaggcaggttcatgtctctaaaaggccagcaagttctggggaatcccataatgaacatcctttcatgggaattggagaccctggcaatgagagactccatgtataatgccctagagttggattagatgcactgtgagctcttgggtggtggttctgaaaaaggtggtctgtgcagtaaatgcaaacacatgcacgggacacaggaaggagcaaaagcttccctttacaaagtgtgtgggcacctggaagaaaccctcacaagggcacgtctcacccttaatgactgcacattagccaggggcatgatcatgattggtcttacaaggaaagagcaccactgaggtcataggttatgaaaatgtcatcctccagctgagaaattccatctgctggcatgtgcgtgtcaaccccgtggagggtgcactctgggagttgacgagatgcatagaaacctcctgtcatgaattatcgtctaccacacagtcagaatcaacctgtgctccagaaagagatacatgcctgtagaaataaacagagcttaaggattttcttacctgctgaatatagtgcccaaaaccacactttcaggaagattagctcagaaatgtttacaaagtgactgaagggcagtggcgggtgaggtgatgggacagcctcagggctgcacttgaggagggctccctctcccatgcaggcttttcctccaggagctgcatcaggaactcacagaggataagggagaattctgagaacatgctactgtggtactgcctagagaggaaggataaatgatgacaaatacatctctgagtaacatatgggcatttgttcatgaaaactgttttttctgaaagcttatgaaggtcttgaaatgcccctgattagctgaggacaaacatttaaaccctccttccacagggagttcaagcaggctggatgtgtcctgctatggatgatcttccccagccccttcctcttcccagctcatccctggctctctgtgtaaaaagttttcatcagtggaaggtggttgatgaagtgaggtcttcaatttcctcatcttctctgtggtcatgttattttcctcatctgaggtttaaaaactcacctgcatgcagcacatgacaggctaaaatctcttgtggacaaaacagtaacaaaggcacccaccatggttgagcacccgtgttgctgacagtgaccaccaagggtcaacgtcctcttcacaatcctgtgtcagagcagcacttgagtgatttcactagcaacttcccaggagaatcggcttaaaactacttgtcgcattttccatacagatataacacatctattttcctgaagaaatagaaagagctgaatgctgaatacactgtatgtctgctggttctgcaagtttgtgactatcactttctaatttctgatctgtgtggaccaccctccagatttttctcactggtgtgaccagccttctggatgtcaaatataattaactttttttcatataaaagtcaacacaagctcctcatggtttcggtgctcactgactactttaaacttacacaatatgtttctttattagttttgttttctggtatctctactcagcatcttcaacacacccatgttaagatgcttgtacaggtaattgttaattttaaatttactggtgtttagtttaattaaataggcaggcaatagcttagaatttagaaacaacaatgtaaaggaaaagtaaatgcaataaaatttaacataagaaaaccagcagctgaaaggaagggaaatctattctgccacctaagagggtatggtgacctcatagtacaacgaacttctgcagtttaatcgatactgctcacaagtgatagcattctctctctttatatcagagcattccctaacatgtacaataaagagtgagcagatacctccaaccagactgaccagtacctctccctgagtgcctcagctgatagagatagacatcacatttgtctaacaaaataattacaggctgtaaggatacccaccagtcatatggagataatttgaaaaacttagtcaaagcccaaaccttataggtagtcatttatacttagaagaattaactcttatcttcacatgtatttttcttaatcatagagaagctactagagtcactgtccaagttactgaatatcttattcctagaatgagacattgcacaatgtgttctgacatgagggaatgtagctatagttaaaggataggagatgtgatcacggaaacacgagtctgcgatccagcagttctttctccctcacatttgcccagaaacaaagaccccagcagaaaaatggaagggttgacttcagtctccaaagtatgatgtgagatatacgtcaggtatttcatgccattgttttatagtaggaaatttaatctctaaagaaggtcattttcaggataatactattctccaggatacttaaatgcccgaaaacagagagcgctacagtgcccagtgtccaggagctacctggcacgggtctggaaaccagtggacagaaatatcagtttctcttaccacatgtatgttggaaatttgaagaatgtttctttccttcttcgtaatcataggctgcaatggactggaggtcccagtacataagaggaaatgtgtctccagtaggaacacaattagtcccataaaataattgtgctcacactgtggtgcccacactgttggaccagctgactgagaaagtgttgtaagagctgcagtgtctactgattcctatcatatttggggctacattcgcagctaccaacggaaagagagagaagtaaaactggcttaggtagagtctatggatttgctttctttccttcaaactgaagtaaaaaaaaaaatcacatcaactaaaatggggacgatgatgaagtgatcaaggacaagagccactcagtgttttaggtgggttttaacctaaagtcccacaacatgtgagaacctgaactctggagtccggggcatctctggggagaatgtggaaggtgggcgggaggaaacagtgattcatgtctagggaaatttcagggctacctgctctgggggaaaggaaagcctgagcctctccgacagtgtcctctgttaaaattgttggctgacttattgtattcttcaacaccaatatttttttagtcctcttttaattttgtttttattattatactttaagttctagggtacatgtgcacaatgtgcaggttagttacatatgtatacatgtgccatgttggtgtgccgcacccattaactcgtcatttaacattaggtatatctcctaatgctatccctcccccctccccccacaccacaacagaccccagtgtgtgatgttccccttcctgtgtccatgtgttctcattgttcaattcccacctatgagtgagaacatgtggtgtttggttttttgtccttgcgatagtttgctgagaatgatggtttccagcttcatccatgtccctacaaaggacatgaactcatcattttttatggctgcataggattccatggtgcatatgtgccacattttcttaatccagtctatcattgttggacgtttggcttggttccaagtctttgctattgtgaatagtgacacaataaacatacatgtgcatgtgcctttatagcagcatgatttataatcctttgggtatatacccagtaatgggatggctgggtcaaatggtatttctagttctagatccctgaggaatcgccacactgtcttccacaatggttgaactaatttacagtcccaccaacagtgtaaaagtgttcctatttctccacatcctctccagcacctgttgtttcctgactttttaatgatcgccactgtaactggtgtgaggtggtatctcattgtggttttgatttgcatttctctgatggccagtgatgatgagcattttttcatgtgtctgttggctgcataaatgtcttcttttgagacgtgtctgttcatatccttcacccactttttgatggggttgtttgttttgttcttgtaaatttgtttgagttcattgtagattctggatattagccctttgtcagatgagtagattgcaaaaattttctcccattctgttggttgcctggtcactctgacgatagtttcttttgctgtgcaaaagctctttcgtttaattagatcccatttgtcaattctggcttttgttgccattgcttttgctgttttagacatgaagtccttgctcatgcctatgtcctgaatggtattgcctaggttttcttctagggtttttatggttttaggtctaacatttaagtctttaatccatcttgaattaattttcgtataaggtgtaaggaagagatccagtttcagctttcctcatatggctagccagtttttccagcaccatttattaaatagggaatcgtttccccatttcttgtttttgtcaggtttgtcaaagatcacatgcttgtagatatgcggcattatttctgagggctctgttctgttccattggtctatatctctgttttggtaccagtaccatgctgttttggttactgtaacctcgtagtatagtttgaagtcaggtagcgtgatgcctccagctttgttcttttggcttaggattgacttgacattgcaggctcttttttggttccatatgaactttaaagtagtttttcccaattctgtgaagaaagtcattggtagcttgatggggatgtcattgaatctataaattaccttgggcagtatggccattttcacaatgttgattcttcctacccatgagcatggaatgttcttccatttgtttgtatcatcttttatttcattgagcagtggtttgtagttctccttgaagaggtccttcacatcccttgtaagttggattcctaggtattttattctctttgaagcaattgtgaatgggagttcactcatgatttggctctctgtctgttattggtgtataagaatgcttgtgattttttcacattgattttgtatcccgagactttgctgaagttgcttatcagcttaaggagattttgggctgagacgatggggttttctagatacacaatcatgtcatctgcaaacagggacaatttgacttcctcttttcctagttgaataccctttatttccttctcctgcctgattgccctggccagaacttccaacactatgttgaataggagtggtgagagagggcatccctgtcttgtttcaattttcaaagggaattcttccagtttttgcccattcaatatgttattggctgtgggtttgtcatagatagctcttattattttgagatatgtcccatcaatacctaatttattgaagagtttttagtatgaagggttgctgaattttgtcaaaggccttttctgcatctatcgagataatcatatggtttttgtcgttggttctgtttatatgctggattatgtttattgatttgcatatgttgaaccagccttgcatcctagggatgaagcccacttgattatggtggataagctttttgatgtgctgctggatttggtttgccagtattctattgaggatttttgcatcgatgttcatcagggatattggtttaaaattctctttttttgttgtgtctctgccaggctttggtatcaggatgatgctggcctcataaaatgagttggggaggattccctctttttctattgattggaatagtttcagaaggaatgctaccagctcctccttgcacctctggtagaatttggctgtgaatccgtctggtcctggacttttttaggcaggaatttccttgtcctaataagcccaggagtgctacaggagaccagggcttatttcatccctcagcggcgaccgtaaaagacagccatcccgaaagcagccatttcagaggcctcccctcagggatgcattctctttctcagggatgttccttgctgagaaaaagaattcagtgatatttctcccatttgcttttgaaagaacagaaatatggctctgttccacctggctcaccagcagtcagagtttagggttatctcccttgttgcctgaacattgctgttattctgttcttttttcaaagtgcccagatttcatattgttcaaacctacatgctctacaaacaatttgtgcagttaacgcaatcatcacagggtcctgaggctacatacgtcctcctcagtttacaaagattatgggattaagagactaaagtaaagacaggcataggaaatcacaagggcattgattggggaagtgataagtgtccatgaaatcttcacaatttatgttcagagattgcagtaaagacaggcataagaaattataaaaggattaatttggggaactaataaatgtccatgaaatcttcacaatttatgttcttctgccatggcttcagccagtccctccgtttggggtccctgacttcccacaacagtttattaactttgtatgactaataatgtaaaatgttccccatatttttagcaatgttttacttatttgtgaaaggtgtgtttattaatttttcattttaaggtgtcacatttatctttcttgtttctgggatttcattctagtagatatagctgaatgcattttaacaattattgtaatcatctcacattttatatttggatttgcatatacattttattaagattttgattttgatataaaatattttcttacaattgtctcttttctatttttatgagataaaattaatgtatgcataattgcatacatcttcaatgtacagtttcagggtttctgacatatgtgcacacatttgtctccagcacctaagttaggatgaggagcaggtcagtctccacaacaagtgtcctcttcagtgcttccagtcagctctcacataaggatttttatttaatttcaagttttcattttcactaatcatcagagaaatgcaaatagaaaaacgttctggtttctgtcactacagttcaattttttcctgttttgggcatcacataaatggaatcaaatgttatagttcattttttgtaaggggctacttttgctatttgtgaggttcattcatgtatttgcatctaccaaggttttgtcatcatatatatacacacacacacttatatatgtactaatgcacatataggtatttcatatctcaatcagtccattacgttaataaatgacagtttattaagtaaatccattcattaagtgaataagtgacaaaaaatatatctattttcctgttgatggaatttagtttccaaaataaatatcgtaaacacatctgttataaatatctttgtacaagttcttctgcttatatctcccatttttattgataaaatatgtataaatataagtatgcattataacttttcagctttatggagctataactgacaaataaaattgtatgaatttaaggtacaccacttgaggtattgatatacatggggaaatattcatcgtgatcaaagtaattggcatgcctatcatctcagagaatatcattttatgcctttaatttattgtgagtctgtgatgaaaacacctaagatctactcttctggaaacagataagtttataatataatattcattagtatagttacattgctgtatgtttcatctccagaactccttcaacctgtgtatcagtccattctcaaactactttagagaactacctgagactgggaaatacatgaagagaagggagttagttcactcacagttctgcaggcttagcaggaacttatagggaggcatcaggaaaattacgatgattgtggaaagtgaaggggaagcaaggaccgtcttcacatgctggcaggggagagagagaaagagcaaggggagatgcgccacacttttaaacctcaagatcttgtgagaactctaacacaagaagagcaaaggggaaagccgcctccatgattcagtcactccccatcagacccctcctacaacacttgaggatgaaaatttgacatgagatttgggtggaaacgctgagccaaacagtatcattatacccggccactcacaaatctcatatccctctcacattgcaaaatataattatcccttctcaacagtctcccagtcttcactcaattcagcattaacacaaacttctacagtccaaagtctcctctgagacaaggtaagtttcttggatgtataaccctgtaaaataaaaaacaagttagttacttccaagctaatatgagatgaatgcactgggtaaatgttcccattctaaatgggagaaattggccactacaaatgggctacaggccccatggctagtccaaacactagcagggcagtcatcaaatcttaaagctccaaaaaaatttccttttactccatgtctcacatccaggacacgttgatataagaggtgatctcccaaggcctttggaagctccacccttgtggctctgcatgttagactccccatagctgctttcataggctggcattgagttgctatgtcttttccaggcacaccatacaagctgctggtggttctaccattctggggtctgaaggacagtggtcctcttctcacagatccactagacagtgcccaagtggggactctgtgtgtggaatccaacaccatattttccttctacactggcctagtagaggtactccattagagctcagcccctgcatgagacttctgcctggatatccaggcattatcatacatcatctgaaatctaggaggaggttcccaaacctcaactcttgcctcatgtgcaccagcaggctcaacaccacgtggaagcaaccaaagcttagggcttgcaccctctggagcaatggcctgagctggaccttgaccccttttagccatggctggcacaggacagacagggatgcaaggcgccatgtcccgaggctgcacagagcagtggcgtcctgggcttggacaaagaaaccatttttctctcctgggcttctggacctgtgatgggaggggctgccacaaagatctctgaaatgccctgcggacattttttcccaccggggtccttgttacttatgcaaatttctgcagccagtttgaatttctccccataaaatgaggttttttgtctaccacatggtcaggctacaatgttttatcaaacttttatgctccgcttcccttttaaacgtaagttccaatttcagaccatctctttatgaatgcacatggcttatgttttcagaaacagccaggtcaactcttcaatgctttggtgcttagaaatttcttctgccagatataccttaaattatgtctctgtagctcaacatttcacagatctctagggtagggggaaaatgccactagtctttttgctaaagcatagcaagtgtgaccttcactccagttcgcaataagttcttcaccttcatctgacaccacctcagactggacttcattgcccatatcactatcagcattttggtaaaacccattcaacgagcctctaggcagtttcaaacttttccacatcttcctgtcttcttgtgagcactccaagcttttccaacctctgcccattacccagttacaaagtcacttccacattttcaggtatcttaatagcagtatcccactcctggtgcaagttttctgtattagtccattttcacattgctataaagactacctcagactgggtaatttatgaagagaagagttttagttaactctcagctctgcccgctaaacgggaagcattattgggaggcatcaggacgaacaatgatggtggaaggtgaacgggaagcaagaaccttcttcacatggtggcaggagagagagagcaagtgagcggggaggtgccacacttttaaaccatcagatctcttgagaactttatcacgagaacagcgaagaggaagacaatcccatgaccaaatcactttatcttaggcccttccttcaacatgcagggtctacaatctggcatgagatttgagtcggaacacggagccaaaccatatcaaccttcataacgggaagtttttaccctttgaccaacaatacccaattttttcctcctcccagcccctgcgacctactattctactctgcttccaagagcttgaatattttatactttagattctatatataaatgagatcatgcagcttttgtctttctgtgtctggcttattccacttagcataatgttttctatttgttgcaaatataagaatttctttgtttttaaaggctgaataatactcagttttatgtaggtataagccacattttatctgttcattcgtagatggacattgactcgttttccttatctagactattatgaataatctcacaatggacatagatttgtcacactcagtttattttctctagatgtatgctcagaagtggggatgctctatgtccagttcactgagtaatcttcatgttgtttttcatactggctgtaataattcacattttgttccaaaccatacatggatacctttgtaccacatattcaggtctttgtgtaactcttgaatccatttttagctgatttctgtgtattgtgtgaggtgagttctatctatttcttctgcatatggatgcccgtttttcacaccactcgttgaagagactgtcctttctctactgtgtgtcttgggaacttgacaaagatcagtttattaggaagaaatgggttggtttccaggttgtgtttaatgttccattggattatatgtctgtttaaatgccagcattataccattttgatttatatagatttgattttgaaattatagattatgatatattcagctttgttatttatgcccaaaattactttggctatttgaagtcttttatatttttatataaattggagctttttaaaaacattttgtaaaatcatgccatggagattatttatttattttattggcatatagtagatatacctattttatgggaacatgtaatatattgatacatttataaatgtgtaaagattagtgtaagatttacatatctgtcacattaaaaatgtaccctttccttgtgctgagcacatttgaatgactcctttcgctattttaatgttgtgcattagattattattaactatagtgaccttactgatctatcaaacatttaggtcttatttctcctctataaatgtatatttgtatacagtaatcaacctctccttatctccttctctcttctatccatccaggattctggtaagcaacagtctattctatcttcaggcgatccagtattttagttttgatgtaaaataagaagatgcaatatttgtctctcttttattggcttatttatcttaacataatgacttccagttccattcatattatagcaaatgacagaatattgggtttcatggctgaataatatcctatcgcatacatagattacatttactctatccatttgtccacctacagacactgaggtgctttcacatctgggctattgtgaaagagctgcaaagaacatgggaggggacatgccttcatgaggtggtggtggttttatcttctttagaacatacccagaagaggatttgccaagtcataaggtatttctgtttttaatttattttggaatcttcatactactttgcacatagtggaaacacaaatggagtaaacattaaaaaagcagtttcggttttgatgtataatccagaaacaaataatgtttgaccatgattctcattaggagtctctaatggatctggtggaaatgcaggaagttttctaaccttgttcaggaaattatgagtttgcacctttttctttttgaggcttgaaattggcatgattcatgatgcatactgttgggaggtttcagaatgatatggcaaaaatcataatgaaaaggcaagacagagagagagggagagagagagagtcaggcctagaaagagaaaaaataattttctcaacaggagaaagtgctggatatctgtatcagtgttgagttttgctcatagacacatctgtaccgagtgaggaaccatgaagtcaagggaggggtctagaacttgttcaagtgaagcatcagcatatttctcacaggcaccaatttccaccacatcacaagggtgatgcatttttgaatgccattaaatatgagttcacagtcagtaatcatgtttccatgaaattcagttaaaataccaagggtgtgtccagatcactcatgcacaaatacacaaaatttgctttttcatgtgtggctatctagagacaaagtgcactgaggagacttcagcaggttacagagatttgcttaagtttggaaaaccatagaagagtgcctttaagtgaaggttggtatataaattaaataggtcaaaatcccctctatggagtagcgttccaattgtgtggaatttttaattccttattcagttgtaaaacataatccctaggactgactccgtggagttttactgctgtgttgacaaaaatatctaacaagcttccttccagtgtttcaagggaagtttttctctaaattttttccaatgtataaattttcctggctaaagatagtaaaaggctgttaaaaacacaactggaatggcagctttaatcttttgctgattgataggagtgagcataatacatgaatctctttgagtgttctgcctcatccaaatacaataggtcaaaggctagtactggaggtaagatttccaaatgtgtttttttccagctaccaagtcataggaaaataacagatacatccttgagacagaggaccataatgccacaatgctggtaggagtacatgtagacaagggagttcaagggtttcttaaaactgataattttaatgtaagaataccattcttttaaacttatgtggaagactgtgggaggttataacaatgccatattttagtatcagccctgcctcacagaatcattttataacagttcctttcatgagtgtgcttcactcggttcatgcaaaaacctggcagatcacaggctaaaaacagaaaatatagaagcttttaatcaactgaaagagctgtagcctttgtcaaggaattattggaagacacagagaacacagatagatgataaataaaatacattcatatcccgttaagtgtggaaattgaggaaagtttacataaatgtgtccaagtggcaaactgtttatttaatctggtaaccaatttttctataaattgtagagttgaaatgcaacaaatacatatttgaaatgatctggcacaaattaagcaaatatggtaactatgtattttcactcatttttatttaagatcagcggctcagcattgatatttttgataatatctgtgactcagcagctttaccttttgaggatatgatctggtatggcagttttcttagcttcaatgttacctctttttgcattgacttccacctttatatctgccaggaatctggggaaaaggagtgcctgtaaacgttccctaacttgcccattttggtgggttttccagaatgtgtgagatgctttttttttttttttcaaagcatcctgaacccatgcactgccctgaaacatgtttatttcctagtttaacaaattggcacttctaataaatgcaatctcttctgccatctgtgctgattttacatcagatagaggactgtgttctaaaggaaatcttatattagtaagagcaattttgtcattaacctagagttttattattgaggtgtgattcataacatataatattaggtagaggttctcagtggcagtgtctaaatctcttgggtgtacagtgtcttccccgttaacatgaagcatttacgagcacagtcatagtttccagccatgcttctccctgtctcacaatcaccacaaactaactatgaccacaactggaacttggtgagttattctttaataagttttaagtttgtctttaatctttatgcctctagattattatgtgagacataatctttatgcctctagattattgtgtaaagctatttcagaagaaagttaaaaagaacattttaactgactaaacaacacaggaaatcattaataaaatgcaaagtgtagatgtgagaggctccaggcctggataatgcaagagttcatgtatgcaggcagtttctttgcccaattatactgatacaaccagcatgtcagcttcatgccccatttgactcctattatgcaagcgcatggaaatgacatgctcaagggtcacacacagatatgaaaactggtgggagcaggagaggagacgactctgcacttctcctctgaaggaccaggaaagcctggacagaccatctccccagcctccatgactgcgcgacgtgcccacatggacactcatctctgacaagataagaagactccattgatgaggctgaacattttatgatttaaattactagagacttacattgaggtttcaataactaatttttataacccaaatttacttacccccatgttgttacctctttcttcagtgaaaaattgcttttgctgtaattgagttttaggaagattcccagtgttcacaactgagcttccaagagagtgttgagaacaaaaactgaatgagggcagagaaacccatctttactgtgttcaccactaaactcaagtggactcggcactgcctttgatcactgttgcttctctgcagagttcaggtttgtatttctcacaattctaacacagactctccctctcctcaaaggtttggcctccactggctgtaaggtcacactgttctgaatttcttgtctgaaccgttttatgagggtggtgatgagccatttaatggaaattttatatcatctcagcatgaatcctatgggcggtcacgaattattattctgattatggtaattgatttttctcagcatattcattactagtgatattcaaaaaccctttttatttaaatctttgatgcttcatttttgttgctatgacactttttcttctactgagtcttcccactagcattataacatgacctaatatccagggctcagttgttatataacaaccacatatgtcaaaagctatgcattcttttcacagcagacataattttctcttttctggagatgaacacacactggctgagctacccccactcacaagaacatatggaaaatcatgacatttttatttacttgactaataaattatgtcattctctcttcaaattctttatcccccagaatgccatgacaaactcttctgcatctgttcaaaccataaactcagaaaccacatggtgagtaaaagctcacttgattcgggatattgggtcaagctcttcccctccaatgtcccacagcattgggacctcagcccacctgtccaggttctatcaagagagtttagctccttcacagtgaaggaaacaattgagttaagagggaacctgcagaagatagacaatattgaaaaccattcatatgacaagggattactatcaagcatataaaataaactcaacccaactgcaaataataatgtggctaataatggaggaataacattaatacatatttctcaaaagaagaaaagaaaaagggcagatagatgatagatagataaatagatatattagtatgtatacatacatatatcgctagaaaacactaatattcaggaaaatgcacattcacaatgagatgtcttttcatcctttatctttgcttgagagtcagaaaatctaaataaataaataaataaaacaggagctggccaggattcatagaaagggaaactcttatagaccattggtggaaatggaaattagtgaagccatcatgggaaaaaatagaactaccatataattcacaatccaactgctgagtatgtatctatttaaatcattaaagtaaaaaactaatattgaagagatacatgtacacccatgtttattgcagcactatccaccatagctaacatatgaaatcaacatatgtgtccatcaacagatgaatggataaataaaatgtgttatatttacacaatggaatattgttcagtcttaaaaatgaaattctgctgttagaagcaacatggatggaactggacaccatcatgttgagtgaaacaagacagacacagaaaaataaatacagcattttctcagtgttatgtggaaattttaaaaagttgatcttctagaagtaaataatagagtagtggttatgagatgccgggaatgggaggagactgagagacaataagaggtttgttaacaaacgtataatttacaggcagataggagggatgtgctccagtgatctacagtgcagtagggtgactgctgttaacaatatagtgcacattttatgtttacaagtagccagaagacagaaatttgtatgttaccaacaaaaagaaatgttagtgtctaagctgatgaatttgttcattgttctgatttaatcataccacatggcacacatgcatagaaatatcacactgtaccccatacagttattatgtgctaactttaaaaaatcctttaattaaaacagattttatttgcatacattacaaatgcttcaacacagagccaggaataaataccatttttctttgaaatgtgaatttcctaacaacgtagttacattcatttgaaccaaaccgtgtatttgatcatggtaagaatagacaggcttatgcatagaatgatatattttaattttagacttctacttaataccataaattcaaataattttaaaacaactaagtaaaaactataaagttgaggaaatgtgtacgtggtgtgtgatgtgtgactttttccttgcgcaccactctgtccatggtggatgtgtggtgtgggtgtctgtgtctatttctgtttactctgcttgaggttctctgtgattctaggatctgtagttcagtgtctttcacaaaactgggaacgttcttagccattatttctttcaaatactgtctctgtatctacaatttctcctttcagatttaaaatgtacatatacaatactttttaatattaatgtttactttcttcactctcttttccttgcactttactctgtaaaatttctagtggtattttaagtgagtggtttcatttaaaaggtgagccagctctactgaagggtgtgcccaaagcttactcaatgtttatactgcattgcttttgatttcttatgcatttccatttgattttttcttagtattttcaactctcagttccctatctagtccttcattatgtatacagtttccttaatagatttttacatatgaattatagttactttatatatcttgtttaattagatagttctaagatccatatcatatagaagtctcattctgatcatttgtttattatgactttggtatttctcattaatatatgtaatctttgttgatagccagatattttaggttggacagttgatattggcttattacttcattttatgcattttctgcctgtatttgaccatactttatttttgccaggcctttaatgtggaaatgtttgaatcttctcagagctacatttgacgtttacttttgcagtagacgtcatagttgaagtctgttcttctgtgtccaccagagacttcagatcctccagtgataccttgtttttctttcctgcttggctttgtctcttcaccctgttccttcctccagagaatctctttcagctccttcaggtggattaagatattatattgaactgacaattgtgaaattggtggaaggcaatagaataaagggagattttctgacctttcatgggtctatatttctacgaaggcattgtgaccctgagtctgggtgtgacattgccggtgtttctgaacttctgccagatgagatgttggtctgtgtgttcttgctgttttccctgctgtggagtcctcttgttttccccagttgttccctcccacagctccaatgttctcttttggtgttatcagcttccagagttgatgacctgacctagagattaaggctctgattaaataagaaggaggggagatacttctcaatggaacttaggtgaagacctctttttccatctcagttcctaagggatggccccagtgcccctaagatcctggctttggtggcttgctcctgcagagtaatttcttagttctgcaatggggattaaggaggtgggtctgaatgcatttcagagtgtgggctctttttctctcccagacagacacattgggacaaaagatttttgtgactgtccccatttttgggaaaaaggtttcaaggtataggaaagctcttcagtatgtggtccctgagaaattcacgctacaacacatttaccacacttgacttcaccaattcagtatgtatgtatttttttctcttataatagcctacatttttatatgccagactctgcctcagttcaactcatacccatgcctttttactctctgcaagaacttgtctctccctaaatttcggatttgatgattatcttaaaacctccagtatttaaagtatattttaaaattggcaaaattccatctcctgtgtttatctgttatgttgatgctgtaaaacagtaagtaaaatatactcctcatctatgtacattttgaagctgagttgcaggttttttggtaagacccagagtcacagagaattcaaatattgttaagctgcttaatagaaaaacaaattatggtaaatgtgttcactggaatactacccatgatttataataaataaatgcctgacacacagaacagcagcaaaaccacacatgctcttattacagaaagtggcttctgaaaaccacaccgggcacgtacagctttgtcctggagttggtttagggggatgtcagagccagtgacgagaagcacagggccagatggcagcgttcactcatcccagacatgagctcctggatgcatacagagcccccccatgtgtgggtttacttccacttctgtaaaaggagaaaatactgactcctacagagcataatttacacattttttaaaaaatgtaatagggtgatcagggcaaagtgtttatcacagcacaatttcataagacagcatattttccaaataccatcattgtcagcaaacttctgcagagcaccgtcttcttatatgggtacagcctattcctccagcatcccactagagcttcttatatagtaggagacatgcaaatagggccctccctctactgatgaaaaccaacccaaccctgaccctgcaggtctcagagaggagccttagccctggactccaaggcctttccacttggtgatcagcactgagcacagaggactcaccatggaattggggctgagctgggttttccttgttgctattttagaaggtgattcatggaaaactaggaagattgagtgtgtgtggatatgagtgtgagaaacagtggatttgtgtggcagtttctgaccttggtgtctctttgtttgcaggtgtccagtgtgaggtgcagctggtggagtctgggggaggcttggtccagcctggggggtccctgagactctcctgtgcagcctctggattcacctttagtagctattggatgagctgggtccgccaggctccagggaaggggctggagtgggtggccaacataaagcaagatggaagtgagaaatactatgtggactctgtgaagggccgattcaccatctccagagacaacgccaagaactcactgtatctgcaaatgaacagcctgagagccgaggacacggctgtgtattactgtgcgagagacacagtgaggggaagtcagtgtgagcccagacacaaacctccctgcaggggtcccttgggaccaccagggggcgacagggcattgagcactgggctgtctccagggcaggtgcaggtgctgctgagggctggcttcctgtcgcggtctggggctgcctcgtcgtcaaatttccccaggaacttctccagatttacaattctgtactgacatttcatgtctctaaatgcaatactttttttgtcctttttgtttctttgtttttttgcaacaggagtacatatcctcagctccacagaagccagggtgtcactttgggggcagaaataatcgtttcgtggtcaacaggatgagagtcctgaggaatcccagggaaacctggagagtgttttccaattagactcagggcagagacctccatgggaatttctgattagaacgggctttgagctctgatgggagccaagagacaggctcacccagggtcggggtccttaaagcctgatggttttcacagctatcccccctcgtcttgtaaactcagactgattcagttgaccctttttctgctaatccattttgcttctctgtaggtttgattctcacagttcgctttcttcttctcttccctgagaacaaacgatgtgttttctgttttcagggaaaatcccagggctcaggtctgcaggacctgggtaggctgaggagactttctcactcaccattgtctggacactcctgttgtcttctgtgcatggaggcatttgggaaatgaagtggacattagtcattaagggaataatactagttttctccaattggatattgatgtagagctgaacttgtgcttctcacactgtcacagagtttggaccctcacctataactttgaggagagttgatgatggatagtccattgtgggtgagctctgggtaacagtaattgtagggtctggctaggcagcctaaggtcaatacttctggacctcaggaaagacaggctggaattcctgggaagacctgcatctgccatccaccgtggagtcccatcatcttctgttatgctgtgattgaatcagccccacctagtttatctagaacactcttcatgacttaggaaaacataatggcaagctctcctaacacctgtatcatgccatgggagcaacacctaagctagtgtgtgattgagtagatgagactgtgatctagtcaagacgacaggtaaaattgattgttgtcattatgatattttatatttggcaatataatcatgctcatattataaatacttttgctacattttttgagtgtgtcagaggctttggaactggaacaacttcatcttgaataggggctaggaaaaataagaccgagacctgctgggctggattcctagtaagttgatgcagtaagttagtcacaggatgagataggaggtctgcacaagatccaggtcataaaggccttgcagataaatcttacagtaaagaagctgggcaaagccctccaaaaccgagacagtggctaaaatgacctcagtttgtcctcactgttcattatactctaattataatgcattaacatgctaaaaaacactcccttccagcccccaagacagtttacagttgtcaaggcaacatcatgaagtttccttgtgtggtttaaaaaggaggggaggaacactcaacttcaggaattgcctggaggactcatgaataatccatccattgtttaacatataatcaagaaataaccataaaatggacaaccagcagcccatactgctgctccacctctggtgtagccagtctcattattttacttgcataagaaacttgttttcattttaatctgtggattttccccaaattgggacccctttctcctaatatttgtgctattattcgtgttctgagcagaaaaccccaagatggaatgaagtttccctacatttttataagaagtacattcacccctttgagcgaaaatgcacagggagtggaatgaggctgggaagctaatggcgtatgatggaagcttgtccctgactggaggagagagggagggaggattgggaggaaggttcctatatttttgtgctatgcaaggaagctgcaaaagataactgagtctcgtgtaagtcagtgctacctctcaggggatccctgtgactccaagaaagggctcttcttaggaatcactgtggagtcagtcctttcattagagtagaccacaggacatgggcctcagcacacgccatgccacagatgtcagaaagcagctgctgggaacctgatccacctgcattttgctgcctgtaggaggagggagggaggtgcattctcagggtcagcacactgtttgtgaatttttatagagaacccctgcttttgctgtatttttattggaaaatatatgaacaagtgtgcacctgcaaacaactgtaattttcacatttccttcagttgcattatttcttaatcctgaatgacgtcctgacacagagttgagtttttcacaggcattgttcgaaggatcgagatgatggcattttccacattcactggtttttctccatgtggcagagaccttgagtagagcacatctggcccttatccacactatctcttgtgtcccctgggaaagagcagagatttgcctgactgcagaatctggggtaggagtctgcacacctctgagcctgcagagaagctcagcgaagttttgtggagtcagagagctttccgtgtggggaacctctagcttcctcactctcggagattaatggtcagctgtacttgaggggttaagaattagagcaccttgggagcctgtctcatcacagttccattatgtaacttaccaccattagactgcgggtaataactcaatcttgatttttctgacccgattttttcatcttattcattactaattttgtttatggaaaatgttatgtttagtttatgattaaaacctcagaactttctgaacttatcaggaataatacaaatgtgtccagtttgggggaaatgtaaatgaatgtccatgcagtttgggtgtgtgtgtgtgcgtgtgtgtgtgcatgtgtgtttgtttgtgtgtgtgtggatatgtcagtcacttacaccacaatgaacatgattgctgaattacatagtcaaactaaaattagatttgctgaaaattgcctgcagcgatgtctgtgaagctgaccctgtcactttgctgtgaagaaactcagtgtacaggcgaggttgcacgggagagctaaaagcttctgcacacaggacaggctgagctcctgaactggagccaggcacaggactgagcacctgagaaacagaacccccagccctcctttatctgggctggatgggcaccagaggacccgcaggagatgctcagaactcacacaagacagagcctcagtgaggagcagaggcagcgaggaaccagtccagggagccctgtgaccgccacctcgggttgtcttattttgcttaacagcatccaaacctcaggagaccatttattacgttatttagacttccatgccctttctgtcccgaagtaaaacaaacataaatatgactctgcagttagctctttgaacctgggttatttttctgagaatgtcatcttcgtcatcaacatcatggtcatcatgtcaaaatcaacaggcaaatccagtcaccgtgaagacagtttcatggcatgattcatacacaatcattccattccacagagaatctctttcagattcttaaggtggattaaagtgttatatttaattgccaattgtgaaattggtggaagacattatactaaaggaattgtctctgacctctcatggggtcatatttccagaaaatcattgtgatcctgagtgtgagctgactttccaagtgttcccaaccctcctccagatgagatgctggtctgtgtgttcttgctgcttcccctggggcagattcctcttgttttccccagttgttccctcccacagctctcataatctctgttggtgtccccaacttccagatctgctgccatgacctgcagattaaagctctgattccgtaagaaagtgaggggagctgcttctcaatagagctttgatgggaacctctgttcatacctcaattcttaaggggctgcaccagtgccctaggatgctgattttcatggcttgctcctgcagggtaatatcttagttttgtagtggggatcagagaactgggtctggatgcatttcagaagtgtgagctcattctctcccagacagatactatgggaaaggaagatgttttgcaggggtaaatgattcaagagattagggcaactctccagtatgaggtcccttagaatttctcactataacatgcctaacacactcgacttcaagcaatccagtgtatatttgttcttcatcttgtaatagcctacattttatatgacagcctctgcctcagggaatttcatactctggcttcattactctctacaggaacttgcctctccctagatttcaaatattttgtttgttttcaaccctcaattatctgaagcattaagtaaaatttgcaaacttccatcttttctgtttatctgttattgttgatactattgttgtaagaatgaatatatgggcccggcgcggtggctcatgcctgtaatcccagcactttgtgaggccgaggtgggtggatcacgaggtcaggagatcaagaccatcttggctaacacggtgaaaccccgtctctactaaaaatacaaaaaattagccaggtgtggtggtgcgcaccagtagtcccagctacttgggaggctgaggcaggagaatggcgtgaacccgggaggtggagcttgtagtgagctgagatcgcgccactgcactccagcctgggtgacagagtgagactctgtctctaaaaataaataaataaataaataaataaataaataaatatgtgtgtatatatatatatatttctcatctatgtacatttttaagcttagcagcatattttttagtgagatccagaataataaaagaatccaaacatttttcagctgcctaatagagaaacaaattctggtaaattttttcactggaatactactcaacatttataataaatatatttctggtacacagaacagcaaggaaaagtatctaagtatttatgctgagtaaaataagccagacaaataagaatatgtactatattactccatttatgtaatttatttcaaatgaaaaaaatctaaagtaatatacaaaagatgagtagttacctgggaaaagggtagaataaaggaaggggaaatgtggaaacatacagaagaacaagagaaaatgttgaggggaactcacttgtccacctcagtaatgatgacgcttacatcatgttttcaattctacactttaaatacgtgaagtgtattatctgccaattaacactcacaaaatttattgcaagcaaacaaatgaaaaattagaccaaaagcggtggtataaagatacaaaatatccattaaaagtcagaaatatatgagaatttgcctcctgaaccctagttctctccttatttttaggtgaatgctagagtgccacaaaaatcactcaagttctcaatacaggaagtgggttccacaaagcacactaggcatgtccaattcttacctggagttggttcagggagtaactggggccactgatgtggagcacaggccaagctaccagggctcattcatctcagacatgagacacacacagcccctcctccgtgtgtgggtttatttcacatctgtaaatggagaaaccattgacttctacagaacataatttacacaaatatgtaaaaatataatagtgcaaaatgtttatcacaacacattttcataataagacagtgtattttccaaataccataattgtcacccaattcctgcggggccctgtcattttatctggggtctgccatctcctcagggttcccaccccagagctctctgtgtagcaggagacacgcaaatagggccctccccatgctgatgaaaaccagctaaaccctgaccctgcagctctggcagaggagcctcagccccgggattcccaggtgtttctgcttggtcaacactgaacatacaggattcaccatggagttggggctgaggtgggttttccttgctgctattttaaaaggtgatttatggagaactagagctattgagtgtgaatggacataagtgagcgaaacagtggatatgtgtggcagtttcttaccaggatgtctctgtgtttgcaggtgtccagtgtgagatgcagctggtagagtctggagcaaacttgacaaagcctgggtgtccctgagactctcctgtgcagcctctggattcaccttcagtagccatagcacgcactgggtcccccaggctccagggaagggtctgcagtgggtcccagttattagtggtagtggtagtaccatgtactacgcagactctgtgaagggccgattcaccatttccagagacaataccaaaaactcactgtatctgcaaatgaacagactgagggcagaggatgcagctgcatatgactctgtgagagatacggtaaggagaagtcagtgtgagcccagacacaaacctcccttcagggtacctgggacaaccagggaaagcctgggacactgtgcactgtgctgaccccaggggcaagtgcaggtgctacaagggctgggtttcctgtcttgatctggggctgccttgttaccaaattacccgagggaacttctctagatttgcaattctgtactaacatttgatgtctgtgactgctaaacttccctcacatatttgttttttgtttgtttgttttgttttgttttttgtaacaggaagacccatcctcacccctacagaagcccgagtgtcaccttgggggcagaaatgaccctgccttggtcacattgatcagtgtcctgaggaagcccagtggaacctggggagtgttttccagtcaggctcagggcagagacctccgtggaaatctctgattagaataggtttgggattcagacttgggccaagagggagtctcacccatgggagggtccttaaatcctgacagtttttacagctgttctccctcctctggcaaaactgtgcacatctgactcagaactgatccagctggcccttacttgctaatcaatttttcttctctctacacttcattctcatagttcccttttcttcccttcccagaaaacagagagtgtgttttctgtggtctaaatctcagggctcaggcctgttacctggaactcaggtgtggcccaggctgtggctcctgtgagacctggggaggctgaggggactttcccactcaccattgcctggacccgcctgctgtcttctgtgcatggaggcatttgggaaatgaagtggacattagtcactgaggggataatggtagctttctcaaatgagatactgatgtagagctgatcttctgtttctcacactgtcacagaatttcctccttcatctgtgactttggggaaagctaaggatggacactctattgtgctgtgagctctgggtgacagcaattggagggtctggctaggcaaatcctacagggtttcaggtcaatggagttggaatttctgggaagacctacactgtcatcctccatggagtcccatcatcatctcttatgctctgatggaatcagccccacctaggttatctaggacaatcttcctgacttaggaaaaaaatgatggcaggctttactaacacttatattataggatcagtacaacacctaggttagtgtgtaactgaataaatgactctatgagtcaaggggacacataaaattgattgttgccatgacatttatttatttatttatttatttatttattggaaaccagagttttattgttactgaaatgagtctcgccaagcattcaagaatgggattttttaaggatagcttggtgggttgggggcagccagtgagtcatgagtactgattgatcaggtcagagataaaatcatagggagctgaaggtgtcttgtgctgagtcagttcctaggagggggccacaagatcggatgagccagtttattgatctgggtgatgccagctgatccatcaagtgcagagtctgtaaaatatctaaagcattgatcttaggctttataatagtcattttatccccaggagcaaactaggaagggttagaatttgtagccaccagctgcatgactcttaaaacataatttctaatattttggctaattcgttagtcccccaaaggcagtctagtccccaggacgaaggagatttgttttgggaaagggcagttattgtctctgttttaaactataaactaaactaagttcctcccaatgttaggtaagcctacacccaggaatgcacaaggacaacctggaggtttgaggcaagatggagcaggttaggtcacagctctttcactgtttcagttgcagctttgcagtggtggcttcaattcctccctttgagttttgaccttatcgacttgttttgtttctctttaagtgatggttttataaccatctatgaaactctaacaggtgctctcacatgcagatttctgattaaaaactctgaagatggttacaatagtatagagataaaactatcaaatagaagactatcttttttgacttttcacttaaaatgttgcccaagaaaacttttcttttgagctatttatagctttcaacaattgagtatagtcctgtacataaaatttggagaatatttgtttctctctgtccactttctccagaatttggaaactctttgtgaatatccttaacttatggcaatatgatttttcataagtgcagtaagattttttttttttttgcaacaggacacaattggagaaactggttattttaccaaggctttgactgtaatggcgtgcttcaccttaagcaatcgaacttgacttatacagccaataagagccccttgggaaaactggcctgtaccttgtccacacagtctttgtacaaggttcctgaccagtggtaagtaaagaatgtcactttctaacaggcccaagaaccccatgttttcctgggaccccagaggaaaaataatttaccagacttacaggtatttgatggtaaaaactcatggctgggcttggctttaaaaaagtcttatctgagattccttatggaacagagttccaccaaagccaattttaaaagcctgtgtaaacaataattatttgtattgtgctttatgcaaataataaggccatgaataataagactaaagtttattttgcaaataaatcagtcctatcttgatttgttttaaataaaaatggggacaagagagaaaaaaattatgctttaaaaatatagtacacctgttgtttgctgttcttgtttttttttcttcagcagtttggacgaaattctaaattatttgtaggctacaaagccataaactaatgcgttcaaatctttacttttaaaactgcgaattgcactccttaccccagttctcattatgtactttatagtatgttgttccctccaatgtggtgctggaattatagatgacagcactgacagctttgccatgcaagccttggaaccccacgcaggcctgcgtgagtacactcagacagttgcaatgaggttccagtcctcttatcttgaggtcagcacctacccctactacgccccaggtcatcaataaaaagttgtaacagtcttggcccttcttacatcttcattatccaacaccatgatttttgttttttgccaaaacaattgccaaatatagtcataatcataggataaataattttgctgaaatatatgtgttattattggtcttttgagatggaaagtccaagactggattatgctttcatgcatttttcataagaagtacttccactcttttgacaggaaacgcacagggggtgacatgtggctgcagaagctgatggcatatggtagaaatctgtccctgagtaaaggagagatggacggaggattgggtgaaacattcttaggtttctgtgctgtgcaaggaaggtgtaaaacatatttgagtctactacaagtcaacattacccaagggggaacccctgtgactccagcaatgactctgcctcagaatcactaaagagtccttcctttcattagagtggaccacaggatctgggccatagcatagacgtcagaaagcagcagcttgacacctgatccatgtgcattttcctgcctttaaagggagggagagaggtgtattctcagggtcaacacactctttgttgatttttacacagaacactggcatttactttatttcattgaaagatatatgaacagatgtgtgtctgcaaatgattgtaattttcacatttattccaattgcataatttttaaattctgcttgatgtcctggcacacagttgtgttttctataggtatttttcaataaatcaagaaaatacattttccactttcactggcttttctccatgtgcagaggccttgagtagatcatgtctgactattagtctgttttcatgctgctgataaagacataccagagacttggaagtttacaatagaaagagttttattggacttacacttccacatgactggaaaggcctcacaatcatggtggaaggtgaaaggcacatctgacatggtggcagacaagagaagagagcttgtgcagggatctccctttttacaatcatcagatctcgtgaaactcatgcagtattacatgaacagtgctggagaaacccgcagccataattcaatgacctaccactgggtccctaccatgacactgggaattatgggagttaaattcaagatgtgatttgagtggggacacagccaaaccatattattttgccccatggcccctcccaaatctcatgtcctcacattgcaaaaccaatcatgcctttcctacagtcccccagagtcaacttgtttcagcgttaactcaaaaatccacagtctaacatctcatctgagacaaggcaagtcccttccacctataaacctgtaaagtcaaaagcaagttacttcctagaaacaatgggggtactggcattggataaacacacccatccaaatgacagaaattgcccaaaacaaaggggccctctgcaagtccaaaatccagcagagcagtcaaatattaaagctccaaaatgatcccctatgactccatttcccaaatccaggtcatgctgatgcaacagatggtttcccttggtcttgggcagctccacccctgtggctttgcagggtacagcctccctcctggctgctttcacaggctggtgttgagtgaatgtgccttttccaggcacatggtgcaagctgtcagtggatctaccacactgggatctggaggatggcggccctcttctcacagctgcactatgcaataccccaatagggactctgtgttggagctctgaccccatatttacctttctcactggcctagcagcggttctccatgagggtcccactgctgcagcaaacttctgcctggacacccaggtgttttcatacatcttctgatacccaggcagaggttctcaaggaccagttcttgacttctgtgtactcactggctctacaccatgtggaagctgccaaggcttggggtttgcaccatctgaagccatggcctgagccctacattggcgtctttcagccatagctggagtggctggacacagggcaccaactccttaggctgcacacagcacgggcaccctgggcctggaccacaaaaccacttttgcctcttaggcctccaggcctgtgatgggaggggctgccgtgaagacttctgacattcacaggagacattttccccattgtcttgaggattaacatttggctcctcattacttatgcaaatttctgcagctggcttgaatttcacctcagaaaataagatttcttttctactgccttgccaggttgtaaattttctgaacttttatgctgtttcccctttaaaactgaatgcctttaatagcactcaagtgggctttttgaattctttgctgcttagaaatttcttctgccagacaccctaaatcatctctctcaagttcaaaattccacaatttgctccagttcccaatgagttcctcatctccatctgagaccacctcaagctagaccttattgttcatataactatcagcatttttggcaaagcaattcaacaagtctctaggaagttacaaactatcccatattttctggtctttttctgagccctgcaaactcttccaatctctgcccgttacccagttaaaaagtcacttccatatttttggttatcttttcagcaatgtctcactctactggtaccaatttactgtattagtctgttatcacgctggtcccaagactggacaattcataaaagaaaggtttattggacttacagttccacatggcttgggaggcctcacaattatggtggaaggtggaaatcaggtctcacatggtggcagactagagaagagtgcacatgaaggaaaactcccctttttaatccatcagatctcatgaaactcattcactatcacacgaatagctcaggagagacccatgcccataattcagtcacctcccatcaggttccttccatgacatgtgggaattgtggaagttacaattcaagatgaaatttgggtggggacacaaacaaaccatatcactgaccttctccgcatcatctctcatgaccccagagaaagagcagagatttgtctggggtaggagctgctcctgtggaacttagaggctgcagacgaccccagtgcagttttatggagtaagagagttttcccatgtctgggaacttctagcatacccactgccagagattgctggttggctgttattgaggggttcagaattagatcacctggtagcctatctcactgcagccccattgtgtaacttaccaccaatggccttcacgtgaggactcaatgttaactgttctgacctcattttcttacctcctttatttgtaagtttggttacagatttttttttactttaatttcagggatatgtgtgctgaatgcgcaggttttagtttcttattcaagccttataattgctcaactgatcaggaataatacaacatgtatgcagttttggggaaatataaatgaacatccatgcaaaattttttgtttggatatgtccgtcagttacacccctatgaacataatagccggtcctcaccagaaattgctggtcctcaccgatctcaaaagcatctagatcttcaacttcctagccttgagaattcagaaaacaatgtttatgatatttctgagccacccatttaatggagttctgttatagcagctgaaacagactaaaccatttaccaagtctcagtaagggcagtgaggatccaccatgcttgagagacaagcattactctctcatttgcagctcaggatgacagaagcatgatcatgagctgatctgaaaagaagatgtggctttctctccctcggatctcagttgaagccatggtgtcacatctctatggtggagactaaattccagtctgtgatgtaatggatgcctgcctcctcccaccctcacttacgagacagagtttccatgccatgcgttattgaccaagaaccaagaaggactccaattattctcacccctgctcacttgtatggcagaggttctggggatattcctgggagaggcataatgagactatttaagtccacgattcccaaacagttttatgctcttaaagcaggagtatcactttgagatatatgaataatttcatgtgcactaaggtggaggctgttatatttttataggtaaagatgcatggcataaagacagagatacagcactctggaaattgtgtgactatgtttgcagttgactgtgaataatttttaccatgaagttatcctaaaacacataatatatttttactgtaagtaattaatgaaaagctgacagctccacaagagcaatatccacttggtttagcagagagaatgagaaatagcataatttaagaataatcagttagacactgtgccatgtgcctgtattttcaactagtgaggatgctaatgtgggaagatcacccaagcccaggatttcaaggccagcctgcaagatattgctagacccattttcttaaaaaaaaaaaaataacattctgggtcatgacaaacctcaaaaactgaccctctaaataggaacaaatttaattgcattaaaatgtggatgaatttttgacacaaaacagtgacagcatgccagcaatgagtacagaataacatccagttgttatgttaagagatacagactccgaaaaagagacatcaggtagaggctgtcaaaggcctcactgcctaatgactgcttttccattgatactgtgtgtatatcccggaatgcacctgtgaatgaggacatcatgtctttcatagtgtgagagaaagagacattactacccatctgacaaaggattgatcagaatataccaggatctcagacaactctataggaaaaatatctagtaatccgaataaaaagcaggcgatatttatttcttaaaataagactttcaaattgcaaacaggcatataaaatgtgctgtgtaacactgatcatcagaacaatgcaaaacaaaactacagtgaaatatcatctcatctgattttaaaatgatttcatccgaaagccagacagaaacaaatgctgggaaggatatggagaaatgagaacactcataacctgttggtgggcacttaagtttataaaaccactatggagaacagtttagagtttcctccaaacctaatagtagtgttgtcatataatccagcaatcctgctgctggcatgtactccctcccacaaaaaaaaaatgttgtttgcactaccatgtttgttatagcactgttcgtaatagccaaaatttgaaagcatcctaactgcccattaacagatgatggataaataaaatgtggtacatatagcatatggattaatattatgccataaagagaatgagattttttcatttgcaacaacgtggatgaaactggagttcattatattaattgaaataatcccagaaccgaaagacaaacttcacatattctcatatatttgtggaagttaaaaattaagacaactgaactcgtggagatagagagtgaaaggatggtcaccagaggctgggaaggtctatggtagatggggattattggggatgctcaatggatgaaaaaagtggttagaaataacaaataatacatagtatttgataacacaacagactaagtataatccttaataacataattatagattgtaaaataactaaaagtgtataaatggaatgttggtaactcaaagaattaatacttgaaaggatgtaggaaccattcatcataatgtgagtattatgcagttcatgctatatcaaagtcaggtaccccataaatatacacatataccatttacccacaaaaattcaaaattaaagtatttatgtatctcatcttctgtatctatattacattaaacctaagaagatactggtttcttcacactaccaagatccacatagacatccgtagcttctttctttgcctgtccataatctgacattgaaaaatgaggaaacctttcctatcatatgacattaatttacttagtgcacaatttcaaaatacacaaattgtgttagaattattaaactgacccttgttgaaaatatgtttatcgactagaataccgtgcttatatgcagcttatttatattttacaatcacaacatcaaattatttccaaagatacttgtttctgatattcatgcccccctttctgcagtgaaattagtacaaacctgtttatcattgttagatatttttatacagctttcattttattctgtgtttcatgaccagctaaatacttttgaagttgtatgcatttaggttaacactttgtctcaaaaaattatgagttttcacaaattatttatgccatgtgtttatcattgaacaccatgaaaatagtttcattgtgattaaaaagtgtgtgtttcacctaatccacacaccttttccccagattcctggaaaaccacaaaggtttactggatctatatttttgtctttggcaaaatagcctggctattctcttagcttcttctgcaaagcatcaagattcaccttcactgactgcagcatttattgggccctgatggctggaggagaggggctggagtgggtggtagccatgagtgacccaagtggaagttctcagtggtgctctgctccagcacaaagaagattcacagttcctggggacaacacttaacatcacaatctcccttaaaattatctactggaaagctgaggagtaggcagtgtattactgtgagagacacagtgagggacatatgggtgagtctagacgcaaacttccctgcaggaagacaagaggggactttgtggtaaatggtgctcagaaccactaggggacactcagaaccactaggagacactcaggatagcagaaggtgctcaggatgccgcagggtgctcaaaacactaggggtgctcaagaccagcagggggcactcaggacaccaggagacacttaggacatcagggggcgctcaggacaccagggggcgctcagcacaagcaggggccacagaatgacaagggtgcattccagaccaccaggaaacactcaggaccaacaagagattctcagaaaccaccaggtgtaacaggaccacctaaaggcccacaagacaaccaggagacactcatggccactgaagaacattgaggacaccaggggttcagggccaacagggagtgctcggggccaccatggggctttcagtaaccacgagggaatcaatcactcaggacaccacggttttcttaggaggcagctccacatcaggtgcctggggaaggtgacgtttgcttttagacctagctgattcctgagctggtcaagcaaaagtcttcccacgatctctcactatttcttccttgtaacccatggtttctttcacatacaaatcattaacttaggataggaattcaattcaacttttaaccttgcatatttttagaataataatagcaatagtaattcaatgtgttttgataataagaaattgtgtatgcctaattcaaactctggttccacgcatgggtttttgtttcttgtgctgtgccagtcacactacagtcaatgcttttctaataataactcaacaatgtcacggtgttaagtttcctttcattttgtctgccatttgtggagatgaaacaccactttcacgggtcagttcctccactttggttgggttctggtcttctgctcttcacactgtttctccaccttcccttctgtcaaatccttttgtcttcctcagtctcctggcaaagaagcaacaaatctatttattttgtctcctccacgtctggtgaatctgttcacttctcttcatgatcattgaacccaaccatgtttagaaggataacagttcaccttacaatatgctcatgtaggtcaggtgcagtggctcactcctgtaatcccagcactttgggaggccaagacgggtggatcatctgaggtcgagtttgagatcagcgtggccaacatggcaaaaccctgtctctactaaaaatagaaaaattagccaggcatggtgtcgggcacctgtaatcccagctactcgggaggctgaggcaggagaatcacttgaacccagggtgagaggctgcagtgagctgagataatgccacttaactccagcctgggcgacagagagaaactccatctcaaaaaaaaaagcatatgttcatctatccgcagactctctgacatcgtcacccttttctagggtcctgcagacatcaccccacaacatccagtccttttcctaagtaccacagagtgggctctgcagctcctgctgctctctgtgtgctcagcgctgaggctcaccagtgctttgatgatgaagttcaaatccctaatgtgtttgcaattctcagacaaccctctagcaagctgccattgtgagtgcattctggggatcctgggctgatttcaggtccatattgctggatgttctctagcatccaggcgtgttggcaaataaacatctagaatttgtattgaaaatttgtggaaaatcaatggtagaaaacaatcctaatttctaaataagaacattttatcctgactttataaaaacacaatgttaatttaaccaataatgtaataaaatgtgtttaaagtgatgtttatcttgttattagatgtattaataattggtattttaaagtatactaacagcataaatgacaaacaaaccaacacagcgattatacataaataccattgtacattaattaatttggcaagaatggcatttattttcatttctaccaaaccttgcctttaaatatgtttgttaattggcattaggatagtgaaacaatcacacagagcaacaacattttggaatattacattatactataaaatagtacattcgattcaattatataattaaaataacattaaataaattcatgttttggtttgatatttggatatgtgttcatttttgtattttctttttttgtatcttttgtagagatggggtttcaccatgttggacaggctggtctcgacttcctgacctcaggtgatttatcgggggaacccacccccaatatttcaatgtagggtctttctattttctgtaagtgtcggctggtctgagaaataaagagaaagagtacaaagaaaggaatgttacagctgggccaccgggggtgacatcacatattgataggtccgtgatgccccctgagccgcaacaccagcaagtttttattagggattttaaaaggagagggggtgtacgaacagggagtaggtcacaaagatcacatgctttaaggggcaaaaagcagggcaaagatcacatattccttccccagggtattaattactaatattccttgctgggaaagaatttagtgatatcttccctacttgcacatcagtttataagctctctgcaagaagaaaaatatggctctattctgcccgaccccgcaggcagtcagaccttatggttatcttcccttgtttcctaaaatcgctgttgttctgttctttttcaaggtgcactgatttcatattgttcaaacacacatgttttacaatcagatttcatattgttcaaacacacatgttttacaatcaatttgtacagttaatgcaatcatcacagggtcctgaggtgacttacatcctcagcttacaaagataacaggattatgagattaaagaaattatgaaagtattgattttgggaactgataaatgtccatattaaaatgaaatcttcacaatttatgtttagagattccagtaaagacaggtgtaagaaattataaaagtattaattttgggaactgataaatgtccatattaaaatgcaatgcctagggccaacaaaggagtcatattaatatgaaaaataatagctgaatattttggaaatgacacatgcagtaacaaatgtctatatgaaattaagaagatattgacacaaaattgagaaaaaattaacataattatgctcactactggtttataaaatgcctataataacactttttaaatcatattatagaaaataaaataactatataaatagcactctctttgcttgattttagtatttggtgcttcaaatgttttttatacaaataaacattggtcattttttgatggtaatttcaatattttcttccagaatacatgttcataaatgtaattgaaattgtataattttcagaaacttattttatcagttgtgacttgtatttttatgatagactttttacatttatatacttttgattcagaataattatagataaaaaaattataaagttaatacagtgtgttcccatctccaagtatctcctaagatgaatatcctctatcatcataagacatggtgttaacacatttacattgataagtgtaaatatattcaataccagaccttattttatttatcatttttccaataatttctattgtaaatgaaaaataaaattctaagcttcctcaagcaactaaatgaactcaaccctcagccaagggaatttcaaagtaaattctaaaacttgttccagcaatgatgggaaagtgagaggtcagacatgcctcattacatgctcctctctttggaattaaggcaccagtggccagcattagtactacaacaaagatcttaagacgggcaaaactatatttttgctgtaaacactttctatagcaaaaagacatcaaattacaacttgattctagtatagcatcacatgacaaatagcaaaacctaatgatttattctgtatgaaatctgctacctggaggcttcatctacataataagaactatgatctccaggaccccttatcttaatccagacactcagttgtaatgattgtattaccttacatttcaaccaattgccaatcagaaaatctttgaattctcctatgtcctggaaccctgtgcataaactttcctgcctttctagactgcataaatggtatagctcacatgtgttgattaatatctgcctgtaacttctgacccactaaagtatataaaatcaagctgtaatcaagccattttggacatgtgttctcaggaattcctggggtcgtgtcatgggccttggtaactcatatatatctcagaatgagccattttaaatatttcatagtttgtcccttttagtggatatcttcttttcttttttttgggacagaatctctctttgctgttgctttcgtatatttgtttgtttccagattccatcaaggccatcagtttgaattcagttgtcttgttcctttattctcttctggtaaatgacagtttgtatttctgaagttttctagttgaatattttatagataaaaatttatcaagtaggttgatagtgccatttgggactcttatatctttacctatttaatcattgcttgttttctcaatcacaatgagtgttgatttctccatgttctatacatgttagtctattttctgttccaaatccatttattaggtcttttaaaatggattttggaaaagttgatcctattattttatgcaatatttcacttgagttgcaaaggtattctttttatgattattttgtctgaaattaacatagctattcaagttttctttggtttatattttcatggtctatatttttccatcttatttcttctctttgtgaatatgttaagaagttttcttggagaaagataattgctgggtcttttttttttttagtcaactatgaggaattattttttaatgatattacccttttgtccaataatggttgttttgtctttttacaataatatgtattgtttctattaatttattatttaattattattgatgaatatcttattggttaccataaggataacaataagacatttctataattgaattctaattcaaaaatgtagtacttctttctctttcttatttctttgagacggagtctcactctgtcgcccaggctggagtgcagtgggacaatctcagatcactgtaagctctgcctcctgggttctcgccattctcctgcctcagcctcccaagtagctgggactacaggcacctgccaccatgcccggataattttttgtatctttagtagagacaggctttcaccgtgttagccaggatggtctctatcttctgacttgtgatctgcctgacctggcctcccaaagtactgggattacaggcatgagccaccgtgcccagcctacccctttatatatagaacagagatattataactatatatgtctaattcctcttttctatcccttttttattttatcagtttgtaattacataagctataaaaatgtaatattgacatttttataattgctttacacatttatgtaataaagaaaacacaaatgcaaaaactaaatttaaacctcatttttttcattgttgacaatctttatcttttggatacattcaggtattggatgtatatcatatggctgctcatctagaaactctgctaaaacgtctatggcaagattaatatgctgggaatagattttctcaggatttgtttgtccgacagagtatttatttgtctttgatttatcatctcaagagacaatgtcaagaagatgctgtttctgcaaatgggcaatctgcaaaccaaggacacgtcactacattactgtgcaagagaagcacatgaggaaaggccggtgtgagacacaaacctccaggaacacctgggctaatgagctgcagggggcgctcaggacccactgatcagtcaaccacagaggggagtgcaaaggttaggactgctttcctgcaagcattgaaaaaagaagaaaaaaactccgtctgacagtttctccaaggaacttctgtaattttagaattctgtgcctaccaatgacatctccaaatatttttttaaaatattgtgtttggaggacatactctcacatggacaaaacacaaattgacacagagatgaaaagccctcaaccatagtcaccaaaattggagacatgtagaagctcactgggacctgttgagtcttctccaatcacactcagaacagagaccttagtgggtctcccttagagtagtcattaaggatggtgataacagcctaaagatggtagaccatggtcagtgtcatatagaatatggggaccctcacaagttttttgtctgacccttctcctgacactaaattatgcaaattaataacactgatctggtgcttcttttgattctaatttattttatttttagttgtcgttctcacttttcctttggattttcctgctccctggaaaaggtaaatgtggtctccgtgacctcaattcaagggctgaagccctttccctgtagctcagctggggctcaggctgtggctactgcagccatgtggaagaggctgaagggactttcttcactctccttgctcaggaccatccactgtattgtgtataggcttctctggaaatgcaagtggccatttgtagtgaaagaaatatgtttgtctggttaaaatgggaggtggatgtagagttaattggctgctacataaactgtccttctccaccagtgcttttaggatgagattgtgaaatttgtaagaatcaaaatggagtcacatatgttaaaaccctgacaaatggattcaggaagtgtagggagaattcttacacacatatccctgacaacaagaactatcataaaatagttcttgcaaaaagaccaacatgacctcataatcatgacttctgcaaagacttctactcagaatctacttgcccagccttagattaatgccatctgaattacactgatcatgttactatcactggtcctcaccacagatgcaacaccctcctgagtcctgaaacctgactccatcccatagagtagggcacagatgaggggaatgcaaatctccaccagctccaccctcctctgggttgaaaaagccgagcacaggtcccagctcagtgactcctgtgccccaccatggacacactttgctccacgctcctgctgctgaccatcccttcatgtgagtgctgtggtcagggactccttcacgggtgaaacatcagttttcttgtttgtgggcttcatcttcttatgctttctccacaggggtcttgtcccagatcaccttgaaggagtctggtcctacgctggtgaaacccacacagaccctcacgctgacctgcaccttctctgggttctcactcagcactagtggagtgggtgtgggctggatccgtcagcccccaggaaaggccctggagtggcttgcactcatttattggaatgatgataagcgctacagcccatctctgaagagcaggctcaccatcaccaaggacacctccaaaaaccaggtggtccttacaatgaccaacatggaccctgtggacacagccacatattactgtgcacacagaccacaaagacacagcccagggcacctcctgtacaaaaacccaggctgcttctcattggtgctccctccccacctctgcagaacaggaaagtgcagctgagatacgttttcctgccagggcctgcatttcccatccccattagactcagagccctgtcttcctccttcttctttaataataaatggcatgactcctgttaatagttcatagaagcagaagctgagtcctgtttgtcaaacattcagcatgaaatgttcatgttacctgggccagatgcatcactggtatgtggccgccagtttaatgggctcatactactccaagcggccgaatacaaaacagcagaacatatgcctttattaaactgcaggaaatgacactggagaaaaatgtggggataagggagcaggaggaattgtgaaaattcagataatagcttttctcgtagagagaaaggtgcgttaataaaataattttataaaacaataaaacagatggaatgtgtccccatcacggagtgtctcacagtaacagtgcagaaataaatttctaaaaatgtcgtagggtaggtgtgatagacaaggcttatttccacacagggagcccataaatacccatgtaattaaaaatccagctcttagaaagggagtgcctcaacttgacatcagaaacccacgtcagtgagtctgaggagcaatgtggaaaagaaatggaaaattcaacaatacctttcttatgaaaatcctagctcacgtttcaacatgaaacataactgtctacaattttaggaaaaccatcccatggcaacaagtcactacactcaaaaggtactgagctaacagagttccagcagtgagcaggtcagtgctgaaatccccggagaatcaaggctctcaggtacgttgtacaaaacccagaactgagccacacaatctatggtcaagtgatctttgacaaagtcaacaaaaatatgcacggggaagaggccacgctcttcatgccatgttgctgggacaattggactgccatatgcagaagaatgaaactggacaccaacctgtcgacatatacataaccataagaaaatggactgaaggcttgattataggacttcaaaatataaatgtactcgaagaaaacaccaggagaactcctctggacattgggcttagtaaataatttaccacaaaaacctcaaaagcacaagcaataacatcaaaaatagatgaatggaatttagttaaactaaagagcttccacacagcaacagagtgaacagacaaattgcagaatgctaaaaaatatttgcacacattgcatctggcaggggactgataggcagaatttacacggaactgaaacaaccccaccacaacaacagctatgaaaaaacaaataacctcattaaaaattggcaaaggacacgagtaggaatttttttaaagaacacatataactggacaagtgctaaacatcactgattatcagggatatgcaaattaaaactgcaaagaggtatcttacaccagtcagaatggctactataaaagaagcaaaaatagcagacatcggtggcgatcaaaggcaaagggaagtctcagtcattgttggtgaggatgtagatgagcacagcctctatggaaaacaatgtggagatttttcaaagaaataaaagcagaactacctttgattcaatgaccccaccattgggtaactacccaaaggaaaaataaatcatcatatcagaatgataaccaaacttttgttttcctgcagaactattcacagtagcatagatatcaacctaaggaattaacctgtgtcttacaacagataattttatttaaaaagtcacatatatatacaattaaatactatccagccatattaaggaatggaatcatgtattttgcagctacatggatggaactctgggtcattattttaagtctaataaacgagaagtagaacagcacacaccacactttttcacttataaatgggagctaagtaatatgtgcacaggcccatagagaaaggaatgatggacattgcagactcagaaacatgggagagcagaagttgggagaatggtgagaaattacttaaagggtatgatgtacattatttggatcatggatacattaaagccaagacgactatgcaatatatatatgtaacaaaattgcagtcactccccgtaaatgtatacgaataaaataaaaaaaaatacaattgaaatgtgaaattattaacagttgatcaacaatcctgaaaattaaaacgtgtgatgcaataaatgaaaataattttagttgaacttcatcaaattttaaaacattttctattcaaccgactatcaagaaactgaaggacaagcttcaggggagaaagtatttgcaaatcatacatctaacaatgtaattataataagaaccctcaaaactcaacagtaaaaagaagcaatctgtttataaaataggcaaaggtttgtgcaaactttctatcaaagaagatgtacagatgacacatcagcatatgaatgtaattttccagtagagaaattcaaatcaagaccaaaaggagacacgactttaggctttagaatgaggaaaaataaagaagaaatactgacagtaccagtgtcagtgagcatgccaggccccgagagactaaaatattgctagtgcaaaatgaaagagtttctgggagaactgtttacagtttcttataaaattaaacatgtccttaatccatgacctagaactctcatccctgagtatgtcctacaaaggattaaaatcatgtgttcacacacacacgtattcagatgtttaacattgtgtgtgtgtgtgtgtggtgtgtgtgtgtgtgtgttagaaactaaaaacaacatgaacatctttgaaaatttgacacaaaccattacaggtgaactccagactttcttctgagtgacagaaggcctgcctgaaagatccccagagacacagtcatggatttcactgtcaccctcacatgtcactggcttgggctgggctctctctggctcttccctgaccaggaccagatgttgagctccactacctgcagttggaagtttatattttcaacaatgcactgagggctaagttgctctacagactgaaccaaacaaacatgggcgcctttgaacaaacagtgcctgacatttgtactgaccccaggagaactcttcccgctctctttcttcttggttctctcctgcaggccagcagccctgcagtttagcctggacctctcatgcatctacccatctcctcccaagtgcattttaccacagcctccactgtttttgtaattctccacactctgttgtaaatgaagtcaggtccttcgagaccagattcgggactctattttatgaccaaatttcagcctcacccccactcctgagacagagctcctaaataagattctgcaggtggagattaagagcgtttttcttcctcaatgtaggagatgagtgctcagtggagggatggggaggagctttccactttaccagcatgcagatcctgctggggtggaccctctgccataggagcagggctgggaaccaggcagccaatgtcctcctccttggtgctgcactcagggcagagcctgcatccatgagtggggctgtgtggaagaagtgagtctctggttctcagtaagtcttgtctagaactgagcctcagcagcatgacctgtgggcaaggtcggagggccaatgtcctggcccctggggaagagtgtgctctgctgggagctgggcagaaggaatcctgtctacttggctgcagccatctgtggtggaatttacatcatgctgagctcgggcatagaaggaaggaagagaatctttgatcaaatatcaatatcatgtctgaccttactgaggttttgtagattatctcgaataaatgttccttcactttctgtatgttgacagggcctttccagacccgttaatttttcaaaattaatctcaccagtttcatggaggcatggatatatcgagctccttataccgtcatgtgagatgtggaactgtttccttcactggttataaaataatgggttgacttttttcccaacactttacagataccatcaattgtcctattgcttatatggttataaccaaagcaatgctgatattattcatttctattctattgcaaggtatgccccctctactcgtctccaattgctggcatgtatttccatttgtctgtatgttttagtaatttgaatatgattcacctaagagtgtttgtgtgtgtgtgggtatgtgtgtgtcgtgtgtgtgtgtgttaagggcttatcctgctatttggtgttctctgacctgcactgatccatgacttacaatttctctaatttggaggaaaaaatagagggaaagtgagtttgagtccagacacaaacctcactgaagtgagcacaggattctaaccccaggggtgctcaggacacgctgatcacaagagccagcctcaggggcaggtgcagatggaggctgagctcttctttcccgtcagcactgtggcttcttctccataaaacatcttcccttgaggaatttatctgaattcatgattttttgcttatctccaaagtctctgaaatgaaaatgtttgttttaataaaagaaaaatcttctcacatgtgtaaaagacagtttcctacagtcgcttaatcttgtctttaaatgtcaattatcaatgcttctgaagtaaatcagctaaatctataaaagacactttgtttaactcaacactgcagcccagcatgacagcactgaaagggccagcaagcagcaggcaggatacggtgcatgccagacactggggcggaaggagttagtatccagtgcaagagaagaaagtgcccgtggtggtcactgtcaggacccaagctcacagctccaattgcaggtgaccccatgcaaaggaagagataccctcaccaatgtttagtgtggatgtcgagtctgatggtgccacattcacacaccacgtgaatatggaaagatttaccaactccattattgaggcgtctgctgagggctgcacaggcctctcaataaagtccaaactggctcaatagagcaggaaagaagctgcctcagggtttttatgatggtttggtgttgaaggaatggtggggcttcctactaaggggaaggagcttgtataatttgaacctaatactggcatccagtgaggacacttccatgattttctactaaatttcccatgtgtgggggacaaaagtgaaggaaaaggattaatcctgtcatcagtaatgaggcatcaaaatagagtctgatgacttattctacttagcaacttaagcaaatgagtgaaaaatgaggtaagtgttcactctgggtggacagcaaataggtctgcagaaaatagagtttttttaagtgtaagcacataacaaaaagaaagagaagaacaaattgaacagggatcttggaccaatgtcctgggtggaagctcttcactctgtgagatcatcagcttgctctgagggtctcgggtcaagtccttcttcaatatatctcaggccttacaggatacatgggaatgctcagcttggtgtccttcactagggaaaagaaagagaaatcagactgtcactgtgtctatatagaaagggaagacataagagactccattttgaaaaagacctgtactttaaacaattgctttgctgagatgttgttaatttgtagctttgccccagccattttgacccagccactttgagccaacctggagctcacaaaaacatgtgttgtataaaatcaaggtttaagggatctagggctgtgcaggacgtgccttgttaacaaaatgtttacaagcagtatacttgataaaggtcatccgcattgtctactctcaataaaccaggggcacagtgcactgtggaaagccgcagggacctctgcccttgaaggcggggtattgtccaaggtttctccccatgtgatagtctgagatatggcctcgtgggatgagaaagacctgaccgtcccccagcctgactcccgtaaagggtctgtgctgaggagggttagtaaaagaggaaagcctcttgcagttgagatagaggaaggccactgtctcctgcctgcccctgggaactgaatgtcttggtataaaacccgattgtacatttgttcaattttgagataggagaaaaaccaccttatggtgggaggcgagacatatttgcagtaatgctgccttgttattctttatgccgctgagatgtttgggcggagagaaacataaatctggcctacgtgcatgtccaggcatagtaccttcccttgaacttaattacgacatagattcttttgctcacatgttttttgctgaccttctccttattatcaccctggtctcctactacattcctttttgctgaaataatgaaaataataatcaataaaaactgagggaactcagagaccagtgctggtgcaggtccttggtatgctgagtgccggttccctgggcccactgttgtttctctatactttgtttctgtgtcttatttcttttctcagtctctcatcccacctgacgaggaatacccacaggtgtggaggggcaggtctccccttcgtacttgagcagccttacaactgggtgggtttatgaattaattcctcggttgcattacatgaaaaatcacacaatctacaaattttaaaaaataagcctttactttttataaaagattacagccatttcacaggctgggaagcacagccattggtgaagacgagagacaggcactcccaaggaggagcggtggggcagaaactttatgctgaacgtgttggctaaacagacataatcaacggattacaggaggggctatgcgtgttcataaaggtggtcatgacacatgaatatgggagcaaacatacacgtcacatgtgacccacttagcagtggggacttagcatttaaatgtgttacagttaggccctaagtgccaaaagctggagcaggggcacaaagaccctcagagcgcagcctccataaatggccagaaccaggccatggtcagtggtctctgatcaggagaaaattcctgaaatcaatctggtgtcccatccaagctggggttatggctgtggaatggggggtcagttagtcaggggatgagctgcagttggttaaatcgtgcttatctcaggatcagtgcttattttgctgctacagaagaaaataacagtttattctttaagagttggggtgagggatgtaacccctgcctggcatggccttaggtcttgtttataacggggcatcttattgccccggagaatctgttctgtcagtcttatgatctccattttaatgttagtgttggtccatgttgtctctgaaccacaaaagggagtgggtataatgaggtgtgtctgatctcttgttctgcccagctgggaactcagtttttaggtgtttttggtgcctccttggccaagagggggaaccactcaatctcatggggtgactgaaattttacttttagtttaaagtttataaatatggacctaagtattgacattctaaaagtcactcctttgttttggctaaaagtacttggcaagagtccttgaaatgaggttcaagagcagtattttctcatgactttatttgcaatagacacatgagagactgttgaaaagatgaagtaccaaagtagccttaatctgttggtgaatggagttggtataatacagaaatcactttcaatattttgtaacacatgcatgcatgcaataagacagcggtgagcactgagtgtaaagtctctaaaggtacgatctttcagccaccaaataatagtgtaataacggacatactctggaggagctgactataataccgtaacaccacggggagaaactttggccaaggaagtccaagattttcttttccttttcctttttttttttttttttttttttttttgttgttgttgtttgagacagagtctcactctgttgcccaggctagagtgcggtggtgcgatctcgactcactgtgacctctgtctccctgattcaagcgattcctgcctcggcctcccaaaagctgatattacaggcatgtgccaccacacccagctaagtttttcatatttttagtagagacggggttttgccatgctggccaggatgatctcgcactcctgacctcaagtggtcctcctgccttggcctcccgaagtgctggtattacagcgtgagccaccacacccagccgagattttcttaaagttttgaaaattttaatttaagggttacaattttttcaacatttccagaaagctgtagacagtattattctgtgttatatgagtgattgtagttccttccatttttagatagtattacaaacaattttagggctgcttgctttaaatagatagatgatagatggctacatacatacatacatacgtacctcgatagagatatagttgcaaacataaatacatagatagatagagttacagatgtattttagttattatgctacttttttctttgccttttcttcctatgttatgttagtcaggtctccaggacttaggagtgcatttacaatcccttcccttgtccattttgacgtgttctagacaatgcgagaatcctttgtgtgtggatcacttccaagtcatgcactacccttgcaataaatgtgtttgtgtatgtctttgccttactgacaagctctgctgagtgcagttatttctgccgtctgagctaactttacacttggtagagaaatatattctagatggaggcttccactattaatttaaattactaattcataacctccagcttaattattgaggtataatctatcagagatggtattagaacaaaggtttccaatgaaatctaacagaagggatgtcaaaaaattttcctaacttaggtaaaataaccctgagcccattcttagtatccagccatgtctcctatctatcacactgaatcccacactaactttgacctgacttgggacttgtaagcttcaaatatgaccttttgattgcaatgcctctaattcaggacgtgtggttattttagccaagagtaaagaaaaccaaatttaactcgctaaaaatgacaaagattaaaacctaatgaaatggaaactgggatatgagtggctccagacttggctattttaagagtctatgtgcccaggtgatttcttttctccattttacacacaggcaaacccaaaacgtcagcttcatctcccgttgactctcatcatctcgttcttcatcagcttgcttagaatgttgacttccagctgcatccatgttgccacaaaagacatgattttattctttttctgtgaatgcatagtgttccattgtatacatgtaccatattttcttgatcaaattcaccatgaatggacacataggttggatttatgtcttaggtattaagagtagcatagcaatgaacatgtaagtgggtgtattttttggtagactgatttattttcttttgtgcatatacccacatatgagatggccgggccaagtggcagctctgcttcaaatacttttcaaatctccagactgctttccacagtgcttggactaattcacattccacccaacactgtacaagtgtttcctgttctccgcagcctctctccagactgctttccaagattcctctcctccactttgacactttggtatatccatgtgtgtcctctctggttcagccagggacagagaaccaggaagacatcatgcattttctagagggagctggcttggggaatcaacgaccggagtagaaagtgcctttgtccatgcatcacaggcctgagggccctgggcaggaggtcaggaagagaggatgaccagacagctggggaaaccgggatgaataaagccagtttccttcctggtgaggaggggcaggtcgaagcctcgtgtccctgtagggatgaagcacactcacctgccactgctacctgccaatcaggtgacctgcagagcagcagctcctgagtcactgatggtgacttcctcctcctccaaaccctctaggatctgtgcttctcagagtgggaaccccagcaggtccccaagttttcaatggattcacctagctagtgtctctcctcagccccatccccaggctcctgccctggtgctgtgtacagtgtcacaacaggggtgacagtaacagctggtgcctgcactttccaggccaagaagtttgaaagaagcaagtcacagggccagccgggatatggggtaatcacacaaatttccttcttggaggaagtgctgggaaacatccttgagtcctcctcagctcacgtgcagctgctgctgttcatcccagtgcgggggacacatgagccctccccatgcccaggatggagctgtttcaatcacagcaggatgggaatgtgtcttctctatgggggcttttgaagcacagctctcctgttcctgagatttgagatttataaagacaagtcccacagagtggacctgcacaaataagacagtacaggatccccaggagagacatcccataagagaagggacaggcgggtcccatcacagacactcatcctcagaaaccctgaccggctactcaccttcacaggtccccagttcctgatcagtgcctgtgtctgctcctgagaagagatgaaaactcaagacaaatacttctcatgatcataggcttaaaaattctcaacgtaggaaatcaaatccagtagtttatcaaaaagttaacacactgcaatcaagtaggctacattctgcaaaagcaaggctgctttaactgctttccacagtgcttggactaattcacattccatccagcactgtacaagtgctttaacctatgcaaagcaataaatgtgatgctctactaaacagaatcaaaagcaaaaaccatgtgagtattccagcagatgcaggaaaaaagctttcaatagaatctaacaacgcttcatgataaaaaccctcaaaattatagacattgaaggagcacacctcaatctgatgagccgtctatgacaaacccatggccaacatcatactgaatgggcaaacactggaagcattttccttaagaacagaaacaagaaaaggatgcccgctctcaccacttctattcagcctagtactggaagtattcaccagatcaggcaagagaaagaaataaaaggcatccaaataaaagaaaaagaagaatgcaaaccctctgttttcactgataatatgattctatatgtagaaaatattgaaggctctgccaaaagtctcctagtattgatacattcgtttaggaatgtttcaggatataaaatcaatgtacgaaaatcacagtaacatttctagtcaccaacaacgttctggctgagagtggaatcaagaacatgctctcccaatagccaccaagacagtggaatacctaggaatagagttaagccaatgagatgaaatatctctaccagaaaaacagcaaaacacatgtgaaaaaaatcagagataaaacaaataaatggaaaaataaacattccatgcttatgaatttaaacaataaatatatgaaaaagttttaaaatttgtgattaattctacgtagcaatgccatttttttcaacatttacagaatattgttgctggtaatagcagtttagcatttgagtaatggaaacaccttacagaatcactttataacagttgcttcctgtagtgggttgcttcagttacctgatgaaaacatctgcatgtcacaggttgaaaacataaaatatgtctatcaactgagaaggttgtaggcttttgtcaaggaattacttcaagtcattcagaaaaacagcagacagtaaacgaaacttgttcaaattccatggagagtcaaagctgaagaaaatccaactagaagtgtccaaaggcccccaaggctcagttcctcggcaagtcccaccttctcaggttttccagaattttgtttttaactgatttacactgagtgaagtagattaccaggagttttccattattttaacataaaatcgggggctaagtgttgttattttataaagacatctttgaatctctcaggaaatttacctcctgagggttcagataagatcctactctaggttaagattacatgtttggcgcaatgaactggtacaaatcttactttagctttcatgttatctatttttccgcactgacttccacctttttattagtcaagtatatgggatggaagagtgcttctaagaggtccttaacttgcccatttcaatggattttcaagaagacatgagaaaccactttgtttgcaaagcatcccaaagccatgtcctgctccagaaacgtgatctcatttcctggtcgtttcttaactgacacgctctaatcagtgcatctgggccaatttgaaatgaggtgaagaaatgtgtcctaaagtaaagctaacattgtaataggaattcgtgtttaaaaacatttagttttattattgggcaggatccatcaacatataacagttgaagtttctcaacaggagtttaataaatataaggaatgtacagaagtgtttcctaatttaaataaaatgtagtgattacctaggctgtgagtgcaatcttggtaatcttctatgtccatgcccatcactctgtgcaccgcaaactaattttgacctcagcagaaacgggattaattttcaaattagtaatttttttccaatttaatttatttagatgattatgaatgactattttagcagaaagagaatcaaggaaacttgaactaaataaccagaatttaaaatgacaaacaattcaacaagatgccaggatgtgagtggctccaggcccaattaattcaaaactttatgtgcccaggttctgtattttcccaaaattacacatctccattccagcttcatgccacagttgactcccaccgtgtaagacatggcgacaccattcccaaaggtcgtgtgcaattctgaaaatggaataagcaaggagaggagatgatagtttatattctcctctgaggaggaagaattgcctcaacagaccacttctcctgcatctgtgactagaactatgtcacaggcacacatggagcaaaatccctcaaggggataatacggtaacattaatcagggtgatcatttttaatactataaaattcatagatgacactgcattccagcctgagggacagagcaagaccctgtctctaagaaaaaaagaacaaatcaatagatactgataccaacattttagataatgaaattttcataatgtaattttaaatacactcacatcattacataaatcttcccagaaatattcctagtcatgttgagtttcatcaacttttccagtgttcaaatctagaaatccaatagactcttgaggataaatcaaaatgagggcagtgaaactggtatctgctcagcacctgttaactcaggaggactcaatacacccttgcacactgctgcttctctgaatggctcacaaggactccagctcactctccatcctcctcaaacatctggcccccacttgccctaagttgactctctgctcttagtctgtgctctgaagtcttcccagaggtgaaagtgagctgtcagatggaacttccctctcacctcagcgtggaatttactgctacatttaactatcactctttccataatggttgatttcttggtctgttcattacagatcaaaggcatctgatttgaatctttatttctttgcatttgtctccatgacaattttgggaggttttaccgccagcactatgacacgatgtagtaacatgacacatttgtggttaacaacacctacaaattcagaagctcttcggttgtcttcccagcaaatatagctgcttcttttctgtgtatgaacacatcctggaaacacgtacacacccacatagatatatacatgcctatgacattttcttctctgtaagtgaaaattaacctcaatttcatacgaagttcatcatttccctgaaggtgaaggtaggtcgtttttcatctgttctaacaaatgctcagacaccagctagtaagtgaggagctaccctgcttctggatgttggatctgtctcttcccctttgctttaccacagaagattggccacttgtccaggtcccaagaagagagtccaggtttgtcctgataatatgactcatccaacttctgataactctactgttacacacattcatggaggtagcctattaattacataattcactaaacaaataccaaatacccacattgcaataccccatacccaagggtatgttcatgcattcagtgaaggaaaaggcttttcagagacagatagatcaggctagattggtcaatatatgggtgaaaacactggacttgaatgtatctgttttcccccatgtcacatgtgagacctgtcagacaggaccagggttccttgtgcactcagaggtgagggctcacagaattcctctctggtttccaggaaaggtaactgcagtaatcttggtaatgagaatatcctccagtgctgacctattatagagtttacatatgaaattttcactgcaattcacaatctactctttcacacagaagtgtacagaggtcaggacacatcctcagggtcacacattgagaatgatgaagatatgtcccacgagtttttcctaaggtctcagaaagaattccaggactcaaaaggtctcagagggcagctcccagtgccttagttaaaatggtggctcaggcctgtaatcccagcattttgggaggccaaggcaggtggatcacctgaggtcgggacattgagactagcttggccaacatggtgaaaccttatctctactaaaaatataaaaattagacggggggggttgtgcatgcctgtactcccagctactcgggaggctgaggcaggagaatcacttgaacccaggaggcggaggttgcggtgagccgagatcaggacactgcactctagcctgggcaaaggagcaaaagttcatctaaaaaatttattttaatttaaaaatttttaaaaaatggcccactccctagaacagagagattccctctaaacatgatggaggtcccgaactatacattaagtgaatcctggtgtgtctgaactcacatgattattacgttaagctgctgttccaatctacttcctcacctgggaaaagaggagccagggcatggctagttgaggccccaggaagagaactgagttctcaaagggcaaagcaagcatcctcatcccagggtgagcctaaaagactggggcctccctcatcccttttcacctctttatacaaaggcaccacctacatgcaaatcctcactcaggcacccacaggaaaccaccacacatttccttaaattcagggtccagctcacatgggaaatactttctgagactcatggacctcctgcacaagaacatgaaacacctgtggttcttcctcctgctggtggcagctcccagatgtgagtgtctcaaggctgcagacatggggatatgggaggtgcctctgatcccagggctcactgtgggtctctctgttcacaggggtcctgtcccaggtgcagctgcaggagtcgggcccaggactggtgaagccttcggagaccctgtccctcacctgcactgtctctggtggctccatcagtagttactactggagctggatccggcagcccgccgggaagggactggagtggattgggcgtatctataccagtgggagcaccaactacaacccctccctcaagagtcgagtcaccatgtcagtagacacgtccaagaaccagttctccctgaagctgagctctgtgaccgccgcggacacggccgtgtattactgtgcgagagacacagtgaggggaggtgagtgtgagcccagacacaaacctccctgcagggaggcggaggggaccggcgcaggtgctgctcaagaccagcagggggcgcgcggggcccacagagcaagaggccgggtcaggagcaggtgcagggagggcggggcttcctcatcagctcagtgctctccctcctcgccaggacctcagctgtccccaggcctcctctttctttattatctgtggttctgcttcctcacatcctcgctgcaggcaagaaagaagggagaaatttctctgtttaccattaaggttttaacagtcactggcacctttttttcaacaaattcccacaaggcccattttaccttcttgacaaagtatttcaaggcttctcaccatctcttgattggcgtcatcggctgcatcgtgtcctgctcttaaattcatgtgatgaaaccccaatcccagtggctctgtatttggagagagggattttaagaaggcaaataagttaactgtggccataaatgtgggaccctaatccactaggactcttgtccttatgggaagtggaagacatcagaggcctctctctccacatgcacacagaggagaggccatgtggggacgcgctgcatgagaaggtggccctttgcaagcctggaagtggcctctcaaaaaactaaccctttcttcacccagatcttggacgtcaaggctccagaacaataagaaaattaatatttgttatttgaaacaacctagtctgtggtatcttctgatggaaagccaagcagattcacagatacaattgtgttagctccgtctcctggagggagaagcagcccaccgaggctgacacatctctcagattatttttataaagaaaaatagatccaagatgaaaaccccaccacatttctgctgagtcattcacttagcaggcttctctgagatcagccctggggggctgtgttctaggtcatgtctctcactttccactatgagaatccatgtagatcatgagaaccagccagatggagtcctgatcccggcccaccttctgctgctccccaagtatcccaaagaaaaccactccagcgtcacccctgtgtcttctactctctaaaatcccactaaagctgaccttaaaccaggagatatttggggccgggctcttgttctcttcttcttagtcttccataaggtccaggtgctgagtaaagcctcagtaaagattgagcttcagttcccctaacccacatcattcccttacatccttgtcatgcatctgtcctctgtgggcactcagggcaggttacacaggaattgcctgaagctggcctcaactgatgtgctgagaccacgggtcatgcacatgtatgattccgggtcatgcacatgtatgattccaggtcatgcaggctctactgcaggacagacctgtgtcctgtggggcacagacagctgctgaccccgggtctcctctaataactcacacacctggtgtttgtgtgtgtccagatggccccatgagcacagcacactagggtggccaaccttacaggtggggccgtcagatggaatggacaggctggtcactcccatcatcagtgatttcccagtgaattttaaataaattaaacaaaattaacaacaaaggggaaggatatgtacctgtctctgggaggtatacagggtcccagaactgtgctgggagtgggtgtgaaacgcccttttgtgtggaaagccctccagcatgagtgaaagctgaaggaatgatcactgtgcaggtggaggatgataggcagctggcagggtacatttcctgaagctgttcctgggtgcatgatggttggatggcccatggtgttgagggctggactcacataggaacaaggaaattatcccatgggaatggcagaaaagaaaatggagatggacacccctggagacagcttattagatttggtggaggaaaaatagaaatttattccaatgaccccagcattttcagctaaataagagttgcattaatagacagaattatgaaaggaagggagaaggagtttatggagggaaaaaaaaagaagataaattaaaatttaaaactatgcaaatctatcaattggcagataacagagtggagctgatgcagctacttccttgttctggaaacctgccagagacacttagcattcctgtaaggccagtctagtggtgatgaacttgtccactttttacttttttggggaacttctcaaacctcctgcattattgaagaaaagctttaatccatgtaacgtatttatttggaagtttcttggctttgtttttattttcagcaacttgaacagaatcatgcacatcatgatatttcggtgaacaacaggccacctacaggacaaaggtctcattagattataatactgtattttcaccgcatttttccatgcttagatatgttcatctgtataaacatctaccatggtgattcagctgcccacagtattcactacacttacatgacatacagatttgttacctaggagcactatgctatcccacgcagcctgggtgtagcaaggtatttcatgtaggtttgtgtaaacacactctatgatccttgcacaatgacaaattgcctaaggacacattgttcagatgtattcctactgtttttcatttttttttagatggagtctcactctgtcacccaggctggagtgcagtggcacaatcttggctcactgcaacctccgcctcccaggctcaagcgattctcctgcctcagccttccgagtagctgggattacaggcatgaaccaccacgcccagctaattctttttttctattttttagtagagatgggatttcaccatgttgccctggctggtcttgagctcgtgacctacatgatccacccactttgccctcccaaagtgctgggattacaagcgtgagccactgcgcctggccaatgtatccctactgttaagccacaaatcatcgtatctcatttctctcccttttttgtccctgttaatattttcatgttgtgcgtgcattcttctcctagctcagtgaacatatttataaggtttactttgaattttctgctaggtaatcaatgtatctccttttaatttgtgtcagtttctagtgctttttttgttaaataatttggaccacttttttctgttttgtgattattgttattattattattttttactttctctgttgctttctcctcattagaagaaaaagctaccgtaatcactcttcacagaatatgcccagggaaaatgccatcacctatcaacccaggctgtcattgtggcatctcttaaaacttcataatggttgaaattttttgttgttgttgttattagtggcactcagacctacagaggattttaagttttgctcctactctaaattaggtggcattgaaattcatcctgcaggcagtctctgataaagtggaggaattgggcagttttgttatgcatatggttcataaaaataatatgagtttaaggttttctcagccaagtgctatatcctgatattttataatcacttctttgaatctctcttgggtttatcttttgaaaatttagatcagaatataaaccaggtttgaggctttttgtttggtgtaaacatctcctataggtcattgcgtgaaaaggcacagagtctatctgaggaggagaactcagggaagcctcacaacaacaggggagacaaaaccgaggtcactaaaaaaatatgaagcttctggctcctgcagcctccagacatgccccacaccctctcattgcacagaaatgaattcctttctctttcctgagtgatctttgccaagattcctctcctccactttgacactttggtatatccatgtgtgtccattctggttcagccagggacacagaaccaggaagacatcgtggcttttctagagggagctggcttggggaatcaatggttggagtagaaagtgtctttgtccatgtgtcacagccctgagggacacgggaagaaggtcaggaagacaggatgaccagacggctggagcaaccagtatgaacaaagccactttctttcctggtgaagaggggcatttggaagcctggtgtccctgtaggggatgaaccacactcacctgcccactgttacttgccaacgaggtgacccgcagagcagcagatcctgagtcaccgacagtggctgcttcctcctccaaaccctccaagatctgtccttccaggagtgtgaacctcagcagatccgcacgttttcaatgggtccacttagctagtgtctgtcctcagccccatccctgggatcctgtcctggtgctgtgtacactgtcacaatagtggtgacagtgacagctggtgcctgcactttccaggccaagaagtttgaaagaagcaagtcacagggccagcctggatttggggcaaacacacaaatttcactctgtggggaagtgctgggaagcagccttgagtcctcctcagctcacgtgtggctgctgctgctcatcccaggtgggacacatgagccctccccatgcccaggatggagctgtttcagtcacagcaggatgggaatgtgtcttctctatgggggcttttgaagcacagctctcctgttcctgagatttgagatttataaagacaagtcccacagagtgaacctgcacaaataagacagtgcaggatccccaggagagacatcccatatgagaagggacaggcaggtcccatcactgacgctggtcctcagaaaccctgaccagctactgaccttcccaggtcccctgttcctggaacagttcgtgtgtctgctcctgaaaagatgcccatcaagagtccccagggttctgcccccttccttgatgtgcctctgggagtggggctggctgggctgtgggtctggcgtgaccctctccacaggtcagcggctcagtgcaggctgcaccgactcggtggggctgggctgtggctgaccctcccagggggagcctggactcttcttaggggtatctgcaggatcccaggttctgggagaacagggaagccacagtgtgtgcagggccccatctccagtaaagtgtttgctgtcgctctgttgacaagggcatatccccaggcctaggggcactgtgggcgcacgaccaatgcgcgagacacagggagtaaggcacagttccctcccattactgtgaggacactagacacagtgtgtgtgtgtgtgtgtgtgtgtgtgtgtgtgtgtgtgtgtgtgtgtccattactgtggggactctaaccaccgtgtgtgtgtgtgtgtgtgtgtgtgtgtgtgtgtgtgtattaggagttttgcagtggcctctgagacccatgatcttgcaggtttagaaattatctgatgagatgttcatccacaggaaccgacaagagattaggtgttctcccaaagcccctggaagctcctggactcactgtgagtgtggactgatccagtgcttccagagctccacagaaggggctccctggtggtttcatagaatccttgcttggggtgtttctgcagagttcactggctttcctacgaccaatttaccattgcaagcgatggcgtcagcagcacatggtgtcacgtgtcactaaaggagcattctgagccaggacacagccacttcatactggggggaaaatgctctgggagcccagacaggagcctctctgcagtgcaagggctgggctgcagggggcgctcaaggcccacccagcacaggctccagccccagagcaggtgcacaggaggctgcggatggagtccccttaagatctgtgtcattcttctaaaaaaatctaaaataagtatttgacaaaaactgctgaagagtccataaatatcctattcaactgcaagaatttatcaatttacactggagatttctaaccctgctacatatcttaatagtaagcatctggaggtcaattaagcttttattttatataaataagtgcaacttttggagaaacacactcatcccccaaataacacattcatgtattaaagcctagaaatattttaaattacctctgagctattcaagtgtgggttcccagtgaagtcctgttctagggaaaattgttctccagtgggagaagctctgtcaacatacagtttagggatatggcagggcacacatggcctctaaggggattatagcttgaacccttagcatcctcctgttgggtaatccatgtgtcatctctccactctttctcatgctgtgttaggtatgaaatagcatcgctcatgaatatgcaaataactgagatgactatagatatctttgtgccctgagagcatcacccaacaaccacatccctcctcagaagcccccagagcacaactcctcaccatggactggacctggaggatcctctttttggtggcagcagccacaggtaaggggctgccaaatcccagtgaggaggaagggatcgaagccagtcaagggggcttccatccactcctgtgtcttctctacaggtgtccactcccaggttcagctggtgcagtctggggctgaggtgaagaagcctggggcctcagtgaaggtttcctgcaaggcttctggatacaccttcactagctatgctatgcattgggtgcgccaggcccccggacaaaggcttgagtggatgggatggagcaacgctggcaatggtaacacaaaatattcacaggagttccagggcagagtcaccattaccagggacacatccgcgagcacagcctacatggagctgagcagcctgagatctgaggacatggctgtgtattactgtgcgagagacacagtgtgaaaacccacatcctgagagtgtcagaaaccccaggggggaagcagctgtgctggcatggaggaaatgacaaagattattagattgaagactttctcagaaaatgatattaagtcattaaggaaaaggaacaatataaacgtgtatttgagaaattttaattatttgagagatttttcatacaatatttattctgcaagcaaatttcagggattgaattaataaaactgatacagaacttcctctgtaggtatctgtgtaaacatcaatttctgaatcagtgttgtaaatattttggaacacacacacaaatcacattttatctctacttttatctctatttttaaaaatgccaaaaaaactcattttgtgcatgtagcattttgaattcccaccatcaatgcatgatagttcttggttttccacattcatattgccatttatcattatgagaattgtgtgttttaaccattctaataggtgagtaatggtatctaatttttagttaaatgcacatttccctaataaaaattcacatttaacaattttcatataatttttgccaagatgcctcttctcatatttggttcatttttaactgcattgttttcttttgattagttgtaagtttacttgcatattgattataaaatcatttaacaaattaaaagaattcatttaacaaatatgtgacttggaagtattttctccaagtctgcggctgtcttttactcccttatcagtatgtattgcagaaaagtgtgtgtgtgtgtgtgtgtgtgtgtttatacaaatttagatttaaaaaatgtaaaatgttattcatccacagatcatgtctttggtattatatctgaaatctcattataaaatacagtaatagcaattactttttccacgtctctaatctcaggctacaatcaactcatgagtgtttaagcttcacctacttgattagaggactatcaacctaacatatttggaatacttctgtaaaaagatgtgttcctcttcctattatttctttatttgatcacttattaatatgtgtattggtttatggatgtctatttcatactctgaagaagatccatgctacattattcattttatttttcaaaccaccacggctttattatgtgctgggagctcattgagtttggatcctgcatccttacagctcacctcatgcttttgtttttgaacacttccctgtttcctgctattataataaattctaaactcattttctatattatctttttcatacatagaatcagccatttttctaaagattgcttgcttctgatgttaaagaatagtatttaaaaaattgtaatactgggtatgtgcattgttaatgtggtataagtacttgcaggacctctcaaccaactggcctagtaaactatgtatctaaccttctgtaatgtgattacattaaaaatgagaacacactggtctctctacccaattatgctaccacatggatctttctagccttccttccttgactgtctataacctctcactgcaaaatgaggaaccccatccaaccatatgccattttattacttagctgcacaatttcaggacacatgcatagcagtatcagaaatgtaaagctgtacccttgtaggaaacatgtttatctactagaatagagtgcttatgttcagtttctttacactttaaacttacagagtttcctcattttcaaagttccttaggtcagcaacttcattttccactttcttcagtgaggtcatttcaatgacactgtataatttgatttatttgaaattctataaaagccaaaactgtagtcaagtgaacaacaacatatagaggatattcgaggagtttagagactggtataaaataagttaaaaagacactgtttaagaagattaaaattatttttagtgatatgcaatggttcagatatgacacaattaatttgtctaagcacatagttttgtgatggaaaatataaacctaaatatatacaattaaaaaaaaatttagcagttcattaacccaaggatcaaatgcagattgtataaaattatctcattacttattttgtgagggtggagatttcatgagatgtatgcaacaaagaatgaggtaattttcctgatttgcatataagatgttgccattcactaaagacctttaattttttaaattgttttttttttaaatcaattttctatgtgacccaggtttttttctcttgacaagcaaataacccacaggattattttctttccttggttgagaaatatttccccaaacttcagctcagttcaggcatacactgtccctgaatgggcatttaccctcagatgggtacacacacctgtcaacatgtggactcttctgtcagacaaacgcacctttactcacgtggattcttctctcagacaaacacacatgtccccacgtggactctttcctcagactaccacatatgttcttacatttactctttcctcagaaaacagacatttcctcatgtggactcttgtctcagacaagcaaacatgtctccatgtgaactcttcactcacataagtacacatatgtccacattgactgtttccttacacaagtacatatatccaatgtcgaattgttctgtggcaaaatgatctcaagataatgataatcataaaccccctccctgacaaggcatagatctgtatttttttcattgcaacctaactttgccttattgtcaagaacagtagtttgcagctctaaatataccaattagagacaggtgtccattttctctggaaacgtatttttatgttcttactggacatatttgttgataatgtttgctattatgaagataccccaacagtgtccacattagagaataaaaaatagtaatgggcagattaactctgtgcatccagacccagaaatcctttgaccttgacttccctgaaatgtagacacagaggatggatgagcaatgctgagcagtgcacccatgaccacaaaaagaaagacgtggaaatgtgtcccctccacttctcatgaaaggcagctcatcccctgttccctcaggccctggcgaggagccaccccatgtctgtgcccttcctcagtgtccacaccgtggggtctgcattgatctggattctcttctcatccccgtcaatattagtgtccttcgtaaatcaggtccagctgtggcttctcctcacggggctgttctcagtctgtttgctgtgttcacggaagtcctgtgtgaagtttactgatggagtcagagggggaaaaaatttacagcccagtggtgagactctcctgcaaagcctctggtttcacctttactggttacagcatgagcttggtccagcacgcttcacaacagggataggtgtgggtgccaacagtgagtgatcaagtatgaattctcagggttactttccatgagtacaaataaattaacaatctcaagcaacacccttttaagtgcagtctgccttacaatgaccaatctgaaagccaaggacaaggtcatgtattactgtgagtgacacagtgagggaaaccctgtgtgagcccagacacaaagctcaccgcagggagacaggaggggactatgtggtagatgctgctcagaaccaccagggggcatcaggaccatcagggagggtgcacagaaccaccaggaggggctcaggacaccagggggcgctcagaaccaccagggggccctcaggacaccagagggtgctcagaaccaccaggaggcgctcaggacaccagggggcgctcagaacactaggaggtgctatgaatcactagggggcgctcaggacacaagggagcactcagaaccaccagggatagctcaggataccagggggcactcggaaccgccagggggcgctcaggacactagggggcgctcagaaccaccagggggcactcaggaccatcagggagggtgcacagaaccaccaggaggggctcaggacaccagggggcgctcaggaccacaagggggccctcaggacaccagggggcactcggaaccaccagggggcactcagaaccatcagggagggtgcacagaaccaccaggaggggctcaggaccaccaggaggtgctcaggacaccagggggcgctcagaacactaggaggtgctatgaatcactagggggcgctcaggacacaagggagcactcagaaccaccagggatagctcaggacaccagggggcactcggaaccgccagggggcgctcaggacactagggggcgctcagaaccaccaggaggcactcaggaccatcagggagggtgcacagaaccaccaggaggtgctcaggacaccagggggcgctcagaacactaggaggtgctatgaatcactagggggcgctcaggacacaagggagcactcagaaccaccagggatagctcaggataccagggggcactcggaaccgccagggggcgctcaggacactagggggcgctcagaaccaccagggggcactcaggaccatcagggagggtgcacagaaccaccaggaggggctcaggacaccagggggcgctcaggaccacaagggggccctcaggacaccagggggcactcggaaccaccagggggcactcagaaccatcagggagggtgcacagaaccaccaggaggggctcaggaccaccaggaggtgctcaggacaccagggggcgctcagaacactaggaggtgctatgaatcactagggggcgctcaggacacaagggagcactcagaaccaccagggatagctcaggacaccagggggcactcggaaccgccagggggcactcaggacactagggggcactcagaaccgccaaggggcgctcagaagaagcagggggtgctcagaacaccagagggtgctcagaagcaccagggggcgctcaggacaccaaagggcactcatgagactgtggcaagggggtgctgagaaccacaggatgtgaccaagacaccaaggggcactcagaactgccagggggtgctcaggacaccagaggattctcagaaccaccaggggatgctcaggaaactagcgggtgctcagaaccaccggaggacactcagaaaaccaggggatgctcaggaaccaccagggggcgcccacgacaccagagggcagtcagaaccaccggggcatgctcagaaccaccagggggcgctcaggacaccaggggatgctcaggacactaggggcgctcaggaaccaccaggggacgctcaggacactagtagggtctcagaaccaccaggggatgctcaggacactagggggcgctcaggaaccaccaggggtcacccaggacaccaggggtcgctcaggaaaccagagggtgcccaggaaaccaggggaggttcaggaaccaccagggggcactgaggacaccaaggggtgctcagaaccaccagggggcgctcaggaaccaccagggggcgctcaggacactagtaggcactgaggaaccaccagggggcgctcaggacactagtaggcactgaggaaccaccagggggggctcaggacactagtaggcactgaggaaccaccagggggcgctcaggacactagtaggcactgaggaaccaccagggggggctcaggacaccagaggtcgctcagaaaaccagggggtgctcagaaccaccagggggcactcaggaaccaccagtgggtgttcaggacagcaagaatggctcaggacaccagggagcactcaggacctccaaggggctctttggaggcagctccatatcaggtacctggggaggatgaggtttccttttccaccttggtgattcctgacctggtcaagcaaaagtcttccccaggatctcttacgatgtcttccttgtaactcatggtttctttcacctataaaacattaacttagaacaggggttcaattcaacttttaactctgcctattttcagagttatactagcaatgatatatctcagtatattttttttaattgtgtatattcaatccaaagtctggctctatgcacaatttttttgttttctgtgctgtcagacacactattgtaaatgcttttctaacaactcagcatatgcatggggtccagtttcttttcctttcatcggctgtttgtgcagatgaaacaccactttaagggctcctgtcctccactttggcccctggtgttctgcttctcaaactttctccatcttctctttttctgtcaaaatattttatcttcctcagtctccatgcaggaaacaggaagtccttttacttcctgtcctccatgtctggtaaatcagttcacttcttttcatgatcactgaagccaaccaagtttaggagagtaacagttctccttagaatacactctacctgcagaccctctgccctcatcacacttttctagggtcctgcagacataacccccacccattcctctttttccctaagtaccacagactaggctctgcaacttatgctaccctctgtgtgctcagcccaggggctcagtagtgctttcatgaagtccaaatccctaatgtgtttgcccactctcagaccaccctccagcaagctgccattgtgattgaatcctgcaaagcatgggctgctttcagtttcctattgctggatgttctttattataaaggcatattggcaaataacgactagagtttgtattgaaaattaacgccaaaaagttttttaaaaagtttttcaaatagaaaagttctatcctgcctagtttaaaaaaatacaatgttactttaatcaatgatttaataaaaatttaagtgatgtttgtcttattagttattcaatttattaataactgactgatatttaaaaagtaaatactggctgggcgcagtggctcacgcctgtaatctcagcactttgggagggtgaggtgggtggatcacctgaggtcgggaattcgagaccagcctgaccaacatggagaaaccccctctctactaaaaatacaaaattagctgggcgtggcggggaagctgaggcaggagaatcgcttgaacctgggaggcggaggttgcggtgagccgagaacacgccattgcactccagcctgggcgacaagaccaaaactctgtctcaaaaaaaaaaaaaagtaaataccattgtacacttaagtaatatatttggcaagaatggcatttacattcattcaaaaatgaaactgcaaatacgagttacattcaattaaataattaaaataatatagaaaaaaatgggtgtgttgttttggtgtttaatatacattcatttttgcatggacgggtatatgtgtcattgctgggctgttgtgtatgtgtgcgtgtgtgtgtgtgtctgtgtgtacaactatgaagtttaaaatatattattaaattacgtagttatattaatccaaatttatcatgttaaaatattaggaaaaaaacaccagtagagaaattacagagaacatcagcaatgcctacagcatttacaagagtcacattaataacaaacaaactagttcaaatgtttagatatgacacatgcagtagaaaacgttcacatggtattaacacaaaaatggtgcacaactgaggaaattataatacgttcatgatattggctacataaatgcttatgatagtaatgcttttcatccatcaaatgcttatgataatgcttttcatccatcatattatagatgataaaacaactctataaacacttccatcactagcgtttaatatgagatgcctcacatctttttctgaaataaataaacatctgtccaccacttcgatgatcatttcaggattatcctctgaaataattatccataataattttagtaacaatattattttcagaagcctattttataaggtctttgaactattatttttatgattgttactttatattttacacactttttatttggaataattataggttatcagaacaattgtaaggaaaatacagtgtgttcacatccatctccaagttttcactaaagttaatatgtcaaaaaaaacatgggacatgggactaatatatttacattgataagtttctgtttattcagctctgggatttatttgaattttgccaatttttaacagtttccttttttcctttttcttttctttttgagataaggtgtcactttcctattgctttttgtttgtttctttgttcaacccacgtaaccacatcaaattcagtcaccatgttcctctcatatcttctggttaatcacagtttgggttcctgctgtcttcccattgaatattctataaatgaaactagtcaaataagttgattctggtcacttatatatttacctattttatcacgtttgttttgtcaatcacagtaagtgtcgaattcgctatctgttatagatgttagcctattttctatcccagatccattggttaaatctttggtgatgccttttagaaaactgatccctttaccctatgtaatatgccccttgattcctgaaagtcttatgtctaccttgtctgaatttaacatagctaagcacgctttcttttcgttcatattttcatggtccatgttttcctgtatttaacttttctatgtagagcaaatttctgtacagagctagtagttgggtcttgctttttaaatcaactataataattctattttaaaactggtattactatttttctgttaatttctgttttaatttggcattttatgatcatgtttatttctctattaacttattgtttagttcatcttttatgaatattgtattggccctaagatatacaataagaattgtgtataatcagattctaattcaaataacgtaaaacctcttcataggttgtagagctattataacttattcttctaaacactctttctcatccgttgtcttagtttattctcagtttgcacttatatgtgctataaaatataatatgtgcatttttatcattacatagacatatattagaacaattaaaaatataaaaactacatttcaacttcattttttcattcttgaccacatgttttatttggatagattcatgtttcggatgtatatcatatggctactcaccctggcagaaaatttgccaaagcacctactgaaggatgaatgcactagcaataaattttctcagaatcgatttgtcttacagggtattcatttgactttcgctttaaatgaaatttttaatatatatagaattccagtttgactttaatttgtaatttattttcttgtactcatgtattcattattttcttcctgaagatggtcacacattccattctgctgggccttcattatagatatttgtgtgtatctattcagggctatatttgcaatttatggatgccacaattatcagagttgaagtcagcttctgctgtccacagagatttcaagttcctcccatgatacttgcttttgtgtccctgtttgatcctgggtctttatatttagttttccccagggaggctgtctgtttcagctgtggaaagtgcaccctactgacagtttaaattgatgactgtgtggtgaaggaggttggacaaagcgggacttcctccaaccttctgactgagtctccttcttatgcaggagtagtaagcatagttctggggagtggccttccacattgtcctgtccttaactctttccccagggctggaacgtcttttcccagacacaactgtttttcaccagtgtccccagctttttacccactatccttaccctaaagagtaaggatttctttcctgaggaaggagatgggaggtgtttctggatcaagtttccttggtgtcgtctgtttccttttgtttctgttgacttcaccacagctcatatgacacatgctttggtggatttcccctggaggtagtggaggtgcattcaggcattccacaggagctgctgttcttttccccagtcaacaccacaagacaccagatgaggaagttgtccgtggatttttcaagttctctaggaaaagcttgcaagcactaggccaatctaacaccattagtacatgcatactaaaaaaaaaaaagtcattaagtatttctaggttagtctgtttctatctcaaatgccatccagtggcacctgccctacgtacactagcaggtaggtcctggttctctctgcaggctcctatcttctcagatttcagttttcttgtttgcttggtgaaatcaactcagatatgttgaatgttttttctctcttttatttgtagctgttcagcttcgttgttaatgaggtcagaataaaatcacagttttctcatttttttcacattcccacactgaatagctgctttccgtataaaagccagaaactgagagaacacattgaatatccattacaggtgaatgttaaacaatttgagatatgtttgtgtactggaataaaatgctgcattacaatcaagtcatcactcattcacataaaacatggccacattctcaaataatgtagggacctgagtgcccctccatctactggcctctcctggggccctagcctggccacaccttcttgcagggcagtcttggacgccctgggatcccgcaccaaaatttctgccctggcagaacatgcctgactggtggagagctccaatcgggcagccctcatgtgcacacaccagcttacacacttcctccgaatactgtaggttcacccaggcccacgtaacttcccacatcactttgcagtcacatgtctgtataggtgggttttgcttttcttgtcccaccattgcgtggagtgcagtcccctccccccaccccaaccaccatggcagaggaagctttggtggggaaaaagccagggccgctcctgtcagcgtcccgcacttgcgctaattctgcacagagaatagcagatcatctcacacattcagaaatcactcctgcttgtggggcatgaatacggcacccgggcctgtgcccacaagtgtcccatccctgagccaacacctcctccagtgtgaccttgaacacagtcaccaacagggccccacagacgcaatgcctctgccactgtggcgaacacctgcagggaggcaggcacccagacacccactagcactctgccacagctgccacacctccaacagcccaggacagtggattcctaaccttaaggagccggagaaccaagtcagggactagtataacttcccccagagtcagagcacacagtctaggtgttgggagctgagcactggccacctaaatttttccagaaatgaagccagttggctgaatccaccttataccacaatcaaaccctcaaggtcatccaatagggtaaaagaaaataaaaatgtatccaaaggtcagcaacttcaaagattgaaggtggataagcccacaaagatgagaaagaaccagtgcaaaagtcctgaaaacaaaaagggcgccctctttcctccaaacaaccacagcacctcttcaacagcagttctgaatggggctgagatggctgaaatgacagaaacagaactcagaatatggagagtgaaaatgtagatgaatacagctatttatggagaatactataaatgttcctcaaaaaataaagaaacaaaatctactgtagaatccagcagtctcactgctggctatgtatccaaaggaaatgaaatcaacatgtcaaagagatatctgcactccatgttcacgttcattgcagcattatttaaaatagtaaagatatggaaacatcctaaattcccatgaatggatgaatgaataaagaaaatgcatacagacacaacagagtaatgttcatccttaaataagaaggaaaccctgcctctgtgacagcatgcatgaatctagaggaccttatgccaagtgaaacaagccaggaacagaggaagagtcattcatgatttcactgtatatattaaagcagtagacttgcagaggtagagtagaatgttggttaccagggcctagaggggtggactgggaaagggagatgtgggttaaagtgcacaacgttccagttagaccggaggtataagttatgcctttctaatgcacagcatgtcaactatagctgataaggtagtatatatttcaaaattactaaaaaaataaacattagaatttccccactaagaaatgataaatttgtgaggtgatgaatataagcggcttgagttacccagttcataatgtatacatgtatcataactaaacaacatatgtcataaatatatgcaaaaattatttgtaatttataataaaataagtttcatatttaaataattacattaagaaaatgaacagaaactttcagatttcaagaatattttatatatatatatatatatcttaaaacaaacttgcaacagaatatagaaataagttttacgactcaatggaaaagaacagaattcaataaaaactggctaaaagaaacaacagctgcatcattatagaaaattctggaataatcagccatataaagattctcactctcttagaactagaattccgtaggacttgtaattcctcctgacctgggtgggaggcaaaaggaagaacagctaatggtgattcagtgagttttatacctgtgtgtacttctgtgctcactcagcagaaagaaaagaagaaaagaaagaaagagagaaagaaagaaacagaaagaaagaaagaaagaagaaagaaagaaagaaagaaagaaagaaagaaagaaagaaagaaagaaagagaaagaaagaagaaggaagaaggaaggaaagaaaagaaagaaagaaagagagagagggagagagggaaggaagggacagcagaagtcattgtggtgtgtgtgaaagcacaatccttgggctcccccacatccatctctactccagtcccatcaatgtccagcaaatacattttctaagatgaagtattttaaactttctaaatcctgctagaaaacccctcagctctttcagttttgctctatcacttgaattattgaattaaatctagtttttgtgggcctatcaataccataagccaaaataacacatgaagaaattgcactgagacacatgaaaaccttctgaaagctccataatttcagatctgcattcttatttccccgaacctaaatcactgaatagagactcagaacgagttgatcttgttcctgaacgtgcacagagccaaggacatcctgtctgtctggaacagctcaggtttgttcctgtttctcctagaggatataaaatcttgagttagggaaaaacagccagggacaccctgggctttgttcttctctcccctggaggcaggatgtccttcagagctttgtcccagtgggtaacacagctgctgaggtgtacaacccacgtggcctcgttttggtcacttttgcatggtgagcctgctttgcaccatggcctacaatatgcgtgtgtaactaatctgtctccatcttcaaaatgacattattccacatcaaatctagtgcaggtgcctcacacagaacattctcaattacctccatcattcataaaattgatgccattaatttcaagtatacatacatcagactcatttaacgtattgttattctcattgtttgaaacataacttttagatcaaataattaacaataataaaaatataaattttgaagtcaggtaatgtgatttctctagttgtgttctctttgctcagaatggcttgggctgttctgcatcttttgtttttccacatatattttaggattttttaaaaatttctgtgaagaatatcattgttgttttcatagggattgtactgagtctgtagattgctttaagtattatggacattttaacaatattgaatctttgaattcataaacatggaatattgttccatcttgtgtcctctttatttcctcaatgttttatagatttattgtagtttttttttactttgttcattacacattgtatgcctgtaccaaaacatcacatatacccaacaaatagaaatatatatactattatgtgcttataacaattaaaaattatgtatgtatattgaatctattcaaaatcagaaactatttctttttactgtttgtaaggtcttgtctctaggctataaaaagaatttgtaaaactcaacagaaagcataatataaacagaattctaaaatgagtgaaaatctgaacaaacacctcaccaagaaaaaatgttatctgaaaataagaatatataaaattgttcagtatcaattgtcataaactgatactcatatttaccaaatacaaaagtaaacatgatgtatttcaacagaattgattctcaaatatttgtatactcatacagtggaatactatcagtcataaaaactatgggttattaattcagaagacaacattttaacattttttctaagtgaaggaagatggacaaaagagactaagtattgtacaattccattcatgagacctgctaaatacagtaaaattaaaaggattttaaaaacaggtttgtgataggcagggcttttggggaaagacaagagactgacttggcaaagctcaggggatatttttagggtaaaacaaactgtgtgccattgtgatatgcctaatttcttattatatttgttcagagttaatagtgtacgtttcaaccaactcggtgattttatattttctatttgctgatagagacatgttcatttttgtcaatcactttgctaaatgtggctgagaggctgttgaaatgaacgctgagcaaatgtattcaccaaatctacaagagcaaattatttgccaattgctgattgagtggggtctataatgtatttgagattgggtgtggggatgttattgtgtgagatcatgatgtttagaccatgacactctctggtgagggatcactcattcattgcacatttaatgaaaggcaggtaggaggagcagaaggggatgagtcacactcctgaccacagccacaggttattgaaggcagaactgatgtaatcccctaaggtagaccactgcccctccaaggtgaccttatcctagagttgacacacatcctgggacaccagagacaactccttctctcccctttctctgcacttcagctggaagcaactgtctcaccgagcaccttgtgttaaggaatgagagttcctgttccaggtgtgagggcccaggtgcatccacttgatccagcacaagagcaagaacagccttccagaaaatgacatcgcctgaggtataaccagctctcacctgctgcagcttcctctgaataaaaaggaaactgttgaaacttcctcataagtgtcctgctgtgccattccctttgtccccacatgttcagttgtgtctgtccagatgtcacttttgtgtagggagattagggttctgcttccagtaccagaacacacatgacctcttaggggacttcagggttttgctgacatatgtgatgatcttaaaagtcattagctccatttctacatcaaaaaacatctgaaccaaaggagcacataggctcaggcctgtaatcccagcactttgggaagccaaggcagaggaatcacttgaggtcaggaatttgagaccagcctggtgaacatggtgaaaccccgtctctactaaaaaatatatacaaaaattagccaggcgtggtggcactagcctgtaatcccagctacttgaaaggctgaggcaggagaattgcttgaacccaggaggtggagattgaagtgagctgagatcgcaccacttcactccagcctgggcgacagagtgagcctccatctaaaaaaaaaaaaaatttatatatatatatatatatatatatatataataaatatatattatatatcatatatatattttatataatatatatgtatatttttatatattatacatacatatcaatatatgatatataatatgtatatataatatataatatgtatattcatatattatataatatgtatattgatatatattacacatatatattttgatatatatatatctccaaaccatctaaatatcaagtattttttaatccatctaagagctgaaattgctgaaaaaactactccctccaaaagctgtagagacaggcacatccacagtcacagcagagacttgctgacttggaagagaagctcctggagacacattggtgagaacatttacctggtgattatgctgaatgtctggaggacaaatgtggactagggggagggtgagcactcctagaggctgtacaccccacacttgtgtggacttgccctccagggccttcaggttctcgtggaagcaattaaaatagattccctatagccatgaactggggaggagtaatcacggagaaaagatgcacaaaaagacttttctagaaagctcatccaagggaaggtattctccaaaatcttagtttatgtgggggaaggaaatacttccaaattacagacccctcctcctcagccttcctctatcacgcaaatgataaaattagccaagaggagtcagattcaaggcggtagccctgggtgcagcatctgcagaagggaggaaagagagaaaatcagctgtatcactggagattccttgtgaaggtcactgctcaggagaagagggcaaccaaaccagggagagtcaactgtaagaacataccatgctcccctgccccacacattacctcctcaacagcatcattaatatggattaaagagggcagtgtgattgctttagatctgtttgagaaagaaagtcacatactgaggcctagggtcagggtcggcggcacttcccgtgagtaagatactacgaagaaggaaaaattaggggtccataactgtgaaaatcagccacagtgtgtgtgagaatgtttgtgtttgtgtttctgtgtgtttgagtaggagttattggaacagcggacgtggagtgagctttaatccacatccatctgcagcttcaggtattctcagatgcagtattcatctgcaagagccgaaatgagaaaagagccacctccaacccccccagagttttagcctccctttgtttccagtgatccagtgcatctagacctccaggaagtggactccctggtgattttagcgattcttctcttggagccaccctgaagaggacattgggtttccaaaggcccattcactatttcaagaagtggtgccatcagctcatgttgtcactgaaggagcattctgagccagggcacagtcacttcctagtgagctacagaggctgagagaaaaatgctctgtgagacccaatgggaagctccctgcagtgcaaggtctgggtggcagggagcgctagggcctcgcccagcacaggctgcagccctggagcaggtgcaagggaggctggggaggggttcctcccagggtctgatgtcttccttttctcggacaaacatgctttaataagttaaacaagactttagtaaagactattgatgtgtctttgtgtctttcagtatacagttctatttgtaggatttatctaacctaacaagtcaatgagaatcacatgtaaaaggagaaatttctaggattttcagatatcttaataggtaggagatggagaaaagggatggttttattaattcagtgcttgccaatcttaacagagacagtagtaagacatgcagaaagcaaagcccagaaaagtatgaaggtgtcaaagtgccatttaagtatgggttcacttggaggaccatgttctgcgggaacttgttttcagcagacaatctattttagcagagttctgggcatacaaggggacacacatcattaaacaaggattgggacagggacttcagcgtcccactgttgcatggcccataaattatgtgtgttctctttctcatcttggatcaagtctagagctatgaaatagtatccctcatgaatatgcaaataacctgagatttactgaagtaaatacagatctgtcctgtgccctgagagcatcacccagcaaccacatctgtcctctagagaatcccctgagagctccgttcctcaccatggactggacctggaggatcctcttcttggtggcagcagccacaggtaagaggctccctagtcccagtgatgagaaagagattgagtccagtccagggagatctcatccacttctgtgttctctccacaggagcccactcccaggtgcagctggtgcagtctggggctgaggtgaagaagcctggggcctcagtgaaggtctcctgcaaggcttctggatacaccttcaccggctactatatgcactgggtgcgacaggcccctggacaagggcttgagtggatgggatggatcaaccctaacagtggtggcacaaactatgcacagaagtttcagggcagggtcaccatgaccagggacacgtccatcagcacagcctacatggagctgagcaggctgagatctgacgacacggccgtgtattactgtgcgagagacacagtgtgaaaacccacatcctgagggtgtcagaaacccaagggaggaggcagctgtgctggggctgagaaatgaaagggattattatttttaatgttgtttacagtatgtcattaataaattgaaaaaaagtaacaatagaagtatatactctaattatatgggaactttgttttttcagttttttcatttttttttttttttttggtttgtttgtgacagagtctcactctgccacccaggctggagtgtaacggcacaatctcagctcactacaacctccacctcccaggttcaagcaattctcctgcctcggcctccagagtagttgggattacaggcacccgccaccatgcccggtgaatttttgtatttttagtagagacggggtttcaccatgttagctaggctggtctcaaactgctgatctcaggtgatctaccctcctcagcctcccaaagtcctgggattacaggcgtgagccactgcgcctggcccaattatatgggaattgtttatataattatcaccctataagcaaaattcatggaggaggaaaagctctactgaagaaagctgataccggcattcccatgaaagtatctgtgtagaagtaagtattaaaatcagttgaataggcaaggcatggtggctcacgcctataatcccagcactttgggagaccgaggcaggtggatcacaaggtaaggagttcaagatcagcctgcccaagatggtgaaaccccttctctactaaaaatacaaagaattagctgggcgtggtggtgggtgcctgtaatcgcagctattcgggaggctgaggcagagaattgcttgaacctgggaggtgaaggttgcagtgagccgagatcacgccactgcactccagcctgggcgacagagtgaaactccatctcaaaacaaaacaaaacaaaacaaaacaaaaaaacagttgaataaagtaccttagagtcatctgttcaattaacatgtttaactccaaagaaatactgaaaatattttccaaaaaggaagtgccattttacgttcctaccaacagtgaataagattttcttttctggagccttgtcagtattcactaatgctttgctgtgcagccgttgtaatattatagtaaatgagtagcagtatttaatggttgttttaaatatacatattcttaatacaaagtcttgatgaacacttttttatacattgttttatgaggtgtgtgttcagatctatgtatgccagaaatgcctggcagcgttaatttaagcacactgtgagaatgaccctatagtttatgaagaatgtatgttcagagctctgagctaagaaatccaggagctgtcaacccagaagtttattccttgtctgtgaaggacatctgaatccctggcctatcccttggaacacaggatgtccaggtgattgatgctctttgttaaatctggaggttgctaggtagagggtgctaagtgaaaatcataatataaactacacgtgttttacaaatggtagtggttttcctgtccaacacacttttcctgggccacattgtatgcaagtcctcaatacaccctaggtcttgttcatgggctccaggtctcctcttcagccttttggacatggtgccatgcctattacagtcaataggggtctagcatgacaactggtaggcccagaacaaggtcaaagaaaatcctgcaagctcttagacaacagtgtcaaggaaggggagacctgtggggaaatcccaggcaggccatgcacatctctgtgggcccaacagctgcaatccttgatggatggggcccgctgcatgtgtacggggatgcctccaaaatgccaaaagttctggaggacctgttgcctgaggtggatgtgacaatgtgacaaagtgacagtcagattcctgagctgtggcagctgttggccactcctgactgcactctgagcaaccactgaggcagagctcattgcacaggctagggtgtgtcagccacgagaacagttgtaactataatgagatgccgcctgtagggataggatagcaaattggagaccattgtttatttggtaggccatttaaagtgttgctgactgccacaccaatgcattaggactactatgactacgtcatcctgggagcctaagtcctggcgtccgatgtagagctccagtgggaaggagatgaaggttaggatgagtccataaaggttcttgctctgcagcccctgctttgctgtctcacttggtgaacagagaatgggaggtcaatgcggacaaagtccagggtccaggcttatcagtcaaatacttggtgtcatctggttacataagactatagttattccatatttcatcatagataagataagatgcaggtctactcatgtcccaccacaccaaagcagttggaaacctcccaaggcctcctgggacattggcgatcctttattccccatttcggcaaaccccttgggcccccatggcacttagacaagaaggtgccccactgcgactgttccaaaagggaggatgagggctctgaagaagctgaagtcacagtgaaatgaatacaaaccttgggagttctagtgcagggacagccctgtgaattggatgtagtcagttaccctgaggggtttaggtggggactgtgttaaaggcaaggacataagtgtgtgtccctaagaccctggtctcaaagacagaaggaagctgaagtgagatatactgtttaggagtagcaactgcactacatgtcatgccttacgagtgtaggatgtgacaaagagggccactccacatccggaacaacctttagcaggctggctaaaggatgccttccagacacaaaagccttggaatgccaggacacagtctgtagccaaatggtacttgtggtggtcaccaccaacataaaagtgggccaactgtgccagcagaagttagccccacagaactttcccccacctaagagaaggcagtgcaccacaatgcggaattccaccactgtggaattgggggagcttagaattggattcagacacaaggggagagagtggatcacagggtggcttctctatgggatagggggtggagagtattatactctctggactcaagatgagtaaaatgacacccatcacaaaccatccagccctatgatggcacctttatggtaagtggttgcaggctccaagggggccgggtccaatgaggaagatgcccccacagctcgttctcaatggcagactatagaagagttgcaggatatcttctgggagtcgagatgaggcatgctaattatgctgagaattattgaagtcccaacaatgaattgtttactgcaaaataaaagctacagttatgtattcagtgcctacccaatggcatggtgcactgatttccacgttaagccccctgggagggcagccaacatttcatgtgccccaggtagttgctgacttaggagaaaagaagaaactgagtaagcaagggatgcaccctactgtgatgaagaacaatggcaccaaaggaagagagacagccaaggagccagtcagggtggccagacaacgaatgtgctctaactggcaacacctaccagttctctgggcccatagcggcaataggtggttatggaagggccacggaagtcagaccggttgaactagtgatacgacctgggggactgccacccagaccctgtgtagtatacacagcttccatcctagaacacatgagaatggatatcttcttaggcgtgaccctccaaacaacggccagggaattccaacggagagttagagtggtgatatgtgtgaccaagcagaaggcaaactggatgccagtagagctgccaacccatggggagtcccacagctggagcaacaccacccgccctgggaggggaagatgatccaatcatgaagattgttaaggagctagcccaggtaggcattaggaggccactgcatggttcctacaacagacctgcatggcccatgcagaggccagttgagacatggagaatgacagtagattactgggagttaaataaggtggtctcccgagtgaatgcagctgttcctaatatctcctccagtctgacgagaataggagaggtgttagccacgtagcatttccttatcagtttagtcaataccttcttcagcatttctgttgccccagagtcaagatcaatttgcattaacctaaaaagaacaatggacttttactgtcttgttccagggatatttacacagcccaaatctcacagcctagtgacctccaacctcagtcgatgggctgacccaaaggggatacatgttttccactacattggtgttatcatgataacctctgagtcttttttcagcttataaattacagcccctgtcttgctgtctcacttgctgaatagaggatgggaggttaatacagacaaaatccagggtccaggcttatcagtcaaatagttggtgtcatctggttgggtaaaactaaagtcattccatctgccatcatagataaggtgcaggcctacccacgtcccaccacaacaaagcagctgcaaactctcaaggccttctggagcatcagtgtccttttattccttttatttgacatccctgaaggaggctgctaggggagactgtgtccctcctaaattcatgtgctgaagtcccaacccttggtccttcagaatgaaatcatacttggattagtgtcctttaaagaggtgaataagttaaagtgagattcctggagtggggccctaatgcaatctgactgttgttataagaagaggaagcaggagggagggtgcacaggccccgagggacggccatgttaccacagaacagtgagaaggcgccatctgcatgccagggagcgagacctcagaggaaacccacccagctggcagcttgatcttaggctttcatcctccataagtgtgaggaaattggttttgtattgtaagccatccgatctgtggtatttcgttataaaagccctataaaatgaatacagtaggtaataggagagcttctatacattgaaaaagtcggatggccagaaaaacctagacactcctgttcagacctgagcagggtgatggacctgctttgggacaggagaggggaagagatgaacccagcacccagacccagctgagcccattcctcagcaggccgtccctgggccggagcttgcacaggtgtgaaagagcctgtcttggtcttcaggggctcatggagttggacggagaatggtgtagactcaagaacacgtcatcggtgtgcccgtgtttatctgaatgggatgtgtttctagggtgtgctcatccccaaagaagaattaatcaggtctcttgggctaaaaagaggttgtggcatttgtgtgtattaataactgtggtcggacagtaaattatgttaaactgcttatgggaaggcacaatggaaagaaacactttgttacagaaggaaaaaaaaggtgattatttaaatgaggtgcctttgaaggtcaccatgccaagaggagcccatcacatgatagtgctggctttcatgttcaggagatcaggagggtccgtccgctggcttttatgacaccctagacagagctgagagtgtaatgtatgaatggaggggaagtggagagaggggaggccaaatgtttggtgggaatggagggtcactattggagccattaggaaatacacaagcatgaattatgctggaggacagaacagtgttcctggggaatattgtgttgctttgggagctgctgaacatacaggagtttcactgttcctagttctcaaattctctagactctctggacaacccagttttaaatattgggaatataggtaagacacattcgttattaaaaattattaagagaagatgtaggaagaaatttaaagtaatccatttggttatgaaaatttagttacagcgaactgtgatgtccgtttcttacttggaataatggaatgtaagtcattagtcatctcaacggttcatttttccataaccatcaattacaaaactgctgagtaatttcctgaattgcccaccatagaaactgacctcacatttcctcaatgagaaactgccagtcccgttgatccagcctcgttcttcccatcagggattttgtatctctgtggacgtgtggcacagtgctgcatatccatcggcatatggcctcaggaaaggcgccagcctatccatgcatgatgaagcttacttaggggatgaagcccgcatgctgggtgagccagtgccaacagctgaaagaatcaactgcctggtgtatgatgcttttatgaaaacaagcccagggcctcttgcattcttctgtattagattctctggtgaagatttttattcatttctgcctgaaattgccacatataattacctggaagcattacaataaactgatttggaagttaactgacttcctggtgaggttaaaatgagtgtcaggtgcatagtgagacagaccggagacatggatgcatagcaaacttgtgctcaccatggtttctatcttagttagggaaacttctgtaccttccttagatgttcaggcactccattgaggaccctggcataacattatttattgacagaccatagctcaaagtatagaactggatactaccaaggaggatatactattactattttatctttatcttaaaatatactcttccatctgaggtgaaaattaatccagatggtagaacttattgcagttactacagcattttagcaaatcaaaagccgcagaacaaacatatggacagatggcaggtatgttttcggaatcgtaaacaagttcgtgatgactgtaaaaccaaggggtgtctcacgagggctggaaacctctcacaatgaaacaacacaatgaggatctttgaaaagtactctgacctcctggtgagctggctgatatggaggctgagctccatgtagaaagccaaaggaatttctgcaggacgtcatcatgccaagcacagccgtaacctgggtcccagcccttttcacacgctcaatggttagatcttgggagggaatcaaagaagccatagtaaaatatcaaaatttaaaccccgattttgaatttaaaaagtgttaaaatatggttgtggcctacactcagaaaatctgtgtccttcagatggtttctcagtggcaccagatggtttcaagtggctattcattaagtttctcagtgaaattaccagacatagaataaataaattgtcactgtcttaaatcaacccatgggaaaggaaaactgtgtaaatacagcagagaggaaacattgctcaagggaaaaacaatctccagaaagtattgttaaagaaacagaggccctctttccagccagcgccgagcgatgggcacctctcgggacaactggcacaagggccgcaaagctgggggcaagagaaggccctgccacaagaagcggaagtatgagttggggcgcccagctgccaacagcaagactgacccgtgccgcatccacacagtccgtgtgcgaggaggtaacaagaaatactgtgccccgaggctggacgtggggaatttctcctggggctcagaatgctgcgctggtgaaacaagggtcatcgatgttgtctacaatgcatccaataacgagctggttcgtaccaagaccgtggtgaagaattgcatcgtgcccatcgacagcacgccctaccgacagtggtacgagtcccactgtgcactgcccctgggccgcaagaagggagccaagctgactcctgaggaagaagagattttaaacaaaaaacgatctaaaaaaattcagaagaaatatgatgaaaggaagaagaatgccaaaatgagcagtctcctgggggagcagttccagcagggcaagcttcttgcgtgcatggcttcaaggccgggacagtgtggccgagcagatggctatgtgctagagggcaaagagttggagttctatcttaggaaaatcaaggcccagaaaggcaaataaatccttgttttgtcttcacccatgtaataaaggtgtttattgttttgttcccaaaaaaaaaaaagaaagaaaaagaaacagaggcatcacacttactagaaaaacatattctatttcatatattatggggatatgacgtgatgttttgacatatgcgggcattgtgaaattattaaatcaagtaaataaacatgtccatcacctcacatacttattttttatggtgtaaacgtgtaaaatctactctcttatcagttttcaagtatatagtacattagtatcatggaagtcaccatgctgtgcaatagatcttcaaacgaattccttctatctaaccaaaactctgtaccctttcaccaacgtctcagctttcacatgcccctgacgccagcccctggtaggcaccattctactctctactctgagttcaacatttttagattgcatgtgtaagtgagatcatggagtaattttttatacctggcttatttcactcaacataaagagtcaaatgctcaacatcactaatcatcagggaaatgcaaattaaaaccacgataagatatcacctcacacatgttacaatggcttagtctcagtctgtctttttgttactataaccgaataccagagactgggcaatttctaaagaaaaggaatttatgctttatggtgcttgagtcagagaagtctaatatcaaggcactggcatctcacaagggccttctcactgcctcatctcacagcagaggtgggtgagcaagagaccatttgtccacgagagaaaagagaccatcttttattagaaattcactcctataataactaacccactccattgatagtgacagtaatccattcatgaggacagagccttcatgacttgatcacataataaaggtcccacctctcaacactgttgcattaaagattatttccagatcctaaactttgggagacacatttaaaccatagcattccattcctaatatcaaaatttatgtccttatcacaatgcaaattacattcattccatcccaattgtctccaaagtcttatccagcatcagtgcaaaagtctgaagtccaaagtctcatctaaatcagatatgagtgtgactcgaggcacaatttagcctgatataaattgtttccatctgcgagcctataaagtcaaaacaagttatctactttcaaatacagtgaacaatggggcaggtatgggatagaaattcccattccaaagctcagagagaggcaaggagaaagcggtgcctagttcaaaacccaacagggaaaaaaacattaagtcttatagctggaaaatcatcctctttaacggcatcttgtgcacactggggagggggatgggcccccaaggcctccggcagtcttgcctctatatattttctgggttcagtccactcagccgctctcacaggtgggactctcaggcctctagctctcctaggctgactggaaactctttgtggtacctccaaacccacatttctgcttggcattgtgctaagggcccagtgtggtgactctgtctctgcaacaagtcactgcccgagaccttaggctgtccttaggctgcccgagaccttaggccgtccacagcattctttgaaatctaggtggagaaagccatgccctcgtggttcttgtattctgcacacctgcagaattaacaacacatggatgccatggaagttgatgacttgtaccattaaagtgatggcttgagccacacctaggtcctcctgagccacagcatgggcagccaaggagtgctgtgcctggacaccgggaacagagtcctaaagtgcctgctagaagtcaggccatagatttccttcaaatttctcccaccatataacctcgttcatggctctgaacttccaccttacagaaggacctagggatgaacacaattcagccacgttctttgccactttatggcaaggatggcctttgctccattttccgatgagctattcttctttttctcctgagacctcatcagaacggcctttattgtccacggttctactgacattctaatggtcatcacctaaataatctctaagaagtttcagaatttcctcacagctctcttcttctgagtcctcaaaagaatcacctctagtgttctattcagggcaatccagactttttatagtctgatcctccaaattattccagtctttgtgcattactacatccacttctacattttggggtatttgttatcgcaacagccccacctcttgatactgatttttcgtcttagtccactttgtggtgcaatgagtgaataccacacactggctaaagtataaggaaaagaaatttattttctcgcagctctagaggctgggaagtcaatatcaaggtgttagcatctggcaagagccttcttgctgtgatgtccatgtggaaggcaggagagcaggtgcgaaggatggaaaggggtttaaactcattttttaatgaggaacccaggcctgtagtaactaatctgctaccacaatgagtaacctactctgacgataatggcattcattgcttcatgagggcagagccctcatgacctaatcatttcttaacattcccacctctggacactatggaatttgggattaagtttccaatacacatcctttctaaacagcaggggctttttaataggttgaccacccaaggctgcaggaggctctgaagcagtggcctgaggttggctgtcctttgtgagaatggagagaagtgaactgactcatggagacacaagtagatgaggtaaaggcattcattgcttcattacatggatggtgaggtcgattgaaggcattaacggattaaagatggtggcaaaaccgtctgaggtggagaccacggggagtccatcagaaatggaggacacgtcccaataaatggtgcttcatttccctgcaaagcagaagaaagcaaagaacaaaacacaacatcatagtgtacactgagcagtggattgagagaagagtttcctaaggcataactgacagagtggagaagacacacaaatctttgcatgatgctaacatttggactgtggcttcattatttcttattaatattttactgaaatatcgctagaaggagactgaaaatgaagtgtgaaaagttaaatgggatttctgctctatgtccttttcagatgagaggaactagggaattccagggaagaaacaataatagctgctgagcaaggcttttgcagggcaggacaaggaatccccaaagagaaaacggaaacctcagcttcactttgcatctgctcctgagccaggtcctgagcgacccctgtaggtcctgagtgcccctccgtaggttctgagcatcccttggttgctgggcgccctctggtggtgtctgagcccctctggtggtttctgagccccccgccttatgtctgatcctccctggtggtgtccgagtgcccctgctagtgtctgagccccctggtggtgtctgagtccccttcttagtgtctgagccaccctattagtgtctgaggacccctgatggtgtctgagcccccagttagtgtctgagccaccctattagtgtctgagcccccctggtggtgtctgagcacaggagagctcctctgaaggaagggtctacatggggacaggcgtgcttgtctcagggaagggtccatgtggggacaggtgtgcttgtctgaaggaaggttccacatggagacaggtgtgcttgtctcagggaagggtccacatggggacaggtgagcctgtctgaggggacagaagtgcttgtctcaaggaagggtcctcatgtggacaggtgagctcttttgagggaagggttgacctggggacaggcatgcttgtctgaggtaagggtcctcctggggacaggtgtgcttctctcagggaagggtccacgtggggacagaggtgcttgtctaaggcaagaatccaagtagggacaggtgagctcgtctcagggaagggtccaggtggggacagttgtgctcatctgagagaagcgttgaagtggggacaggtgtgcttgtctcaaggaagggtccatgtggggacaggtgtgctagtatcaagaaagggtccacatagggacaggtgtgcttctctcagggaagggtgcatgtggggacaggtgtgcacatcggagagaatggtccacctggggacaggtgttcttgcctcagggaagagtccaccttctcagggaagaagtgtgctcctctgagggaagggtgcacatggggacaggtgtgcttgtctcagggaagggtccatgtgggaacaggtgagctcatctgagggaagagtccacgtggggacaggtgagctcatctgagggaagggtccacatggggacaagtgacctcgtctgagggaagggtccacgtggggacaggtgagctcgtctgaaggaagggtccacttggggaccggtgtgctcctctgagggaagggtccacgtggggacaggtgtgctcctctggagggaagggtccacgtggggacaggtgagttcatctgaaggaagggtccacatggggacagttatgctcctctgagggaagggtccatgtggggacaggtgtgcttgtctcagggaaaggtccacgtggggacaggtgtgctcaccttggggaagaggacagatgagctcatctcagggaaggggccatgtggggacaggaccaagggttgggacttcagcacaagaatttaggaggaacacagtcttccctagcagcctccttcagggatgtcaaatattttccttctgttccctgtgaaagccttaaaggggtagggaaagggcgttcaacctgcacactcgtagaggggaaaccagcttcattagtaatcgttcatctgtggtaaaaaggcaggatttgaagcgatggaagatgggagtacggggcgttggaagacaaagtgccacacagcgcagccttcgaaacacaccacggtcacgttaagtttaaatggagtgaccacattcgccaggaaagggaaatatttacacttttgaagaaacagtaatttgtgtttctgattatgatctggccttggattttccctcccctcataagcaatgacagaattggcagaaatatgtgaaacgttagttctcagacatgagacacccacagagggccccctgtgcccttccctgagagctgatcagctcctgcatctgaagaaatgaccaaagaccaggagagaaccacacagaagcatcggagggacagcacctggggctctgatggggtcaggaatagcatctgttcccaatagatggactaagtaaaaagtatcataattcacaagagttttacatagcacagaagaaaaagttaccctatatcaactgttgatcttgtgaatccaggaactctggattcaaggtggtcgggcacatcttgatttacgcatttcagggacacatgagacatcagtcaatataagtaagaaggacattagttccatccagaaaggctgagacaactcaaagcaagtcctccccacttagggcttccaggtcacaggtaggtgagagacagatggttgcattcttttgagtttctgataagtgtttgcaaaggaggccatgaggatatgcacctgtctctgtgagcagagggacaactttaaatagactgggaggcagatttgtcctgagtggtttccagcttgacggggcccaagatattttcctttcacaatctggtaacttcaaacaaaacttcaaagccacaacaaaacaacacaacaacaaaaagaataagacatgggtacttattaagagtagaaaaacattcagtccccaaggaaaatattggcagtgtctacctccacatgacaaaggagtaagcagtgtgagccacagaaaggagcactattaacccacagagcaaccgagaataacacgggtgatgcgagggcattggacgcacatcattgcattttgtagattcagaaagaaacggaaaagattgacggtggtaaaagagacagccctgcttccctctcccttttccctccccgatgaggcctcacagccatgaccctcagcctcatcccgcagtgcagcagctgccgtcctgtccaggcccaccccctgccccgccctgggactgttacctcattccctcccggagtccaggtgccccccggggtgtggtgcgggagcctggggaggccctttgttctctgtcagggtctccctgggagggacgcagccaccgcagctggttggggcctggcttcgcccaggacagtcctttcctttcccattgtctttggatgactatcgctgggctgggacatgaggcgggcagaggcgcgggtcacccttaggacccccctcttgctgctggggctctgggcgctcctggctccggtccggtgttctcaaggccgtcccttgtggcactatgcctcctccgaggtggtgattcccaggaaggagacacaccatagcaaaggccttcagtttcccggctggctgtcctacagcctgtgttttggggtcaaagacacgtcattcacatgcggaggaaacaccttctttggcctagacatctgctggtgacaactcaggatgaccaaggagtcttgcagatgggtgacccctacatccctccagactgctagtacctcggctacctggaggaggtgcctctgtccatggtcaccgtcgacacgtgctatggggacctcagaggcatcatgaggctggacgaccttgcgtacgaaatcaaacccctccaggattcccgcaggtttgaacatgttgtttttcagatagtggccgagcccaacgcaacagggcccacatttagagatgatgacaatgagacagaccccctgttctctgaagcaaatgacagcatgaatcccaggatatctaattcgctgtatagttctcatagaggcaatataaaaggccacgttcaatgttccaattcatattatcgcatatatggcaatattacaacttgttccaaagaggtggtccagatgttcagtctcattgacagcattgctcaaaatattgatctgcggtactatatttatcttttgaccatatataataatcgtgacccagcccctgtgaatgaatatcgaattcagagtgcaatgtttacctattttaaaacaactttttttgatacttttcatgttcattcatccacactacttattaaatacgtgccacatgaatctaactatgaacctgaaaggtataacttctgttcccgtatagccctgttacacattggtactccaggcagacattatttattggtagccgtcataataacccagacacagatgagaagtattggtctggagtatgatgataactactgcacatgtcagagaagggcctcctgcattatgcagcgatttcctgggatgacagatgcgttcagtaactgttcttatggacatgcacaaaattgttttatacattcaggccggtgtgtttttgaaacacttgctcctgtgtataacgaaaccatgacaacggttcgctgtggaaacctcatagtggaggggagggaggaatgtgactgtggctccttcaagcagtgttatgccagttattgctgccaaagtgactgtcacttaacaccggggagcatctgccatataggagagtgctgtacaaactgcagcttctccccaccagggactctctgcagacctatccaaaatatatgtgaccttccagagtactgtcacgggaccaccgtgacatgtcccgcaaacgtttatatgcaagatggaaccccgtgcactgaagaaggctactgctatcgtgggaactgcactgatcgcaatgtgctctgcaaggcgatctttggtgtcagtgctgaggatgctcccgaggtctgctatgacataaatcttgaaagctaccgatttggacattgtattagacaacaaacatatctcagctaccaggcttgtgcaggaatagataagttttgtggaagactgcagtgtaccaatgtgacccatcttccccggctgcaggaacgtgtttcattccatcactcagtgagaggagggtttcagtgttttggactggatgaacaccatgcaacagacacgactgatgttgggcgtgtgatagatggcactccttgtgttcatggaaacttctgtaataacacccagtgcaatgtgactatcacttcactgggctacaactgccaccctcagaagtgcggtcatagaggagtctgcaacaacagaaggaactgccattgccatataggctgggatcctccactgtgcctaagaagaggtgctggtgggagtgtcaacagcgggccacctccaaaaagaacacgttccgtcaaacaaagccagcaatcagtgatgtatctgagagtggtctttggtcgtatttacgccttcataattgcactgctctttgggacagccaaaaatgtgcgaactatcaggaccaccaccgttaaggaagggacagttactaaccctgaataacactaattcagcctcccgatccctgtaaagatacagagaatataacagcaaaatctatgaaacaggatcaggggaagggatggcaaagctcaagtccacatttcttgaagtccacaggaagcacagggtcctgtttcacatcacagggaaacgggaggcattggcttctgtcccaggttcttgtaggtcgctgatgctcactctgaaataaatcttcaaaaacacacattggtgccttccacattttcttagactcctctgggagcccaaacttggccagaacctcttgcctggagagacatgaatgagcatctggctcttgtcctgaggtctctggtcccagaattaacggaagttgccaccagctccttacagggaacattcatgacatttctccagaagagagctccagagcaatgagcttcctcattccccaggtaatctgtccttctctaaacccgaagtcagtttagggtgatccagggctactccctgttccctgtctgttcctcacgggggtgctgtgggctttgcagtgagagggacttgggttcaaatcccccaccaagcaaatccccctacctggggccgagcttcccgtatgtgggaaaatgaatccctgaggtcgattgctgcatgcaatgaaattcaactagaaaaataggtagacgtgaggggcaagctgtctgtcatttagtgtgagctctgtgagtggcagctgccccctttcttcctgcccccacatttccttgaactgaaacaggaagggaagctgagtaagtcgtgatgaggaagagaaaccaggcttgtagcagcacaggctggtccgggtggaaaacagggctaggtgtatcactgagttattgtaaaggaaaatggaagttaaatgtataaataactgaatgagataacattttattttaacttaaaattcacactaatattgacttttaaaatgcagtgtagatatgtcagagagaatttcaaaggcaaagcccaccgacggaagaaatcacccttcccataccatccacagaaaactgttggtattctagggtagtactgagatctagcatttttctgaatacatctgtggttctagatgtcctgcttccatagatattgtttagaattcccacccctttctccaaacacagcttgatatcctttctctgaacctgttagaaatttcctccattcagctgtcataaagatgcgagcaatccattcctgtgcctctgtcagtgtgttctattattttgtggctgaacgctaatggacagttaagtgtgaggtcagtgaatacagtgccctccctctatgtgtccttcgggtgtgaggggttttgctgatagagcagcaggccccatcccaccctttatgcatctccgccccccacctcacgctccagctgacctctcccctgtggcctggggcgttccccagggggaatgacctctcctctctccagggcccacccactcagtgcccgtgcaagaccaccacgcttggcacggccccacctcgtgtcagggcctgtgtcccctgccccaccccctaaacagatgggaaccactgggactctgctcagggcagggggcggaggtatgtgtgaaaggaaggcaaatgtgcactctgttggagaaatattataggtagtttgagcaaaaaatctaatgccatgggaacttttagaatgatacgtattttaacaaagaacatgaccaatagagtttgtattgaagccaggaaaacactatttagagcaacagcaatatcaaaaacacaagccaacagttcaccaagaaaaaccaccattaaccccatggaaatggtcttccaagagcatcggcacttaaatcctggaaatctgcctgcctcagcacctgttgtcctgacctgccctcctgtgtgtcctaatcactcccaaacacggggcctgcactgtgggagattcacactgtgccaggtggagggagcaggacaactgctaacaggttgttggtgtggatgccgaggccacccaagcaggtgtaaactcccacctgtggggcagggaagagtgcacgggagacatgtcccgggcatagggtgagggagagctgtgggggctctgggttctgaagtgggttctgaagagggttctggcctggcagggataagaccaaccagcatgtgaggccaggctggagtctggacctctgaagctgcaagggtcatgggctgcttggccccaggggctgtcctggttctctatggagtactttcaaacattctttcttcttccaatccccctccttctctcccaaagcctgcatctcccaaatcctctttgtcggatcctcggcttcactctgcatccgtcctgagcatcgatcttccaattccatcctcttctcttctgctatgtctaagctgctgtgaagccacctgctgtaatttactgctttatatttaatattgtaccgtacatctgttctgtttccctcatcataaatgcttcatttcatgctcagcatctgagaacacaaggccttgtcagctgtcacctccttccgttctctgtttccttcctcctatccccatattgctcatcatgtccagtctcctgccatcctgaatgcttctgatggaaggtctgagatgtctcatgagcactgtgaagattctttgtaatgtgagcttgttccaggcaggaattctccttcacccagccctggaagccaagtataggcagatggccatgctcaatcaaagactgagctaacttaacagtggctttggttttaaggtttctccaatccccagggcacaggatttcagggaattcaggtgagagtctgggtgttacccttcaggaggctgtaaactccatttcacctagtctacaccacagactatggaaactatatatatatatagttctgtccctctagagaaacctaatatgtatatatacaatatataatacgtattatatattatatataatacgtattatatattatatatattatatatatattagagtttattgaggagtattaaactcacaatcacaaggtcccacagtaggccatctgcaagctgaggagcaaggaagccagtccgagtcccaaagctgaagaatttgaagtctgatgttcgacggcaggaagcatccagcacaggagaaagatgtaggctgggaggctaagccagtctagtcttttcacgtttttctgcctgctttatatcctggccacactggcagctgattagatggtgcccacctagattaagggtgggtctgcctttcccagtttactggctcaaatgttaatctcctttggcaacaccctcacagacacacccaggatcaatactttgcatgcttcaatccaatcaagttgacactcagtatcaaccatcacaagtccaccccttgtcaacttgaacccatacaaatctcctgagatcatacataatcttcaaataaagacaataataaggtcataattacacctaatgtaatacaactatcttttgtacaaccagaaatgcaccaatccccaacccaaatgctattatgtaaagttaagaacacttaaatgctgatatgaagtcaataaattttatgtcacatgataaaggaaaaaagaaatgaaggaattttcttagtacaagtgtgtacatgcacaaacatgtttttaacaaaagaagaaggaaatactgatgacaattacagtcctcatttctgcaactgatcacgtggttgtagctggtattgatgactaccttcttctactacccattctgtattccctttgccttcagcaagcatcacagcaggtagagttttttctcctagtggagtgatgcaaaccttcattcctgaagggtctgggccatttgtagtcctgcctggattgggctgttgtagtttcccgttgaccttaatgacagggcatggtaatgttaagagacgccctaatggatctcctgtattccatacatattcttccttacctccattgtggagtaatagactgattgcatcttgatagtccaggtcaatcagcccagccaacactgtaactcccctcttagcctgtggacttaaaggtaggaggggcccaaagtggccaggtggaaatctttacttccagtttaatggaattgttgttgtttctcctgatggcagcattattcccactggaactaagacctctaggccaacagaatgtaatgtcatgggaccaggaagcaaaaattttgctagtggatcactaggggtgatggtgaatggtgccatttccacttccaccccttgattcctggatccatgaattatggctatgggagaaagagtaccatatattggatgctgatttggagcatacatggccttttggagagctttgccccagccctgcaaagtattggagcctagttgacattgtaattgtgactttgaaaggccattccattcttctatcaatccagctgcttcaggatgatggggaaaatggtaagacaagtgaatcccatgagcatgagcccactgccacacttctttagccgtaaagggagtgccttggtcagaggcaatgctatgtggaatactgtgacagtggataaggcattccatgactccacagatggtagtcttggcagaagcattgcatgcatatctgcagtaagtgtctatttcagtgaggacaaacctctgccctttccaggatggaagaggtccaatataatccaacctgccatcaggtagctcactgatcaccctgaggaatggtgtcatttgggtagagacccagagccaaaccagatcacgccacccaacccctcccaaatctcatgtcctctttgcatttcaaaaccaatcatgccttcccaacagtcccccaacatcttaactcatttcagtattaactcaaaagtccaaatccaaagtcacattggagacaaggcaagtccctttcatctatgaacctgtaaaatgaaaaacaagtcagttacttccaagacaaaatgggggtacaggcattagatacatgctcccatttcagttgggagaaatgagccagaataaaggggcttcaggtcacatgcaagcccaaactccagtggggcagtcattaaatcttaaagcttcaaaataatctcctttgactccattcctcacattcagggcatgcttatgcaaagtgggggctcctacaaccttgggaagctctcaccctgtggctttgcagctctgaccccatggctgctctcatgggctttgcagagttcagccctcctggctgctctcattgagtgcatgcagcttttccaggtgcacagtgcaagccgttaatggatctaccattctggggtctgaaagatggtggccctcttctcacagccccattagtcactgtctccagtggggactctgtgtgggggctccaaccccacatttcccttctgcactgccctagcagaggctctccatgaaggctttgcccctggcgcagacttctggctggacatccagtcatttctataaatcctctgagatctgggtggaggatcacaaagctgaactcttctcttccgcacatccctaggcccaacatcatgtagaagccaccaatgattggggctttctgaagcaatggcctgagctgtacattggacttttttagccacagctagacctggagcagctgggacacagggcaccaagtcccaaggctccaaagagaagctgggccctggacccagcccatgaaaacatttttccctgataggcctccaggcctgtgattggaagggctgctgcaaagatctccgacatgccctggaaacattttccccattgtcttgattattaatattcatctcttcattacttatgcaaatttctgcagccaacttgaatttctccctagcaaatgtgtttttctttactaccacatggccaggctgcaaattttccaaacttttatgctctgtttcccttttaaaaataagttcctatttcagatcatctctctcaagggcaaagttccacagatttctagggcagggacaaaattccatcaagcttggttttatacattttagagaggcatgagacatcaatcaaatacatttaagagacacattggtttggtccagaaaggtggaacaactcaaagctagggcttccaggctataggtgaatttaaatattttctggttgacaattggttgagtttgtctaaagacctgggatagatagaaaggtaatgttcaggttaagataaagattgtagagtccaaagttcttttgaagtcttatagtggctgcccttagagataataggtgacaaatgtttcctattcaaatcttagttgaactctttaggattgggaggttctagaagaaaaagatctagctatgttaatagagattctttacagatgcaaattttcccccacaaagaacagctttgcagggccctttctttctttctttctttctttctttctttctttctttctttctttctttctttctttcttttttagatggagttttgctcttgttgcccaggctagagtataatggcacgatcttgtctcaccacaacctccacctcctgggttcaagtaattctcctgcctcagtctcccgagtagctatgattacaggcatgcaccaccacacccggctaattctgtatttttagtagacacagggtttctccatgttggtgaggctggtctcgaactcccaacctcaggtgatccgcccacctcagcctcccaaagtgctgggattacaggcatgagccaccatgcccggcctgcagggccatctcagagtatggcaaagaaacatgttttggggtaaaatattttgattttcttatttgtctcataatgttatgccagagtcagtttggaaagtaaatcatgatatataggtttaaataaaacccatctgatgagaatttatgatttgtagagcatgcctccccagactctttagataggaatttgggcaagatgaaaaaaaaatcagagtttagtcctcactacctaagaccagctcagcttggacttcactgttcatgtcactatcagcattttagtcaaaaccactcaataagtctctaggaagttccaaactttcccacatcttcccttctcctttcaagttctccaaactgttccaaccgctgccaggaggtacccagttccaaagttgcttccagattttgagttatctttatagcagttccccactcctggtaccaatttactatattagtctgtttccacagtgctataaagaactgcccgaaagtggttaatttgtaaagaaaagaggtttaattgactcacagtgctgtgtggttagggtcggaggctcaggaaacttgcaatcatggtggaagtggaagcaggcatgtgacacatggcagcaggtgagagagagaaagagagagagagggaatgaaggaggaaccaccatacatggataaaaccatcagatctcatgagaactcactcactatcaggagaacatgaggacagcatgggggaaaccacccctatgacccagtcacctcccaccaggtccaccccttgacacataaggattactatttgagatgagatttgtttaatgacacagagccaaaccacatcagcatgtgacaaaggtctaatatcaagaatctatgagggggcagttccaaaatggctgaataggaacagctccagtctacagctcccagcatgagctacacagaagacaggtgatttctgcatttccaactgaggtactgggttcatctcacgggggcttgttggacagtgggggcaggacagtgggtgcagcccaccaagagtgagctgaagcagggcgaggcattgcctaacccaggaagtgcaaggggtcagggaattcccgttcctagccaagggaagcggtgatggacggcacctggaaaatccggtcactcccaccctaatactgcacttttccaacggtcttagcaaatggcacaccaggagattatatcctatgcctggcttggaggttcccatgcccacggaacctcgcttattgctagcacagcagtctgagatcaaactgcaaggtggcagtgaggctgggggaggggtgcccacaattgctgaggcttgagtaagtaaacaaagtggctgggaagctcaaactgggtggagtccactgcagctcaaggagacctgtctgcctctgtagactccacctctgggggcagggcatagctgaacaaaaggcagcagaaacctctgcagacttaaatgtccctgtctgacagctttgaagagagtagtgtttctcccacatggactttgagatctgagaatggacagactgcctcctcaagtgggtccctgacccccgagtagcctaactgggaggcaccctccagtaggggcagactgacaccttacacggctgggtgcccctctgagatgaagcttccagaggaattatcaggcagcaacatttgctgttcagcaatattcgctgttctgcagcctctgctgctgatacccaggaaaatagggtctgcagtagacctccagcaaactccaacagacctgcagctgagggtcctgactgtcagaaggaaaactaacaaacagaaaggacatccacatgaaaaccccatctgtacatcaccattatcaaagacaaaaggtagataaaaccacaaagatggggaaaaaacagggcagaaaagctgaaaattctaaaaatcaaagtgcctctccccctccaaaggaatgcagctcctcgccagcaatggaacaaagctggatggagaatgactttgatgagttgagagaaggtttcagatgatcaaacttctccgagctaaaggaggaagttggaacccattgcaaagaagctaaaaaccttgaaaaaagatcagatgagtagctaactagaataatcagtgtagagaagtccttaaatgacctgatggagctgaaaaccatggtatgagaactacgtgatgaatgcacaagcttcagtagccgattcgatcaactggaagaaagggtatcagtgattgaagatcaaatgaaagaaatgaagggagaagagaagtttagaggaaaaaaaagtaaaaagaaagaaacaaaccctccaagaaatatcagactatgtgaaaagaccaaatctatgtctgattggtgcacctgaaagtgacagggagaatggaaccaagttggaaaacaccctgcagtatattatccagcagaacttccccaacctagcaagacaggccaacattcaaattcaggaaatacagagaaccccacaaagatactcctcgagaagagcaactccaagacacataattgttagattcaccaaagttgaaatgaaggaaaaaatattaagggcagccagagagaaaggtcgggttaccctcaaagggaagcccatcagactaacagctgatctctcagcagaaactctacaagccagaagagagtgggggccaatattcaacattcttaaagaaaagaaatttcaacccagaatttcatatccatccaaactaagcttcataagtgaaggagaaataaaatcctttacagacaaacaaatgctgatagattttgtcatcaccaggcctgccctacaggagctcctgaaggaagcactaaacatggaaaggaacaactggtaccagccactgcaaaaacatgccaaatcataaagaccaccaaagcgaggaagaaactgcatcaactaacgagccaaataaccagctaacatcataatgacaggatcaaattcacacataacaatattaacctttaatgtaaatgggctaaatgctccaattaaaagacacagactggcaaattggataaagagtcaagacccatcagtgtgctgtattcaggagacccatctcacatgcagagacacacataggctcaaaataaaggcatggaggaagatctaccaagcaactggaaaacaaaaaaaggcaggagttgcaatcctagtctctgataaaagagactttaaaccaacaaagatcaaaagagacgaagaagaccattacataatggtaaagggatcaattcaacaagaagagctaactatcctaaatatatatgcatccaatacaggagcacccagattcataaagcaagtccttggagacctacaaagagacttagattcccacacaataataatgggagactttaacaccccactgtcaacattagacagatcaacgagacagaaagttaataaggatatccagcaactgaactcggctctgcaccaagcagacctaatagacatctacagaactctccaccccaaatcaacagaatatacattcttttcagcaccacaccacacctattccaaaattgaccacatagatggaagtaaagcactcctcagcaaatgtaaaagaacagaaattataacaaactgtctctcagagcacagtgcaatcaaactagaactcaggattaagaaactcactcaaaaccactcaactacatggaaactgaacaacctgctcctgaatgactactgggtacataatgaaacgaaggcagaaataaagatgttctttgaaaccagtgagaacaaagacacaacataccagaatctctgggacacattcaaagcagagtgtagagggaaatttatagcactaaatgcccacaagagaaagcaggaaaaatctaaaattgacaccctaacatcacaattaaaagagctagagaagcaagtgcaaacacattcaaaagccagcagaaggcaagacataactaagatcagagcagaactgaaggaaacagagacacaaaaaaacccttcaaaaaatcaatgaatccaggagctggttttttgaaaagatcaacaaaattgatagaccactagcaagactaataaagaagaaaagagagaagaatcaaatagatgcaataaaaaatgataaaggggatatcaccaccgatcccacagaaatacaaactaccatcagagaatactataaacacctctacggaaataaactagaaaatctagaagaaatggataaatttctcgacacatacaccatcccaagactaaaccaggaagaagttgaatctctgaatagaccaataacaggctctgaaattgaggcaataattaatagcttaacaaccaaaaaaagtccaggaacagatggattcacagccgaattctaccagagctacaaggaggagctggtaccattccttctgaaactattccaatctatagaaaaagagggaatcctccctaactcattttatgaggccagcatcatcctaataccaaagcctggcagagacacaacaaaaaaaaagagaattttaggccaataaccctgatgaacatcaatgcaaaaatcctcaataaaatactggcaaaccgaatccagcagcacatcaaaaagcttatccaccatgatcaagtgggcttcatccctgggatgcaagtctggttcaacatacgcaaatcaataaacgtaatccagcatataaacagaaccaacgacaaaaaacacatgattatctcaatagatgcagaaaaggcctttgacaaaattcaacaacacttcatgctaaaaactctcaataaattagatattgatgggacgtatctcaaaataataagagctatctatgacaaacccacagccaatatcatactgaatgggcaaaaactacaagcattccctttgaaagctggcacaagacagagacaccctctctcaccactcctattcaacatagtgttggaagttctggccagggcaatcaggcaggagaaggaaataaagggtattcaattaggaaaagaggaagtcaaattgtcgctgtttgcagatgacatgattgtatatctagaaaaccccatcgtctcagcccaaaatctccttaagctgataagcaacttcagcaaagtctcaagatacaaaatcaatgtgcaaaaatcacacgcatttctataacccaataacagacaaacagagagccaaatcatgagtgaactcccattcacaattgcttcaaagagaataaaataccttggaatccaacttacaagggacgtgaaggacctcttcaaggagaactacaaaccactgctcaatgaaataaaagaggatacaaacaaatggaaaaacattccatgctcatgggtaggaaggatcaatatcctgaaaatggccatactgcccaaggtaatttatagattcaatgacatccccatcaagctaccaatgactttcttcacagaattgggaaaaactgctttaaagttcatatggaaccaaaaaagagcctgcaatgtcaagtcaatcctaagccaaaagaacaaagctggaggcatcacgctacctgacttcaaactatactacgaggttacagtaaccaaaacagcatggtactggtaccaaaacagagatacagaccaatggaacagaacagagccctcagaaataatgccgcatatctacaactatctgatttttggcaaacctgacaaaaacaagaaatgggaaaacgattccctatttaataaatggtgctgggaaaactggctagccatatgtagaaagctgaaactggatcccttccttacacattatacaaaaattaattcaagaggattaaagacttaaatgttagacctaaaaccataaaaaccctagaagaaaacctaggcaataccattcaggacataggcatgggcaaggacttcatgtctaaaacaccaaaagcaatgacaacaaaagccaaaattgacaaatgggatctaattaaactaaagagcttctgcacagcaaaagaaactaccatcagagtaaacaggcaacctacagaatgggagaaaatttttgcaatctacttatctgacaaagggctaatatccagaatctacaatgaactcaaacaaatttacaagaaaaacaaacaaccccatcaaaaagtgggcaaaggatatgaatagacacttctcaaaagaagacatttatggagccaaaagacacatgaaaaaatgctcatcatcactagccatcagagaaatgcaaatcaaaaccacaatgagataccatctcacaccagttagaacggcgatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggattataaaacatgctgctataaagacacatgcacacgtatgtttattgcggcactattcacaatagcaaagacttggaaccaacccatatgtccaacaatgatagactggattaagaaaatgtggcacatatacaccatggaatactctgcagccataaaaaaggatgagttcatgtcctttgtagggacatggatgaagctggaaaccatcattctcagcaaactatcacaaggacaaaaagacaaacactgcatgttctcattcataggtgggaattgaacaatgagaacacttggacacaggaaggggaacatcacacaccagggcctgttgtggggtggggggagtggggagggatagcattaggagatatacctaatgttaattgatgagtttatgggtgcagcacaccaacatggcacatatatacatatgtaacaaacctgcacgttgtgcacatgtaccctaaaacttaaagtataataaaaaaatttttaaaaaaagaaacacctgcttttttctgttttccatttgcttagtagatttttctccatccttttactttgagcctggggatgtcattgcatgtgagatgggtctcttgaagacagcatacatttgggtcttgcttctttctccaacttggcaattctctgccctttaattggggcatttagcccatttacattcaaggttaatattgatatgtgcatatttcatcctgttatcatgttgttagctgctcaatatgcagatttgattgtatagttgatttatagtggcaatcgttatgtacttaagtgtgtttttgtggtggccagtaacgttcttccattatcatatttagcaatcccttaagggcctcttgtaaggcaatctagtggtgatgaatacccttagcatttgcttgtctgaaaaggatcttatttctccttcacttgtgaagcttcatttggctagatatgaaattcttgcttggaatttcttttctttaagaatgctgaatataggcccccaatctcttctggattgtacagtttctgctgaaacctccattgttagcctcattgggttccctttgtatgtgacctgaaccttctttctagctgcctctaatattttttttcctttcaacctttaagagtctgatgtctgatggctatatgtcttagggatggttgtcatgtataatatcatgcagaggttatttgcatttcttgaatttgaatgttggcctctctggtgaggttggagaaattttcatggaggatagcctgaaatgtttttcaagtttctttttttctctttctcttcttaagggataccaatgtgtcatagatctggtctttttacataattgcacatttctctgaggttttatgccttcttttttattctttgttctttatttttgtctgactgagttaattcagagaatcagtttttaagctctgtgattctttcctcagcttggtctattctgctgttaatacttgtaattgtattctgaaattcttgaagtgagttttttagctctatcaaatcagtttggttctttcttaaaatggccatttcatctttcagcttctgtatcattttactttatttcttagctcccttggattgggtttcaacattctcctgaatctcagtgatcttctttcctgtgcatattctgaattctatgtctgtcatttcagccatttcagtcaggttaagaaccattgctgggaaaccagtgtgattatttggaggtaagaagacactctggattttagagttgcagagtttcttgcattaattctttctcatctttgtgggctgtttctttaatctttgaagtggctgtcctttggatgtttttgtcttttttgttgttttttggtgtgtgtttttgtttgtttgttcatttgtttgttttttgctcttatcttctttgatactcttgcaggtttgattgtggtataaagtggattcagttagctgtgtttcttgaaaatcttagagggtccaggctcacctcagcactcttgtggtgtgttctctgctctgggactgggcccctggctttattctctggccccttgagtttagaaacttgctgcattggaggggctgaggtgttcccagtccattggccacaacactatagtagggggtgccggccaaagcacttcattagagtggtggcagtgggatccattcttactcatgggtgccagcagttgtggagtcatggcagggtgcacatgcatctgctggggtgggggtactggcaggagcagagtggcagcatccctacataggttcctgctggcagtcacagcgcagtgaggtgcccgtgtgttggcagggacagggtggtggggcacacatgcacatgcttgctggtggtagagggagttgtgatctgctgtgcactcatgccagcaaagcagttgggaggtactatgggtggactggtgcacatcagcagaggctggcctgctggaggtctccaatggttaggcatggtctgctggcaaaggagctatgatgagggcccccaggaaacaccctggttgggcttccaaggctgtactgcaagcaggcacagccagcctggggccccaggagaggccagaaggcaaggaaattctcatttcagatgggccctgtcccatggacaagaccaccctgctttattcaggtcccatagtcactctaaggttaaaatctcctagaggaggttggtgagccttgggggatgggtgtcccctggctgtgctccactacagccattctcatgtcaaacactctgggctttacacagactggagtcctgcccctggcatctctctaagcagctgtcccttccagcacaagtgtccatgggggtcatggggtctcctgctgctaggattctggaggcccatggcaacagcaggccactcctcacctgttcaactcaacctttccccaggagttgctgggagccaggaatgagtcctggtgcttggcatccccatgcagggttcccatcttcctccaccttcagctcagcatctgtgtcctcccccgtctactctcaatccactctcaatgcctccccttcaaagatctgcttggaaagcacccgtcttcctgatgtctcactccctccatggcagatattcctcctggctgcatctagtcagccatcttgactcgcctccaaagtctttttaattaccacttcggttaaattagtaactatcattttacaatggcctgtgattctgttttgatcaaatattttgagccttttagcatctataacaaatgttctcaaaaatcaaaatcctaaatcaagtctctgccttagtcttatttctggggcttattaaggctataaaaattaatcaccataaggttgtacaagctttttacagcttccagtcaggctatgaactccagtatcaccacctccagcctgataattacatatattggaagaaaatcagttaaaggactccctctagacccttgaaagggtgtgagagacaacatggtttcgcctgccttcatgtgtcccagtccatccctgtggctgcctctgtccacctcagcttgcccactgtctttccttcccaactgtctgccctgctgacttctggcctcagtgacagatgcaaagacaaggcgacagccccacatagaccgtttaaccagtcccacatttgcataagctaaatggtcatgtcacagtctgttgcccaggctggtctcaaactcctgggctcaagtgatccacccaccttgacccccaaggtgctgggattacaggcttgagccacagtgcccagccaagaacccgtttttgagtgggcaccttggcacacacctgtaaacgcaacactttgggaggccaaggtgggagtgtggcttgaggccaggaggttgaggttgcagtgagctatgatggcaccacctcactccagcgtgggtggcagagtgagatcctttagaaaaaaaaaaaaaaaaaacttgttttctctgcagccgggctccgtgaccaaacacaaacacaaacttcccctccagagggtccaggaggggctgggctgcaggaggtgcttagggcctcttagggaatggtaagtgaccacccaacgcaggcactcagccccaggggcatatgcagagagagggtccaggaggagctgggctgcaggaggtgcttagggcctcttagggaatggtaagtgaccacccaacgcaggcactcagccccaggggcatatgcagagagagggtccaggaggagctgggctgcaggaggtgattagggcctcttagggaatggtaagtgaccatccaacgcaggcactcagccccaggggcatatgcagagagaggctgggaggacactttcagtgactggggttacaaaccccaaccataagacattgctggctctgtgagccgccacctccagaaatctcccacttagttcttagcacttatccactcttcccttttcctactctcaattcctggaggatgccctcctttctcaggctcagaccaacctaccagctccactctagacctgaacacatgactcctccctctgtctccacctggaaatctcatcagtgcctcacatttacactcctgaaaatcaggtcctgcctacccaccctcttgctccacctgattcctgccctgtttcagccagagaccttgcagtctcctttaactctcaaacccacccatgtcgtgtgagcatactgactgtgttctatgcaagaaagagcagtttcttggtggtcctgcggttttattagtccagaggcaaagcgttggcagagctggtttcttctgaaccctgggagggagattctgttttcatgccttttccagattctagaacccatattccttgctctgtgtccccttcttccatcttcaaaggccatcctctcatctctgtgtccatcatcacatcacccttcccctgactctggttctcctgcttccacttataagcacccttgtgattacatcatacccacccagacaatgcagggccatattctcccctctcgagattaatttaatcacatctacaaagttcctcgtgccatatgaggtcactaaaccacatgttctgggggtttgaatgtaaacatttgggggatgcattattcagccacccacaagcactgctccccactggccacacactatgcacagccgagatcatgcaagtgaggcacgttcatcaacagcagcttcagcaggaaactatatgctccactttcctgccatttgtatctggatttttttttcgctatcattgtagaaagagtggtattgtaaaattaaagatggattattttctttctagaacactttggcaatctatccaacattatttatccccttctgagtgtcaagtgtgaggtcattctttcattgagagctcaatgcctacaattatgataatgcatattgggtactttcacacatcagaaagttcttctttcttaaaatctgttcttgaattattcattcttctctagctttttgttgatctattttataattttagaaaaatcagaaagtaacttgaagtatctgtcatctctacaggtttacctccctctttgtggccttcagaatgtcatgacacgcttttcccttgctcatcacatggtttctatgtatgagacctcatcacaggagctgtggtcccccgggagcaggcatctgtggatggtgccttgctcctggctgctgggacctgtgtgctgccagtggcactccacgacagtgatttcccagctcagttttgcagctccagatggtgggtgagacactaggaccactttgtgaacagcgagggcttggggtttgcttttctaccatgtccagggctgctgttcatgagggaatgtttctaacctgacatcatggctgaagccaacttagaacctctctagccgtatggggagtaggtgagtgatacagatgttaattagctcagtggagccactcccctatgtagacatgttacaaaacattatgctgtacagaataaatataggtcatttttatgtgtcaatcaaaagagaaactaattatttaaaaaaaaaaaaaaaacctctctactcaagccgaaacctcagctccagtcccacaagtcacacaaggctgctcccgtcctgtgtatgttaaacctacctcagaaatgcaagggggcattcaggtttcattctcaattcaaatgccctttttaattttgtctattcctagcacctggcaacttccagctctttttttcggggctcattcattatttaaagcacgtataatttttcacccacattctaacacatgtagtactgtagagaatccttccctaggaggatctacagcattagaaaagaattaagaactccaatatttacaagaaggaaaaagcaaaaagagatcaaaaaatgggcaacttctagaaatagaaaaccctcatgagtatgatgataaatcgctggcacacatgtgaatagttacttgatgcttatagtgatgtctgggaaaataacatgaaatacttataatctgtttctcacacatgtaattcaaaagaatagagagaagatgatttgaaatattcttaagtttgtaggaaaaaagctacttccatatgcataattgcatgtattttgatactgccattattaagaactatctaagagggtccattaaaaataaaatttcttggctgggcacagtggctcatgcctgtatcccagcactttggaaggccgaggcaggtggctcacctgaggtcagaagttcaaaaccagcctggccaacatggtgaaacgctgtatctaccaaaaatacaaaaattagctgggcatggtggcatgcacctgtagtctgagctacttggggggctgaggcaggataatcgtttgaacccaagaggtgtaggttgcagtgagctaagatcataccaccgcactccagcctgacagacaaagcaagactctgtctcaaaaatattaaaataaaatttctcattcctattacagagtaatttaattcattaatgccctgccctgttacaaaactcatttgtaaaatactaattgtaattgtgaaaaaatggcaattgatactaattttaaattctaaaaacagggcacccatattaaagattattctgcagtaagagaattagctataacattttgtaataaggtggagaaaacattctccaacttacaatggttggtgagaagaaagtttccagcacggtagatggaccctaagagcccttgttgaaataataagacaaaaagatatacagagagatgagccagatgaagggagacagagagagagagagagagagagagagaggcacagaaatgagagatacaaagtgaaagagggcaacctgtggggtcatcagatatttgttttctgttttgtttattctaacataaaggcagtggtgggtcatcgatgtatttagagtttgcacaatcactgtggaacacagacagacacaggggaagaggagaaacacagggcggtggcttgcccttggactgttcttagttcctcaaaacgtaacagctttgcccaacctaagggaactttcagcagctgctcttctgccataggcctctttcctgccttgttttcatgtggctgactgtttctgttcctgcaggtcttagctcatcagacaggcatttattacctctgtgtcaacagtgggagcttccattactctctagcatgacactccccttcctcttttaggaaatttaacatggaagtgagtttgccatcggccttctccccacagtgttaacagtggtgaggaagccagcctgttccaccttgcccctcccatgattccaacactgagttcagacttgtcacatggaacttatctttgcatgtttgtggcacagacagatggacccaaccatggattagtggatggatggatggatggatggatggatggatggatggatggatggatagatggatggatggatggctgagtaggtgtgtggatggaagagtgaaaagatagatggatgcatgtatgggtggatgggtaggttgatggatgcatggatgggtggatggatgggtgagtggatgaatgggtgggtaggtgggtggctacatgcatggatgagtacttggatagataagtgagtggatggatggatggatggatgaatgggtatgtgaagggatggatgtattagagtgggtagttaggcaggcatgagctgatagtcaagtgattgttaaactgcctctctaaaataataattggtctcggctggacgcggtggctcatgtctgtaatcccaacactttgggaggctgaggtgggcggatcacaaggtcaagagattgagaccatcctgaccaacatggtgaaaccctgtctttactaaaaatacaaaaattagctgggcgtggtggcgtgcatctatagttccagctactcgggaggctgaggcaggagaattgcttgaacctgggaggaagaggctgcagtgagctgagattgtgccactgcactccagcctggtgacagagcaaagctctgtctcaaataataataataataataaataataattgatctcagccagcgccaagaaaaggcagtctcccaatagatagaaaacacccgaaactggtcatcagcagcttcctgataagatctcaggcattgggtgagtgggctcaagcatatgcactaagaggcaaagtggcagagtttaactggcacataatcttcctctaggaacactctaatagtaagagaaggacacctcaaatgagcatgtgcacatttcattaaacccactgtgtatgcagcccctcccaagtgctggcaggccactgtacatgtgggcagcccactccaagggaagaatcaagggagaagaaatacaaatcccagaaccatgtcaatgtataaaaccccaagtcaagggccggacagagcacttagatctctcaagtcgcccacttagccctcttccaagtgtactttacttcctttagttcccactttaaaactttaataaacatttactcctgctctaaaacttgcttgggtctctcactcttctgtatgccccttggccaaattctttcctccaaggaggcgagaatcaagttgctgcagacctgtatggattcgctcctgctaacagatagctggatgggtggacagatgcatgaattagtggatggacgtttggatgtgtgggtgggtgggtggattgtgggatggctggatgaatgcatggctggatgggtggacagatgcatgaattagtggatggatgtttggatgtgtgagtgggtgggtggattgtgggatggctggatgaatgcatggctggatgggtggacagatgcatgaattcgtggatggacgtttggatgtgtgggtgggtgggtggattgtgggatggctggatgaatgcatggctggatgggtggacagatgcatgaattcgtggatggacgtttggatgtgtgggtgggtgggtggattgtgggatggctggatgaatgcatggctggatgggtggacagatgcatgaattcgtggatggacgtttggatgtgtgggtgggtgggtggattgtgggatggctggatgaatgcatggctgggtgggtggatggatgcatggataagtggtggacggatggacgggtgagtggatgggtggatgtgtgtgtggatgggtggataggaaagccctctaattgattacagggctcagtgtgtgcttcaacatcatgatggcatcatcacattggtccctgtatgaagcagtgggggaggagagtgtaccaggggagcaggaatgacttttctccagaatcgacctctcccaccctgcagcctgggctgtgcaggccacattggagaaggtgcggtcgactactcctaaatgttgttgtgtccaatggcttgttgacgttgatgtaggaatgagcctacatctccaccatagatggaactgtttgggtccccaaagcagaaagcctcttctgttgcaggtgctgaagtttccatcttcttctgcttatacggaagctcacgcatcccttggatggcaggcgtcaggttcctgtgcgcactgagttccccccttacatgctttggacagaagtgtgagacacacaagattgctgcaggaagtccacctgtggggatgctgcgacttctccagcaagaacacgagtctgctcattgaccatcaccacacataacaaattaagtgtcccttttttgataacacgtcattgtttcacagagtattcttttaaagtgtataagttgactgcagttattattttttacttctgttactaatttactcataattaggcacaatttacacttaagaaatttcttaatagttttttcctccttaaggtgaactacagtcagataacatacttatcaattgtctctagctcttgtcagaaaaacatatagatgtgtgtgtgcgtgtgtcttggcctttccaatgatgaattaagatgtgcattgagaaggcattcactttatttgacgttaaggaagtaccaagaagacgctctccacagaccctgggaaagccagcagctgcaccccgaggctgtgccaggcagggaacaaggaggcagcaccacctgctgggcagggaaaatgtcctcccagtccctgccgcttctctgcagaggcacaaagagctgccccttctcctgggccttctcctgggctgatgagattgctccccgatatgccaaatcagggttgtgcatctgaggctctgtctagactctcagctccttcctactcctgcaaagtgaagaaaacaatgccaaggggtcctggaggcgtctctacccctggagagttttgactctcttcaatagtctccactaccctgccctcactccatgtcctccgtttctccctaaagcggtgcccagtctgattgcactgtggcagggataacgaggggccaggacatcaggggagagaagtttctacctgagtcacagcagcggctgccctgcagactcctgaagacacaagacacatttccatcccagagacccagcgaaatgcaacctcaggctagagacagccagttattttttcttgttctgtcctggagaggccactgagaaagtcgagccccttgttgaggaaaacatgagatctctgtgtgtcgtcctctgcctgatggctgtacctccatgtgagtgtctcagagatttcagaacgggggctgtgggctgtggtgtccgcttgtgactcatctctttgcttcttgtccctgagtgtcctgcatcagatgcagctactggagtcatgcccagggctggtgaggtcctcacagacctctgggcctggacccagcagccctctgggaaggcgctggggcacctcagctccaggggcagcacacacttcagcccagcctttctgggccaactctccatctgtagagacacatccaaggcccagttatccctgcagctgagctccgtgatggccaagggcagggccgcacattcccgtgggagacagaatggggacctcagcgtgagcccagacacaaacctccctgcagggaagcacaagaccaccaggcggcgctccagaccacacagcggccccagaagcaggttttagggggcggggcagacgtgtccgcgttgagtcaggtcattggttttactttccctgagcaaacggcctctgccaaggactcactgcacctctcaccttcacagttgttttttttttttttttaatcaccctgtagagttttgctagctaatttagatattgaggagtgcttcatacttccttgggcctctgcttgcagaaacatagcaattgtaaggaggcacgtgggaaagccccggctcggtgacccgggggatgctgctgtggccctggcaagagggcgtcgggccgcagtaacaaaggtgcagacggctctcagcctgcgcccgcggagtacaacacataagggctgtaacctaacgaaaaaagaatcgcagtgcaactgtcctgcatttgagtttgtgatcagttttgccctttgtctttaacaggttctaacataaaattttgaatgttggttcaagccctgtgggtaaaatgcacttacccacattccttaaacaaatagaacactgaggtggaaatgttttgaaaaagtagttttcagacatttggaaacaagcatcacaggatcataacccctgagaaaagaaaaacaaatgaacgaatcctgctattgcctgaaagcagctgccaggacacacggaaaggcttagtgagctgagcggacagagagcagagttcaaggcagcagcagcccgaggggaggagcaccggggagcaggctgctgtgcagccaggatgggccggggtggggcggggggagaacagctggagacttgccgcagggagggggatccctcaggtttggggctgagaactgacttatgcctgacttatgcctgcatgaaaagaaactactcgatatcagggggaaatcaccagaaacctgtggacccaaaactacacagagcctacacaaggaaagcattgtttgtgttctcccagccagggtggaaagaccttgagatatgtaaagcttcaagcaatcttccgaagtaatctcgtgagtagtggtgccacattaattcaggactaaaggctgctctgaactgaacctaagaaatgcttcaagtgtagcctggagcccgggtgcagtggctcacacctgtaatcccagcactgtgggaggccgaggcaggcggatcacttgaggtcaggactttgagaccagcctggccaacatggcaaaacctgtctctactaaaaacacaaaaattagctgggcgtggtggcagatgcctgtaatcacctcccacctggacccttccttgatacatcagaattacaactagagatgagattggggtggggacacagagccaaaccgtatcacataggaacctaaaaggataataaagtaggaaaacttcccacatcagtaaccctttatccgatagtaatcccaatctgcaaagtaaaactgtgtgattttactaagataacggaatcttctctacagaaggactttccagtgcaaaagctccccaccctcaccatgaaatgcacgtgaccatttccaatttgtgtaaagtcctcagttagtactgagacttcggaaggttagaaatccctttgctcatgctgcatggtccggatgagatgtaagaatcattagctaatagacatgcaacagcttttgtgtgaaagatgttatgagacatttaaggtatttgcttgtgattactaagcattcattgtatcattggagcacatgtgcttttataccctggagaaattccagtaattgaattgctgggttgaatgggattttgatttggattaaatttaaactatagattttatttagggaaaactggcatcttaattatgttattggggggcccttgctcccagagctcccaagatggtggcaggccgcttccaaaatgaccgcaggccacttccaagatggtggcaagcctcatgttctctgacctggggttcttggcctcacggattccaaggaatggaagcttgggccatgcagtgagtgttatagctctattagaagccgtgggtcacggaagagaaccgtggaacccagtgactagtgttcagctcgattaggacgaacccaggcacttagccgtgcaggaacaatggcgagcatttggcccgatcgagagtggcaatgggcgcctcgctggatcaggagcacagcggataccctgatggatccggagggatggaagccagcggtgggtctcccacgggggcaaacagcagtggtggacggtgagcgaaagcgaagctcgagccgtaacaaacatggaccagaagagtgcagttgcaagatttagtagagtgaagacagagctcccatacaaagggaggggacccaaagagggtagctgttaccggctcgaatgcctgggtttatatcccgatcattgtccctcccgctgtgctctcaggtgatagatgattggctatttctttacctcctgcttttgcctaattagcattttagtgagctctctttactatctgattggtcgggtgtgagctgagttgcaagccccgtgtttaaaggtggaagtggtcaccttcccagctgggcttagggattcttagtcggcctaggaaatccagctagtcctgtctctcaattacactgagttttccaatccatgcatccaatatgtggtgtatctcttcatatgttcatagcctctgagcaatgttttacaattttctgtgtaaagaactccacatcgttttatgtttcttctaaggtatatcctgattgctttttatgtcttcacaagttttttcctttcaaaattaattttccaattgtttggtgctaatatgctcaaatgtccttgattttcttagtttgaacagtccgtttttgttttggggatttatttttttttcagattctttaagattttctatgtctataaccatataatctctgaacagagacagttttgctttttcctttcaacttgaggtaggttttctgggtagttcaggacgcgcaggcactgggtgggtggtgttagcagctgcacgatgccttggagaggacactctcgggggactgtggccgctgctcagctgtgaccgttcttatagcaccagcagctgcggccaccattcttatccaatttccaaagccacaccacaggccctctcaagaacgaggcgtggaggctatgccctctcctggacacatcatcattcccaagccccacgatgtgggccccatgggacgcacacctttgtctgtccagacctcagccccacctcctcatcctgcaccagaactcttcagagcccagtgcatgaaatgggctaccaaggaaatgagggtaggttcctgagaggaaactggccctgcatttgggagctaggagtctgctaattcgcctggcagccctgtgcagccctccgtggctacagtccaccccgtgcccatcagtgcctccttcctgtgcaagcctggacctcgccctgggctcaggatgggctgtagaccgagaatgcaggcgggaaagtctttgtctatcggggccatagtcaggttctacagtgagtcagggaaagacctgtggaggtgtggatgaggacaatgggtccaccatcaacaggaggacacgggttcgaccccttgcagaggcacagtcccacatcactgggaggcagccacactcactgcctcgccctctcctcacacagtgcagtttccacgttcacagccccagccagtcaccaggaatgccctgggggcggcctttccccagtgcactccgagccctcccttggctgtgcggtgagctccatgcccaggagatatccacccatagtcctccggaaagcagctgacctgccatgccctggaaccacaaatccccacagatcagccagcctgcagtgggccttggatgtggtgaggagtggtggcacccccgttcccaccccacagatgcaacgcctgtgggtgacgcatgtgagtactgaggagtagagggtagaactgtaggccccgagaaccacagaaactcgggtgttacactctggggccatgtaaggagaaagtgtcactggacagaaacaggcccctcctagacactgtgtgcgccatagtcacctgtcattagctctcactcttgcagattcatgattgaggtggttaaaaaaaaaaaagctcctactcacccatccaaccccatcctggggtgtttccaccacccttggggtttgggatgagctgcccttgcccactgtgctctgtggacctccctttagaagctcacagctccctgcactcggctccatcctgccccaccacacagaagcaaaacccctctcctttccactgcaggcttttcctggaccagaatgctgacctgctgcccttcactcccgaagtggtgggactgcctggggtggtgtgggtgttgagccttcttactctagggacctggcacctggccccaggggcacagggatggtgcatctgcctagggatgcctcctcatgccagggggtgggggttagtaccatcggccctcaggatttgttgcatgaatgagtgaatgggtgaataaatgaaggggatctgatctatgaataagggtatatagactttggttgatgtaggacgccaaatgctggaatttcagagtcatcacacccaggggccctgcctctgagctcctctttgcatccaatctgctgaagaacatggctctagggaaacccagttgtagacctgagggccccggctcttcaatgagccatctccgtcccggggccttatatcagcaagtgacgcacacaggcaaatgccagggtgtggtttcctgtttaaatgtagcctcccccgctgcagaactgcagagcctgctgaattctggctgaccagggcagtcaccagagctccagacaatgtctgtctccttcctcatcttcctgcccgtgctgggcctcccatggggtcagtgtcagggagatgccgtattcacagcagcattcacagactgaggggtgtttcactttgctgtttccttttgtctccaggtgtcctgtcacaggtacagctgcagcagtcaggtccaggactggtgaagccctcgcagaccctctcactcacctgtgccatctccggggacagtgtctctagcaacagtgctgcttggaactggatcaggcagtccccatcgagaggccttgagtggctgggaaggacatactacaggtccaagtggtataatgattatgcagtatctgtgaaaagtcgaataaccatcaacccagacacatccaagaaccagttctccctgcagctgaactctgtgactcccgaggacacggctgtgtattactgtgcaagagacacagtgaggggaagtcagtgtgagcccagacacaaacctccctgcagggatgctcaggaccccagaaggcacccagcactaccagcgcagggcccagaccaggagcaggtgtggagttaagcaaaaatggaacttcttgctgtgtcttaaactgttgttgttttttttttttttttggctcagcaacagagatcatagaaaaccctttttcatatttttgaaatctgttcttagtctaatggagattctctaatatgtgacaatgtttttctcttgctgtttttggaattctttgtctttgacttttgacaacttgacttttgacagtgtgcctcaaagaagttctattttgggttctgtgaacctcctggatctgggaagttttcagctatgatttcattaaacgtgttttctacaccatttccctactcttttggaatacccataatgcaaatatttgttcacttaattgtgtcccataaatgctggggattttcttcattcctttttactctttttttctttttattcatctgcctgaattatttcaaaagatctgtcttcaacttcagaaactcttttgcttggcctagtctaatcttgaaggtctcaattgtacttttaatttcattcattgaattcttcaactctggaatttctgttggttcttttttatgatacttatctctttgttgaattcctcattcaaatgataaattgttttcctgatttcactgaattttctatctgtacactattgtatctccctgagtttcttagagattatccttttgaattatttttctgacattctgtatatttccttatgattggggtctgctactggagaatgactgttgtctttttcaggtgtcgtgtttcctggccttttcatgttttatgtgttcctacgttgatttctacacatctggcggaccagtcatcccttgcaatttaatggagtaggttttgcaggaaaagacttcctagtacagacgggtctcagggtgtcagtgtggcggggcgtgctggctttagttctaggttgacgcagtagcgtagtctccatgtcgtttcttcagctgccgtccacattggtgacgtttgcgagtgtctcagtggcctgggctgagaggtttgtggcagtggaagtgcaacgttgctagaggtggactcaccaggctgtttctgaggtcgaggcacatgcatgcacatggtggattgaccaacttggtgccaggctcactagggttggggacatggggctgtttctcaggcccaggatgcaaacacaagtctctttggctggcctgggggtgtggcttctgagggcaatccacagggctgtttctcaggttcaggacacaagtgcatggccgctcaactggcctgggcatgtgtctcccagggccaccccatgggctctttctcagacccaggacatggccacatggcttcctcagctggcctgggtgtgtgtctgctggggggctgcaggggcacagggttatttctcaggccggggtcatgggcgcacagctgcttgctggcttataggagtgcctgccaggggtggcccatgatgctgtttctcaggcctaatttcaggtgcagagcctttgggcaggtcaacggcatacctgtggaaattggagtggatgccacagggctatttctcaggtgcctgagtgtgggcacatatccactctgccagcctggagttagtatcaggtgctcggtggctcaggggcctctcctgctcaggggagggccctcagcagcttggccaaatcaatggtggattcaccctgggcaggcctggcaggctcttcctccagctggatgtgcagcagcaggggttgggttttttgctgtgcagggccagagtcacggccaatcctcagcctaggctctgcacagccagggttgtggcattcagccacccagatatgggcatcctgaagatggagccccaatgctagaaaggggcagtggctaccagcctcagggcaggatgcactccagaggcggctccggtctcaaggtggcgctgggctgcagcagctaggctcacagtggatgaatgggggcagggagtacacaccttgtgctcctaatctgggatcattcctggcagctcccaaacttggctgagggcttgcaaaacctgtggaattctcctgttgcaagggctgtagatgtttgcagtggcagtgggtgctggcgggaaatctgcttaccttttccctacatgggaagtccctcctgtgtccagaccaatccgatctgggtggggaagacaaggctgcaaaggccaggtgcctccatgctgccctccgatcaccacgggtgcgtttccacacctccactgcactccgtcagtctcccttcaacactccagtcaaaccttagctgtttcttctttgccttattccttcctcatggggagggtgtgggtgaacaccaggcttctctaagttcttcatccatcttgctgatgtcattctccatccaggcatgggtttttaagaagtagtgaatactgaaatttcagcagaggacacctctataaaaattctgcaactggaaaacctccttaaattggctgattgtcattacaattggaggaaaactgccaataatttcaaatttagaaggctgagactctataaacaaagactaacaatatgttttctgatatttttccccaaaataatacttttccaagacgaaaatttttccagggtatataagcacatgtgctccaatgatacaacaaatacttactaatcataagcaaataccttaaatgtcttataacatctttcacacaaaagctgttgcatgtctattagctaaaaattcttatgtctcgtccagatcatgcagcatgagcaaagggatttttgaccttcaaaagtctcagtactaactgaggactttacacaaattggaaatggtcacctgcatttcatggtggtggtggggagcttttgcactggaaaatccttctgtagagaagattccattatcttggtaaaattacatagttttattttgcagattgggattaccaactgataaagggttactgatgtggaagttttcctactttattctcctattaggttcctatgtgatatggtttggctctgtgtccccaccccaatctcatctccaattgtaattcccatgtgtccagggagggtccaggtgggagtgattagatcaagggtggtttttcccaggctgttttcatgatagggtgttatcatgagatatgatggtttaaaagtggcaggttcccctgctctctctctcgcctgctgccacataagacgtgccttgctttcccttcaccttctgccatgattgtaagtttcctgaggcctccccagccatgcggaactatgagtcaattaaacctcctctctttataaattacccagtctcaggtagtatctttatagcggtgtgaaaatggactaatacactatggctttgaattaataatttaaaatttgtcagcttggcaataaaacatcctgttgacatttattttttaggtaatattttaaattggcagtttcattcatgtttttacaaattcttattttcagggtgtttaaggcctttgctttgaacttggtggttccttacactccatgctgttagtgaagagggaccaggttgggaggcattggtttgggtggtggtcaggaagggcagagtgatttgagtagggtctgagtggataatagctcatcagtttggaatttataaatgaccagggatgatttaaggagattcctgccagacacctatgccatggccatgccctatctggatctccagccgtgagatgagaacccagccatgcgggggagtctgttcgttctgctcaatgttgtaagtggcacatgctattggataatgtagaattgaatggatatcattttattattataatttacaaacttcctacaataaacttatcacctttatacatagaaacaaatataagtacattttccctcccctatgtcattttgagccctctctccaaaccatcctcccactctgcgactcactgtcctgcatttggctatgctctggcaagtcctgcttagacaagcactcaccagaccacctactcagcctcccttcagcgcccacctggcccacctgctcaaatacatgttgagtggtcacacacatggactgaacaccatctattccatgcactgccccagtgaccgcactgagcagcaagagagaaatgatcgcattagctatcaattatgccaattcaaatgctggagtctttctcagatacttttcaatgttcaagaattgttgattgtgaattctatacccaatgaaactatccttcagaaatgagcagaaaatggataccttctcaaataaacaaaaactaaaagaattcttgctacaagatgtactcttaaagactggctaaaggaagttcttcaaacagcaaggaaattgaattgatcttatgtcctgcacacttgctaaatttcctctcaattttagcagcactgtttagattccataggattttccatacaaacagtcatgtggtctatatatagagacagattttcctcttttccagtggggataaatttatgtctttttctttctgtgttacagcaggtaggacctccagtacaatgttaaacagaagtggtgaaaacagacattcttgcctgtttcctaacgttggagtttggtcttttactatggtgtcagatgttagctgtagggtttttataaatgcccttcatcacattgaggaagtttgctcctatgcctaattttctgagagtcttttaatgtgacactcatgctagaatttattaaatgctttctgtctactaagatgattatgcagttcttatattaacatgaataattacatttatttattctttaatatcaaggcaattttgcattcctgagacaaaccccatttagtcatcatgtgttgttattgttacatattgttggattcaatttcctcaaaatttgttaagaattgttacatctatgtttacaaggaagattagtctgtagggtattttttcttataataactttgcctagttttgcaatcagggtaatgctggactcacagaatgagttgggaagctatttcctcctcttcatttttctgaaagaatttgtataaaattggaattatatcttccttaaaggtttgcaagatttcataatgaagtcattggcctagagttttctttgtgggaaagtctttgtttgtttgttttgtggtttgggtttttttttaagagacacagtctcactctgttgcccaggctggaatgcagtggtgtaatcatagctcacagcagcctcaacctcctgggctcaagcaatcctcctacctcagccttcagagtagctgggactacgggcatgtaccaccacacccagctgtttgtttgtttgtttatcgctttgtcttgtttttgaggtcttattatgttgcccaggctggtcttgaactcctggcctcaagtaatcctcatgcctcagcctcccacagtgctggaattacaggcatgagccactgcacacagactgtgggaaagtttttaactaaaaattcaattttctcttccttttccagtgagctttccagtgtctttcaattaatgtatctattttatctaagttgttgaatttattgtcaaaatttttttaaacaatattcctctcttagaggttgaacatctgtagaatctgtagtgatggcacctcttaaatccctgatcttgctcatctgtgtcgtctctctttctctaatcagtatgcctaaagtttaatttcattgattttcttaaaaaactggttttggttttattgatttttttccctagttttttgtgttacatttcattgacttctgctctgatatttactatttcctttctactgcctacagtaagtttaatttgctattttcttagtttcctaaagtggaagctaagtttattgacttgaggcctttcctctgtctggatgcggatatttgctgctaaacatttccctccaacaccatgctgtgagttttagttacagcgggcttggagttggcctgagaaattctacttaaacagctgcacctatcatgtaagtgataaatgatgtacctgcctggccctcacccctggtcaaagaatgggatgtactaatgagcaatgttgctgcgtagctgtggatttcaaggtattttctgtgtggttttatcatcagcattgtttgttgatgactgcaagactgatgatttgcacctggcctcggtgagatccccgaaagaccctgcagatgggctggttacttagcagaaaatatgacaacgtggccagcaggaaacaggaaggtacaatcggctgcaggtgagctgttggaagtaagttccaattttcctattttgtatttgcattttaatagtgagactgcgcttatgttatttgtgtgaaacagctttattcatagcactgtaatttaaagagaaaacccattcatgggaacaacaaacgacctagacaccaaggtagctcatgccatccaaggctatactgtgcagtgattgggaaaatgggcactggtcccagaagtctgatcgacactctgccactggctagtcccgtgctggggggcgaggatccacactctgccactggttagtcccatgctggggacaagtatccacactctgccactggctagtcccgtgctggggggcgaggatccacactctgccactggttagtcccatgctggggacaagtatccacactctgccactggctagtcccgtgctggggggcaaggatccacactctgccactgattagtgttgtgaagatttaaataaagaacccacaccatattctttgacttgtgctttccgtatactgagagatagtaagagtacattattattatttataaagtaaactagaaagcacatgggaagacaagaagaaaacctgaataaacatgaattaccccattttcctcaggagaaaactttcacactctgaaggtacacaaattagcctacaaatttaatgtaaagcaaatagactgttgtaggtaccaattctcaatgtcacagtgttacatggaaagtaaaatacacaagaacagcccaaaagatggaaacaatggacgtggtcaaatgacatcagtacaacatccatatggtcctaagtagccatctttaaaatgggttagaaatgccttcaatcattcacacagacacatgcattgaacaaactctaagaagtgttcttacacgggaaaagcaagttacagatgcatgggcatgatatggatgtagatgtgtgtatgtgcatcccactcatacacaaaatacccagcatcgcccacatgcctgctgtgtgcgtaagtgtgagcgagtgcacagacaacagcgtgcagaaattcaaaccaagctgtgggtacttgttaccactgggaagggagtcggtcacagagggaaagagaaacaggacatcagcctttgacttcagaactgttcctgccttttcacatcctgtgctgttttcagcatcatcggagcccttaacacacatcacgggagtaagagtgtgttagagggagcattcggtgggacagatattgccatggcttgtggatagagttcacagtccttaataatccccgagatggcagccaagagctacgttctcaatcacgcagcttcaccccagaaactgacagaaacccaacaaccaaaaggtgtccattctgacagcctcagcctgtgctggctcagatgagcaaaaatgtacagatattaataatgatgttgatttgaagagcacagaggggggtatgcatgataagggtccaaatttttaccttaaaaaagaatacatttacttctcaatcacctacataacgatcattttttaaaaaactgatcaaatttggtgttacaagggcacgttgcaaattcttctggctacttttctctgactattctaattacgttaccgtgttttctcctgtatgtgcccgttcatgtgaatgtcatttctggctacttttctctgactattctaattacgttaccgtgttttctcctgtatgtgcccgttcatgtgaatgtcatttctggctacttttctctgactattctaattacattaccgtgttttcctgtatgtgcccgttcatgtgaatgtcatttctggctacttttctctgactattctaattacgttaccatggtttctcctatatgtgcccgttcatgtgaatgtcatttctggctacttttctctgactattctaattacgttaccgtgttttctcctgtatgtgcccgttcatgtgaatgtcatttctggctacttttctctgactattctaattacattaccgtgttttcctgtatgtgcccgttcatgtgaatgtcatccaggcagatttcccaaatccggcttcctgtaaccaagggctgaaagagggaacggtttcctgggaatcctttttgcagtttattttacccggaggcagaagcccacggttccgtgaagagtctattgctctcccctctctccttttgtgtctctatttttaattgacaaaaaagcaaatgtgaagattcctggggtacaatgcaaagtgacaatgcctgtctatattgtgggatgattaaaacaaggtaagtggcatatccatcacctcacacacttatcattttgtggtgagaacatttaaaatctcatcttttagcaattttgaaatagtcattattgttaactatagtcaccatgctgtgcaacagatcaaaagaactgactcctcccatcagcagaaacttcatgccctttgaccagcatctctcctttccccgtccacgactaacccccagcccaagagaacagccaacacccacctcgctgctgccacacgacatgtcgggctttgatgggatggaggtgagggtggggaagacaattccaaagctggagcactggcctcacagctcagacactcttctacttatcctgagagaatgatgtgctgagaccaactaaacctcccctgctcttcccacatggcagaaaagaggcaacccagggaagccattgccaggacatcatggtcacccaacccttgtgcagaaaggaagcacctgcccaggatgccatagcacccaaccctcatccccaaggaaacacagcccagggcaccatggacacccaaccgtcatccccaggggaggacacagcccagggcaccatggacacccaaccctcatccccaggggaggacacagcccagggtatcttggacacccagccctcattcctaggggagtacacagcccagggcatcttggacatccaaccctcatccccagggaaggacacagcccagggcatcttggacacccaaccctcattcccataagagcacacagcccagggcatcgtggaggcccgaccctcatccctaggggaggacacagcccagggcaccatggacacccaaccctcatccccaggggaagacacaacccaggccaccattaacacccaatcatgtgcagggagggtgtccttggagcctgggactcttgccagtgaagcggtggacaagaaactgaggatgcgatcagcacacagaaatctcaggcagcctaggatacatgaggcctctcacccctgggaacactgagcagccaccaggagcccacaccttgaggtacagcaggagccatgcgctcttgctcttgctcactcacactcctgcacacagccactgacacacgccctcgtgcacgttgcagattaactccactggccttgcacttgcaacgctggaggctgagaggtatccccaggttcttttctcgtgagaggggcaggctgactttcactctcctccatgtgctagaggcagctccaccaacactggctgccctgagtggatgcacctggctctggaattcctgtcatttgctttggatccaggagcccctgcctcatgtagctacttaacagaaaggaggaatccacccaggacatgcccagacgggagcctcacaggatggacagtggtgtctggggtcacgggcagccctgacccagcagcgccagcaccagcacacccagtggggaaggcggggaggcccaaacgccacccacagtttgttactccactgggtgggacccggcacccctgccttcctgacaccctggagtccctgcctcctcctagagcccccaagcccatctgcctcagagcatccagagacagacctggggagccatttcctcaggccctggacaaggaaacagggaattccaggttatgggtgcctggggcaggtctcaggcaggtgctgggaaccagagagaggggtcaccgcgaggcctcaggcctggcaccagcactttgagcctcagtttaccagcccacgaggtgctgagtctggactggatgaccttcccacccccagtgacctctgccctttcccgagcatgtcagctctgctccagcatcctggtgtgagcgcaatgccactttttttctcaacaaatacgaaaggaggaaggtgcccccagggccctgtgccctgaggatgcctgtgtggaggggtccatttcatcactggtgtcactcacaggaagggacgaagccacctgccttgacggagcttactccacctccgccgaaggccggggaggtccctcacagagaacctgaggcccagcaggctgcagaggtgctggcatggaatgactgctcagacgcccggggccggcagagaggacggatgtgggggaggtgcacactgaggagcctctccttggaggtggagacacgtgcaccacatggaccaggacacagtccacgaagcctcgcatccccctgagctgcagctcaagggcctctctctgagcccagagtcccacccctgggaggcagctgccccagctctgagggaggagggcatccaccaggccctccatctcctgggggcaccagcccagcccagaggctctgcaggactctgcacctccaattcatggccaggactttctggatgtatcttaaggactgaggactccacatcagggaccacacaagaccggggtcccggacacgggggttgggggtgagcatgtcaccgggatgggctgtggcgtcactctggtacttcatccggacagccagggaccaaagccacgccctcagccccaccccacccctgcctcacatggcaacgcagggtctgcagatgcaggagagtgagaagcatggtagccaggcagactagaggacccgagctggggttgagcacctccctgtctacccagggcatggcctgtgagactgcaggtggcctagtgtgtgctgcaggctcaaggtcctgccccagggagcatgacattcaggcccagaaattgcatcgtgctgcacacagtccaaggggataaccctgtgaagttcaggtcaccagcaggcttggggtcaagaccgagctgcagaggacaggtttctggaaggcacagcatcatgggtggagggacttggagcaaggtccttagccccgggaccagtgaatgtgtgcccttatagggaaagggggtctgtgcagaagcaagttagctgaaaatcatgaagtggagaggctcccctggattaaaggggtgagccctaatgtaatcacaagtgtccttctaggaggttggcagagggagactgacatagacagaagccaggtgaggtgggaagcggaggcagaggccgagagagcagacgctacgccctggccctgaagacggaggaggagccgagagctcagggatggagagactggaggaggcagggaagttctccccgcaagcctggagggagcatggcctccagcacccccagaccttggccctgcaggattcatctggacctgtggtataaatggtgtttaagccactgggctgtgcaaattgtcatagcagccatggcgcattcctagagggagccctggtggggacccagcaggcagcgacggggccctcacaagcctgtgagccactcagagccgcgagagtggctaggcttggtgaggtgcaggccacgcgcacctccactaaggcagccttagggcccacacatcctctctctctctctctctctctctctctatctctctccctccctccttccctccctcccgctctcttggttggacagctctccatcatccccctggacacgaccacctcccaaggccgagctggggcgctttgctcgaggtgagcactgacatcctgggggtgtgaggggcacctgcccagcggccccgtgtgcaggatgggcggtgggccctagctggcactgggcatatggcccggctggtgcctgcaggctgcagcttttctggggtggctgggatcagtgaaggcctccagagtctgggcctgggatccctgcagtgctggctgaggacaggcggggctgggcagtgagggcactgggtcactatcaccacccacggtttattacttcactaggtgggacctggcacccctgccttcctgacaccctggaatccctgcctcctcctacagcccccaagcccatctccctcagagcctccagagacagacctggggaggcatttcttctgcccccagcagaagcccgggaggccgggaaggcacagtgggtctaaaggagaggatcccaggactgcctgaggggtgactccgacgaggcaagcatagagcccactgagaagcggggtgggagccccaccagggatgggctagttcctcatgaaggaccaggacccaggaaggacaagggggcctgctggggcagggtctgctatgccggagtccctgtgagcctggcccagacctgcctctctctttcctcattggtccccacaggtccgtggtggttgccgtatcgggaggccccatggtggcaggggtgggacacctggtatacgtcgccaggtgtgtccaataggctcatgctcacaccttctcctggcacctgggcaaagcctgagcacccaggcactgaagtgagggcaaggcctcggggccccacaggatggccgaggagacagctgcagggcgcctgggacccctgggctcaggaggtagaaggatacagcctgaaaacccacaccacaagctcaccggccagtgcaggcccacagagctcgaggaggcagccctgagcctcccagggagagatgctctgtgcacgccggcacaggccctgggttacaaaccctaggcacagcccaggagaggcccaggccccagtccagcaaggggttgcaggaagcaagaggtccccggccacagcatgagataagcccatcaagccagggccaggtgggcaatgggaggcaggcagggcttgggggtgagtccctgctgcagcgccgtccactgtcgaccggaggagtttcttccctgtgcggagtccacgggcctcctgtgagtgtgtgcatgggcacaagtgtgtgtgtggctctgctgtgtgtctgtacacacgtatgttttgggtttttttgtgtctcagaccacagagtctgcccctcccaccaaagcccaggcagaaggatgaacccacgcccctggggcccaggcctcagcagcctctgcaggatcattgttcccagttgtcacttgcctttgccacagccctatttctccacaattccttaaagtcctcaacatgcatttaaggcacaaaggtgaaactgcccagaaacatctgactccgccgtggaacccaggagcaagctgggttagctaaggagcggggccgttggcagaggctggggatccaggctgaactttggaggaggcatgtgccagcatgggctcctgactatgtcctcctgggacaaacccaaacccactctttgaatatgggagggactttgctggccccggccctgaccgcagcacttggaaactgaggagtggtcgcctcctccgtgtcacagctgcccgttcaccatcatagaagcaactctgtcacctccatgggcccctctgtggctgctgcctgggtccaagctgagcccagctgcccaggcccagaaggaaagcccaggccaggtgcccagcacagaggcagtcacataccccggggagagccacagcaagcagccaatgttgcccaggagaggagtagctgacaaggtagaacgtgagctgccatcggctcgagaggctttgctggtcctcctggggctctggacatgaccaggaggagcgagggaagaagtcgcatggtggtcccatcctgggtggggcctgatggcagctggccacccgtcccagagtggcagccagatgccagcgccattcccacagtcacatcattggtcacagaatgcaggacatagagtgtcttctttccatcacagtgctgtccagacccatagcctagggtagacctggaagattcaatgtccacacccggggctggagcgtagccatgagccacgccccctgcccgtgcatggaaagccagcccaagctctgctccatccctagccaaagtcagtgtcctttccccttctcccaagtgagctctagccacctgcctaccctgccatctgaggatgacagccttcattccattggaacctggctctgccaccagcaggcttgcagtcctgggcagactccgtcacctctctatgcctcagcctttccatctgcacaggaggaagatgatgatggtggtgatgatgatggcgatggtttccttttgcatctgaggcaaggactaattgagatgatacacatcaggcactgggtatggtgctggtccttcctgagcactcaatctatgtgagctgtccttgtgaaatgggtgtcaccacatttccccacgcagaacatcctttgtctgccatacttgaaacatctgccccaatattaacagttccttcatggaagatgtgcacacccacccaccctcatactcccaaaggtgcccgtgctttatcaagccaaagtccagccaggaactttacagcagcatccctttccctctccaagcaccaaggagcaaggcaaagcactacatcttccatctggaggcaatgccaccctcttctcccattttcactgccatccctaagaggcagtgcttccccaaaaggttccatagcagcctgcctacagcaactctgttcacacgagtttcagcatccttgcagtggctcccctgccatgctgtggctcttcattcaccctcttctcctgctccccgtgacaggcatagattctgagtgatctggatacattgctttgtttaataacattacagcttctgtgctgaaaaagatacagcagatagagaaggcaattgttgaacacaaaatagtgacagcagagatgacggcaagttggcatttttcttttctagcaataaaacttaaagctgactcaaggagaaatggaaatcataattggaacagtaatcctcaagaaagcattaagattattaaataattgccctcacagatgacttcaggccaagatggctttatgggtgaagtttagactttcacaaaactaatcagttcccataagaactgctccaggatttggaggaacatgggaaagtctattaaagggatcacaattcacagtccccagagtaaaacatgggctaacttgcattttggcaaagagccaaatgttataaatgacatcctagaaggccaaattctgtccatctcgttgaacaaggacttacaccaggaatttagaactatttatagctcatcccaccactcaggccaatgatgacccatgatcatctcaccagaaatggaaagactcagatgattaatagagtctcaatttctctgagacatctaagagcccagcccaagcccagacccaggagggcacccaggcctggacagagaacactgatatcacaccagccctccagagggaagcagagactccttcaagctctggaaacacaggcccagacagctgcctaaagttgggcaggcttcactgcaaacccaaatcatgaagctaggtaacacctttacagattctttacatttaaaaatcatcaaaacaagagtaaataataaactcaaataatattaatctaatatgtaaaggtcttgtaccattattatgcaaacaacatacataagctaataagaaaaagaacaaatcccttaagaaatcggcaaaaaggatataacacaatttctaaaagaaaacaaatggctagcacacataaggaaaacactttgtgaacagacattcttcagaacattatttataattataaaatagttgaaagcaagatagtgcctgaagaaattatggtgcatacattagtgggactattctgcaaacattcccaattatacttgtcacatatctgtgataacgtgacagccagcattcatggggtgacctcatttggtaaaagggtgcaaagctcaacacgcattgtgagatgactgtggtgtaaaattagtgggattattccgcaaacattcccaattatacttaccgcatatctgtgataacatgacagcattcatggggtgacctcatttggtaaaagggtgcaaagctcaacacgcattgtgagatgactggtgtaaatacaaagaccaaactgtgaaaaggagtccatcaattaatcgatgcttaccttcagttttgggctaatttttaaagtatgctataagcatatgctcctgttataacagaatggagggattatgagagatgatgcaggtgtgtcctgggcctcccctggcccactgggccctagagatgccttcccaggcatcgctgtcagggcttccctcagagggagtcctgtattgacctcaccaccaaggtctggagcaggggatccttagatattggttggggttatctcaccttaggtctgaatttggggttgtcttagactgttttgtgctgttagaatagaatacccaagactgggaaatttatactgaacggaaatttatttctcacagttctagaggctgtgaagtccaagagcacaggtgccagagcaagtccaagagcaagggaaagtccaaagcaagtccaggagcatctggcgaggaccttcttgctgtgtcatcacatggcggaaggcaagaaagagagcaagagggggccgaactcacccttttataacagcaccaatcccacccatgaggtggggaccttatgacctaatcactcttcatactgttacaatggcaatgaaatttcaacatgagttttggaggagagaagcattcaaaccacagcaagggtgctcctacctcctctctcagggcatctgcagaaagagctgcaactgcacgtccttcctccgtccatcctccatcccttcccaatgtccgtgcatatcctgtgacccaggaggtctggcatagggggtgctcctgccttaggtctgaggccctgtctgaagaggggtaggtgaggaggccatctgatggtctgggccaagacagtcacaggacgcatcatttatcatcaaggaggctgagggttgagtctccaggtccagggaactccccacaaagtgggaaccctgcccagctccacacagcctctgctgggggaccctgctctggtgcagagcctggggacaggtcttgagctcagccagagtctgcctccctgtcatttaggaactaaaccaagcggcaggatgctggagcccagcccccatctgaccttacagggccaaggctggggccctgggttcccctcaaggcgcagcaggactggagccccaggcagtgcaggagtggccaaagctggggcttcctccagagcccccaagcatcacggcaccaagaagggtaggaccctggcctgaggaattggcaccaaagccccagaaactaccctggacaccatggagagaggcctggaggggaagcaccaggcactgcctccccttctgatcccacctgaggtggctgccaagcccagagagccgctctgatgtcccccagccctgcagcccagggatacctgtactgtgcccctgggggacccctggccagtctgtgcaaagaagtcaccaccctacactcagagacagtgggggtcctcgtcccacatcctcagagcatggcccggctgctgcagggatggtctcctggtcctcagagcatggcccggctgctgcagggatggtctcctggtcctcagagcatggcccagctgctgcagggatggtctcctggaggccccccagtgctctattgtcagggctccctccaccccccgcaccaagagagagccagaccccagcaaggcttccagtggcttcaggtcacacccctaggctgaccccagccccattaacacctgcctgagaaagctccacgcaccagaactgaccgtctgctccaactcttgacctcccgttctcagggcgtctgctgaaaaggctgcaactgcacatccttcctccgtccgttcccgatgtccgtgtgtctcctgtggccaggaaggtctttctcgggacctgagagccgctccctgaagtgtccccattgggaaggatggggcctgtgtctccaggctctgggaggacagaatcctgacctcaacagtggccggcacggacacaactggccccatcccggggacgctgaccagcgctgggcaacttttcccttccccgacgactgagccccgagcaccctccctgctcccctaccacctccctttacaaggctgtggcctctgcacagatgataatggagcttggctcattcccctagagtcggtagggagttaaggacaaaactcagtttcctccacctgaactcaagtctgcctatgtttacctaatcacacctggtggacagtttggacaaacttgcacactcagagacacagacacttctagaaatcattatctccctgccccggggaccccactccagcagaagtctgctaggcactggcctgggccctcctgctgtcctaggaggctgctgacctcctgcctggctcctgtccccaggtccagagtcagagcagactccagggacgctgcaggctaggaagccgccccctccaggcgagggtctagtgcaggtgcccaggacaagaaagattgtgaatgcaggaatgactgggccacacccctcccgtgcacgccccctcctgccctgcaccccacagcccagccccccgtgctggatgcccccccacagcagaggtgctgttctgtgatcccctgggaaagacgccctcaacctccaccctgtcccacggcccaaggaagacaagacacaggccctctcctcacagtctccccacctggctcctgctgggaccctcaaggtgtgaacagggaggatggttgtctgggtggcccctaggagcccagatcttcactccacagaccccaacccaagcacccccttctgcagggcccagctcatccccctcctcctccctctgctctcctctcgtcgcctctacgggaaatccgggactcagcagtaaccctcaggaagcagggcccaggcgccgtttaataggaggcttcctcacaatgaaacttttagaaagccttgactacaatgatgaccttggtgtggctgtgaacactgtcagctcccacagctgctgcagcaaaaaatgtccatagacagggtgggggcccggggtcgtctgctgtcctgctcagcccacagcacgcatggaggatctgaggtgccacacctgacgcccaggccagaacatgcctccctccagggtgacctgccatgtcctgcattgctggagggacaggggcagcctatgaggatctggggccaggagatgaatcctattaacccagaggaaaactaacaggacccaagcaccctccccgttgaagctgacctgcccagaggggcctgggcccaccccacacaccggggcggaatgtgtacaggccccggtctctgtgggtgttccgctaactggggctcccagtgctcaccccacaactaaagcgagccccagcctccagagcccccgaaggagatgccgcccacaagcccagcccccatccaggaggccccagagctcagggcgccggggcagattctgaacagccccgagtcacggtgggtacaactggaacgaccaccgtgagaaaaactgtgtccaaaactctctcctggcccctgctggaggccgcgccagagaggggagcagccgccccgaacctaggtcctgctcagctcacacgacccccagcagccagagcacagtggagtccccactgaaccccactgaatggtgaggacggggaccagggctccagggggtcatggaaggggctggaccccatcctactgctatggtcccagtgctcctggccagaactgaccctaccaccgacaagagtccctcagggaaacgggggtcactggcacctcccagcatcaaccccaggcagcacaggcataaaccccacatccagagccgactccaggagcagagacaccccagtaccctgggggacaccgaccctgatgactccccactggaatccaccccagagtccaccaggaccaaagaccccgccccggtctctgtccctcactcaggacctgctgcggggcgggccatgagaccagactcgggcttagggaacaccactgtggccccaacctcgaccaggccacaggcccttccttcctgccctgcggcagcacagactttggggtctgtgcagagaggaatcacagaggccccaggctgaggtggtgggggtggaagacccccaggaggtggcccacttcccttcctcccagctggaacccaccatgaccttcttaagataggggtgtcatccgaggcaggtcctccatggagctcccttcaggctcctccctggtcctcactaggcctcagtcccggctgtgggaatgcagccaccacaggcacaccaggcagcccagacccagccagcctgcagtgcccaagcccacattctggagcagagcaggctgtgtctgggagagtctgggctccccaccgcccccggcacaccccacccacccctgtccaggccctatgcaggagggtcagagccccccatggggtatggacttagggtctcactcacgcggctcccctcctgggtgaaggggtctcatgcccagatccccacagcagagctggtcaaaggtggaggcagtggccccagggccaccctgacctggaccctcaggctcctctagccctggctgccctgctgtccctgggaggcctggactccaccagaccacaggtccagggcaccgcccataggtgctgcccacactcagttcacaggaagaagataagctccagacccccaagactgggacctgccttcctgccaccgcttgtagctccagacctccgtgcctcccccgaccacttacacacgggccagggagctgttccacaaagatcaaccccaaaccgggaccgcctggcactcgggccgctgccacttccctctccatttgctcccagcacctctgtgctccctccctcctccctccttcaggggaacagcctgtgcagcccctccctgcaccccacaccctggggaggcccaaccctgcctccagccctttctcccccgctgctcttcctgcccatccagacaaccctggggtcccatccctgcagcctacaccctggtctccacccagacccctgtctctccctccagacacccctcccaggccaaccctgcacatgcaggccctccccttttctgctgccagagcctcagtttctaccctctgtgcctaccccctgcctcctcctgcccacaactcgagctcttcctctcctggggcccctgagccatggcactgaccgtgcactcccacccccacactgcccatgccctcaccttcctcctggacactctgaccctgctcccctcttggacccagccctggtatttccaggacaaaggctcacccaagtcttccccatgcaggcccttgccctcactgcccggttacacggcagcctcctgtgcacagaagcagggagctcagcccttccacaggcagaaggcactgaaagaaatcggcctccagcaccctgatgcacgtccgcctgtgtctctcactgcccgcacctgcagggaggctcggcactccctgtaaagacgagggatccaggcagcaacatcatgggagaatgcagggctcccagacagcccagccctctcgcaggcctctcctgggaagagacctgcagccaccactgaacagccacggagcccgctggatagtaactgagtcagtgaccgacctggagggcaggggagcagtgaaccggagcccagaccatagggacagagaccagccgctgacatcccgagcccctcactggcggccccagaacaccgcgtggaaacagaacagacccacattcccacctggaacagggcagacactgctgagcccccagcaccagccctgagaaacaccaggcaacggcatcagagggggctcctgagaaagaaaggaggggaggtctccttcaccagcaagtacttcccttgaccaaaaacagggtccacgcaactcccccaggacaaaggaggagccccctgtacagcactgggctcagagtcctctccaacacaccctgagtttcagacaaaaaccccctggaaatcatagtatcagcaggagaactagccagagacagcaagaggggactcagtgactcccgcggggacaggaggattttgtgggggctcgtgtcactgtgaggatattgtagtagtaccagctgctatgcccacagtgacacagccccattcccaaagccctgctgtaaacgcttccacttctggagctgaggggctggggggagcgtctgggaagtagggcctaggggtggccatcaatgcccaaaacgcaccagactcccccccagacatcaccccactggccagtgagcagagtaaacagaaaatgagaagcagctgggaagcttgcacaggccccaaggaaagagctttggcgggtgtgcaagaggggatgcgggcagagcctgagcagggccttttgctgtttctgctttcctgtgcagatagttccataaactggtgttcaagatcgatggctgggagtgagcccaggaggacagtgtgggaagggcacagggaaggagaagcagccgctatcctacactgtcatctttcaagagtttgccctgtgcccacaatgctgcatcatgggatgcttaacagctgatgtagacacagctaaagagagaatcagtgaaatggatttgcagcacagatctgaataaattctccagaatgtggagccacacagaagcaagcacaaggaaagtgcctgatgcaagggcaaagtacagtgtgtaccttcaggctgggcacagacactctgaaaagccttggcaggaactccctgcaacaaagcagagccctgcaggcaatgccagctccagagccctccctgagagcctcatgggcaaagatgtgcagaacatatgtttgtcatagccccaaactgagaatgaagcaaacagccatctgaaggaaaacaggcaaataaacgatggcaggttcatgaaatgcaaacccagacagccagaaggacaacagtgagggttacaggtgactctgtggttgagttcatgacaatgctgagtaattggagtaacaaaggaaagtccaaaaaatactttcaatgtgatttcttctaaataaaatttacagccggcaaaatgaactatcttcttaagggataaactttccactaggaaaactataaggaaaatcaagaaaaggatgatcacataaacacagtggtcgttacttctactggggaaggaagagggtatgaactgagacacacagggttggcaagtctcctaacaagaagagaacaaatacattacagtaccttgaaaacagcagttaaaattctaaattgcaagaagaggaaaatgcacacagctgtgtttagaaaattctcagtccagcactgttcataatagcaaagacattaacccaggttggataaataaacgatgacacaggcaattgcacaatgatacagacatacattcagtatatgagacattgatgatgtatccccaaagaaatgactttaaagagaaaaggcctgatatgtggtggcactcacctccctgggcatccccggacaggctgcaggcacactgtgtggcagggcaggctggtacctgctggcagctcctggggcctgatgtggagcaggcacagagccgtatccccccgaggacatatacccccaaggacggcacagttggtacattccggagacaagcaactcagccacactcccaggccagagcccgagagggacgcccatgcacagggaggcagagcccagctcctccacagccagcagcacctgtgcaggggccgccatctggcaggcacagagcatgggctgggaggaggggcagggacaccaggcagggttggcaccaactgaaaattacagaagtctcatacatctacctcagccttgcctgacctgggcctcacctgacctggacctcacctggcctggacctcacctggcctagacctcacctctgggcttcacctgagctcggcctcacctgacttggaccttgcctgtcctgagctcacatgatctgggcctcacctgacctgggtttcacctgacctgggcttcacctgacctgggcctcatctgacctgggcctcactggcctggacctcacctggcctgggcttcacctggcctcaggcctcatctgcacctgctccaggtcttgctggaacctcagtagcactgaggctgcaggggctcatccagggttgcagaatgactctagaacctcccacatctcagctttctgggtggaggcacctggtggcccagggaatataaaaagcctgaatgatgcctgcgtgatttgggggcaatttataaacccaaaaggacatggccatgcagcgggtagggacaatacagacagatatcagcctgaaatggagcctcagggcacaggtgggcacggacactgtccacctaagccaggggcagacccgagtgtccccgcagtagacctgagagcgctgggcccacagcctcccctcggtgccctgctacctcctcaggtcagccctggacatcccgggtttccccaggcctggcggtaggtttggggtgaggtctgtgtcactgtggtattacgatttttggagtggttattatacccacagtgtcacagagtccatcaaaaacccatccctgggaacctgctgccacagccctccctgtggggcaccgccgcgtgccatgttaggattttgactgaggacacagcaccatgggtatggtggctaccgcagcagtgcagcctgtgacccaaacacacagggcagcaggcacaacagacaagcccacaagtgaccaccctgagctcctgcctgccagccctggagaccatgaaacagatggccaggattatcccataggtcagccagacctcagtccaacaggtctgcatcgctgctgccctccaataccagtccggatggggacagggccggcccacattaccatttgctgccatccggccaacagtcccagaagcccctccctcaaggctgggccacatgtgtggaccctgagagccccccatgtctgagtaggggcaccaggaaggtggggctggccctgtgcactgtcactgcccctgtggtccctggcctgcctggccctgacacctgggcctctcctgggtcatttccaagacagaagacattcccaggacagctggagctgggagtccatcatcctgcctggccatcctgagtcctgcgcctttccaaacctcacccgggaagccaacagaggaatcacctcccacaggcagagacaaagaccttccagaaatctctgtctctctccccagtgggcaccctcttccagggcagtcctcagtgatatcacagtgggaacccacatctggatcgggactgcccccagaacacaagatggcccacagggacagccccacagcccagcccttcccagacccctaaaaggcgtcccaccccctgcatctgccccagggctcaaactccaggaggactgactcctgcacaccctcctgccagacatcacctcagcccctcctggaagggacaggagcgcgcaagggtgagtcagaccctcctgccctcgatggcaggcggagaagattcagaaaggtctgagatccccaggacgcagcaccactgtcaatgggggccccagacgcctggaccagggcctgcgtgggaaaggcctctgggcacactcaggggctttttgtgaagggtcctcctactgtgtgactacagtaactaccacagtgatgaacccagcagcaaaaactgaccggactcccaaggtttatgcacacttctccgctcagagctctccaggatcagaagagccgggcccaagggtttctgcccagaccctcggcctctagggacatcttggccatgacagcccatgggctggtgccccacacatcgtctgccttcaaacaagggcttcagagggctctgaggtgacctcactgatgaccacaggtgccctggccccttccccgccagctgcaccagaccccgtcctgacagatgccccgattccaacagccaattcctggggccaggaatcgctgtagacaccagcctccttccaacacctcttgccaattgcctggattcccatcccggttggaatcaagaggacagcatcccccaggctcccaacaggcaggactcccacaccctcctctgagaggccgctgtgttccgtagggccaggctgcagacagtccccctcacctgccactagacaaatgcctgctgtagatgtccccacctggaaaagaccactcatggagcccccagccccaggtacagccatagagagagtctctgaggcccctaagaagtagccatgcccagttctgccgggaccctcggccaggctgacaggagtggacgctggagctgggcccacactgggccacataggagctcaccagtgagggcaggagagcacatgccggggagcacccagcctcctgctgaccagaggcccgtcccagagcccaggaggctgcagaggcctctccagggggacactgtgcatgtctggtccctgagcagccccccatgtccccagtcctgggggcccctggcacagctgtctggaccctctctattccctgggaagctcctcctgacagccccgcctccagttccaggtgtggttattgtcagggggtgtcagactgtggtggatacagctatggttaccacagtggtgctgcccatagcagcaaccaggccaagtagacaggcccctgctgtgcagccccaggcctccagctcacctgcttctcctggggctctcaaggctgctgttttctgcactctcccctctgtggggagggttccctcagtgggagatctgttctcaacatcccagggcctcattcctgcaaggaaggccaatggatgggcaacctcacatgccgcggctaagatagggtgggcagcctggcggggacaggacatcctgctggggtatctgtcactgtgcctagtggggcactggctcccaaacaacgcagtcctcgccaaaatccccacggcctcccccgctaggggctggcctgatctcctgcagtcctaggaggctgctgacctccagaatggctccgtccccagttccagggcgagagcagatcccaggccggctgcagactgggaggccaccccctccttcccagggttcactgcaggtgaccagggcaggaaatggcctgaacacagggataaccgggccatcccccaacagagtccaccccctcctgctctgtaccccgcacccccaaggccagcccatgacatccgacaaccccacaccagagtcactgcccggtgctgccctagggaggacccctcagcccccaccctgtctagaggactggggaggacaggacacgccctctccttatggttcccccacctggctctggctgggacccttggggtgtggacagaaaggacgcttgcctgattggcccccaggagcccagaacttctctccagggaccccagcccgagcacccccttacccaggacccagccctgcccctcctcccatctgctctcctctcatcaccccatgggaatccagaatccccaggaagccatcaggaagggctgagggaggaagtggggccactgcaccaccaggcaggaggctccgtctttgtgaacccagggaggtgccagcctcctagagggtatggtccaccctgcctatggctcccacagtggcaggctgcagggaaggaccagggacggtgtgggggagggctcagggccccgcgggtgctccatcttggatgagcccatctctctcacccacggactcacccacctcctctccaccctggccacacgtcgtccacaccatcctaagtcccacctacaccagagccggcacagccagtgcagacagaggctggggtgcaggggggccgccagggcagctttggggagggaaggatggaggaaggggagttcagtgaagaggcccccctcccctgggtccaggatcctcctctgggacccccggatcccatcccctccaggctctgggaggagaagcaggatgggagaatctgtgcgggaccctctcacagtggaatacctccacagcggctcaggcaagacccaaaagcccctcagtgagccctccactgcagtcctgggcctgggtagcagcccctcccacagaggatgaacccagcaccccgaggatgtcctgccagggggagctcagagccatgaaggagcaggatatgggacccccgatacaggcacagacctcagctccattcaggactgccacgtcctgccctgggaggaacccctttctctagtccctgcaggccaggaggcagctgactcctgacttggacgcctattccagacaccagacagaggggcaggccccccagaaccagggatgaggacgccccgtcaaggccagaaaagaccaagttgtgctgagcccagcaagggaaggtccccaaacaaaccaggaagtttctgaaggtgtctgtgtcacagtggagtatagcagctcgtcccacagtgacactcgccaggccagaaaccccatcccaagtcagcggaatgcagagagagcagggaggacatgtttaggatctgaggccgcacctgacacccaggccagcagacgtctcctgtccatggcaccctgccatgtcctgcatttctggaagaacaagggcaggctgaagggggtccaggaccaggagatgggtcccctctacccagagaaggagccaggcaggacacaagccccctccccattgaggctgacctgcccagagggtcctgggcccaccccacacaccggggcggaatgtgtgcaggcctcggtctctgtgggtgttccgctagctggggctcacagtgctcaccccacacctaaaacgagccacagcctcagagcccctgaaggagaccccgcccacaagcccagcccccacccaggaggccccagagcacagggcgccccgtcggattctgaacagccccgagtcacagtgggtataactggaactaccactgtgagaaaagcttcgtccaaaacggtctcctggccacagtcggaggccccgccagagaggggagcagccaccccaaacccatgttctgccggctcccatgaccccgtgcacctggagccccacagtgtccccactggatgggaggacaagggccgggggctccggcgggtcggggcaggggcttgatggcttccttctgccgtggctccagtgcccctggctggagttgacccttctgacaagtgtcctcagagagtcagggatcagtggcacctccctaacatcaaccccacgcagcgcaggcacaaaccccacatccagggccaactccaggaacagagacaccccaataccctgggggaccccaaccctgatgactcccgtcccatctctgtccctcacttggggcctgctgcggggcgagcacctgggagcaaactcaggattaggggacaccactgtgggcctgacctcgagcaggccacagacccttccctcctgccctggtgcagcacagactttggggtctgggcagggaggaacttctggcaggtcaccaagcacagagcccccaggctgaggtggccccagggggaaccccagcaggtggcccactacccttcctcccagctggaccccatgtcttccccaagataggggtgccatccaaggcaggtcctccatggagcccccttcaggctcctctccagaccccactgggcctcagtccccactctaggaatgcagccaccacgggcacaccaggcagcccaggcccagccaccctgcagtgcccaagcccacaccctggaggagagcagggtgcgtctgggaggggctgggctccccacccccacccccacctgcacaccccacccacccttgcccgggccccctgcaggagggtcagagcccccatgggatatggacttagggtctcactcacgcacctcccctcctgggagaaggggtctcatgcccagatccccccagcagcgctggtcacaggtagaggcagtggccccagggccaccctgacctggcccctcaggctcctctagccctggctgccctgctgtccctgggaggcctgggctccaccagaccacaggtctagggcaccgcccacactggggccgcccacacacagctcacaggaagaagataagctccagacccccaggcccgggacctgccttgctgctacgacttcctgccccagacctcgttgccctcccccgtccacttacacacaggccaggaagctgttcccacacagaccaaccccagacggggaccacctggcactcaggtcactgccatttccttctccattcacttccaatgcctctgtgcttcctccctcctccttccttcgggggagcaccctgtgcagctcctccctgcagtccacaccctggggagacccgaccctgcagcccacaccctggggagacctgaccctcctccagccctttctcccccgctgctcttgccacccaccaagacagccctggggtcctgtccctacagcccccacccagttctctacctagacccgtcttcctccctctaaacacctctcccaggccaaccctacacctgcaggccctcccctccactgccaaagaccctcagtttctcctgcctgtgcccacccccgtgctcctcctgcccacagctcgagctcttcctctcctagggcccctgagggatggcattgaccgtgccctcgcacccacacactgcccatgccctcacattcctcctggccactccagccccactcccctctcaggcctggctctggtatttctgggacaaagccttacccaagtctttcccatgcaggcctgggcccttaccctcactgcccggttacagggcagcctcctgtgcacagaagcagggagctcagcccttccacaggcagaaggcactgaaagaaatcggcctccagcgccttgacacacgtctgcctgtgtctctcactgcccgcacctgcagggaggctcggcactccctctaaagacgagggatccaggcagcagcatcacaggagaatgcagggctaccagacatcccagtcctctcacaggcctctcctgggaagagacctgaagacgcccagtcaacggagtctaacaccaaacctccctggaggccgatgggtagtaacggagtcattgccagacctggaggcaggggagcagtgagcccgagcccacaccatagggccagaggacagccactgacatcccaagccactcactggtggtcccacaacaccccatggaaagaggacagacccacagtcccacctggaccagggcagagactgctgagacccagcaccagaaccaaccaagaaacaccaggcaacagcatcagagggggctctggcagaacagaggaggggaggtctccttcaccagcaggcgcttcccttgaccgaagacaggatccatgcaactcccccaggacaaaggaggagccccttgttcagcactgggctcagagtcctctccaagacacccagagtttcagacaaaaaccccctggaatgcacagtctcagcaggagagccagccagagccagcaagatggggctcagtgacacccgcagggacaggaggattttgtgggggctcgtgtcactgtgaggatattgtactaatggtgtatgctatacccacagtgacacagccccattcccaaagccctactgcaaacgcattccacttctggggctgaggggctgggggagcgtctgggaaatagggctcaggggtgtccatcaatgcccaaaacgcaccagactcccctccatacatcacacccaccagccagcgagcagagtaaacagaaaatgagaagcaagctggggaagcttgcacaggccccaaggaaagagctttggcgggtgtgtaagaggggatgcgggcagagcctgagcagggccttttgctgtttctgctttcctgtgcagagagttccataaactggtgttcgagatcaatggctgggagtgagcccaggaggacagcgtgggaagagcacagggaaggaggagcagccgctatcctacactgtcatctttcgaaagtttgccttgtgcccacactgctgcatcatgggatgcttaacagctgatgtagacacagctaaagagagaatcagtgagatggatttgcagcacagatctgaataaattctccagaatgtggagcagcacagaagcaagcacacagaaagtgcctgatgcaaggacaaagttcagtgggcaccttcaggcattgctgctgggcacagacactctgaaaagccctggcaggaactccctgtgacaaagcagaaccctcaggcaatgccagccccagagccctccctgagagcctcatgggcaaagatgtgcacaacaggtgtttctcatagccccaaactgagagcaaagcaaacgtccatctgaaggagaacaggcaaataaacgatggcaggttcatgaaatgcaaacccagacagccacaagcacaaaagtacagggttataagcgactctggttgagttcatgacaatgctgagtaattggagtaacaaagtaaactccaaaaaatactttcaatgtgatttcttctaaataaaatttacaccctgcaaaatgaactgtcttcttaagggatacatttcccagttagaaaaccataaagaaaaccaagaaaaggatgatcacataaacacagtggtggttacttctgctggggaaggaagagggtatgaactgagatacacagggtgggcaagtctcctaacaagaacagaacgaatacattacagtaccttgaaaacagcagttaaacttctaaattgcaagaagaggaaaatggacacagttgtgtttagaaaattctcagtccagcactgttcataatagcaaagacattaacccaggtcggataaataagcgatgacacaggcaattgcacaatgatacagacatatatttagtatatgagacatcgatgatgtatccccaaataaacgactttaaagagataaagggctgatgtgtggtggcattcacctccctgggatccccggacaggttgcaggctcactgtgcagcagggcaggcgggtacctgctggcagttcctggggcctgatgtggagcaagcgcagggccatatatcccggaggacggcacagtcagtgaattccagagagaagcaactcagccacactccccaggcagagcccgagagggacgcccacgcacagggaggcagagcccagcacctccgcagccagcaccacctgtgcacgggccaccaccttgcaggcacagagtgggtgctgagaggaggggcagggacaccaggcagggtgagcacccagagaaaactgcagacgcctcacacatccacctcagcctcccctgacctggacctcactggcctgggcctcacttaacctgggcttcacctgaccttggcctcacctgacttggacctcgcctgtcccaagctttacctgacctgggcctcaactcacctgaacgtctcctgacctgggtttaacctgtcctggaactcacctggccttggcttcccctgacctggacctcatctggcctgggcttcacctggcctgggcctcacctgacctggacctcatctggcctggacctcacctggcctggacttcacctggcctgggcttcacctgacctggacctcacctggcctcgggcctcacctgcacctgctccaggtcttgctggagcctgagtagcactgagggtgcagaagctcatccagggttggggaatgactctagaagtctcccacatctgacctttctgggtggaggcagctggtggccctgggaatataaaaatctccagaatgatgactctgtgatttgtgggcaacttatgaacccgaaaggacatggccatggggtgggtagggacatagggacagatgccagcctgaggtggagcctcaggacacaggtgggcacggacactatccacataagcgagggatagacccgagtgtccccacagcagacctgagagcgctgggcccacagcctcccctcagagccctgctgcctcctccggtcagccctggacatcccaggtttccccaggcctgccggtaggtttagaatgaggtctgtgtcactgtggtattacgatattttgactggttattataaccacagtgtcacagagtccatcaaaaacccatgcctggaagcttcccgccacagccctccccatggggccctgctgcctcctcaggtcagccccggacatcccgggtttccccaggctgggcggtaggtttggggtgaggtctgtgtcactgtggtattactatggttcggggagttattataaccacagtgtcacagagtccatcaaaaacccatccctgggagcctcccgccacagccctccctgcaggggaccggtacgtgccatgttaggattttgatcgaggagacagcaccatgggtatggtggctaccacagcagtgcagcctgtgacccaaacccgcagggcagcaggcacgatggacaggcccgtgactgaccacgctgggctccagcctgccagccctggagatcatgaaacagatggccaaggtcaccctacaggtcatccagatctggctccgaggggtctgcatcgctgctgccctcccaacgccagtccaaatgggacagggacggcctcacagcaccatctgctgccatcaggccagcgatcccagaagcccctccctcaaggctgggccacatgtgtggacactgagagccctcatgtctgagtaggggcaccaggagggaggggctggccctgtgcactgtccctgcccctgtggtccctggcctgcctggccctgacacctgagcctctcctgggtcatttccaagacagaagacattcctggggacagccggagctgggcgtcgctcatcctgcccggccgtcctgagtcctgctcatttccagacctcaccggggaagccaacagaggactcgcctcccacattcagagacaaagaaccttccagaaatccctgcctctctccccagtggacaccctcttccaggacagtcctcagtggcatcacagcggcctgagatccccaggacgcagcaccgctgtcaataggggccccaaatgcctggaccagggcctgcgtgggaaaggtctctggccacactcgggctttttgtgaagggccctcctgctgtgtgactacagtaactaccatagtgatgaacccagtggcaaaaactggctggaaacccaggggctgtgtgcacgcctcagcttggagctctccaggagcacaagagccgggcccaaggatttgtgcccagaccctcagcctctagggacacctgggccatctcagcctgggctggtgccctgcacaccatcttcctccaaataggggcttcagagggctctgaggtgacctcactcatgaccacaggtgacctggcccttccctgccagctataccagaccctgtcttgacagatgccccgattccaacagccaattcctgggaccctgaatagctgtagacaccagcctcattccagtacctcctgccaattgcctggattcccatcctggctggaatcaagaaggcagcatccgccaggctcccaacaggcaggactcccgcacaccctcctctgagaggccgctgtgttccgcagggccaggccctggacagttcccctcacctgccactagagaaacacctgccattgtcgtccccacctggaaaagaccactcgtggagcccccagccccaggtacagctgtagagagagtcctcgaggcccctaagaaggagccatgcccagttctgccgggaccctcggccaggccgacaggagtggacgctggagctgggcccacactgggccacataggagctcaccagtgagggcaggagagcacatgccggggagcacccagcctcctgctgaccagaggcctgccccagagcccaggaggctgcagaggcctctccagggagacactgtgcatgtctggtacctaagcagccccccacgtccccagtcctgggggcccctggctcagctgtctggaccctccctgttccctgggaagctcctcctgacagccccgcctccagttccaggtgtggttattgtcaggcgatgtcagactgtggtggatatagtggctacgattaccacagtggtgccgcccatagcagcaaccaggccaagtagacaggcccctgctgcgcagccccaggcatccacttcacctgcttctcctggggctctcaaggctgctgtctgtcctctggccctctgtggggagggttccctcagtgggaggtctgtgctccagggcagggatgattgagatagaaatcaaaggctggcagggaaaggcagcttcccgccctgagaggtgcaggcagcaccacggagccacggagtcacagagccacggagcccccattgtgggcatttgagagtgctgtgcccccggcaggcccagccctgatggggaagcctgtcccatcccacagcccgggtcccacgggcagcgggcacagaagctgccaggttgtcctctatgatcctcatccctccagcagcatcccctccacagtggggaaactgaggcttggagcaccacccggccccctggaaatgaggctgtgagcccagacagtgggcccagagcactgtgagtaccccggcagtacctggctgcagggatcagccagagatgccaaaccctgagtgaccagcctacaggaggatccggccccacccaggccactcgattaatgctcaaccccctgccctggagacctcttccagtaccaccagcagctcagcttctcagggcctcatccctgcaaggaaggtcaagggctgggcctgccagaaacacagcaccctccctagccctggctaagacagggtgggcagacggctgtggacgggacatattgctggggcatttctcactgtcacttctgggtggtagctctgacaaaaacgcagaccctgccaaaatccccactgcctcccgctaggggctggcctggaatcctgctgtcctaggaggctgctgacctccaggatggctccgtccccagttccagggcgagagcagatcccaggcaggctgtaggctgggaggccacccctgcccttgccggggttgaatgcaggtgcccaaggcaggaaatggcatgagcacagggatgaccgggacatgccccaccagagtgcgccccttcctgctctgcaccctgcaccccccaggccagcccacgacgtccaacaactgggcctgggtggcagccccacccagacaggacagacccagcaccctgaggaggtcctgccagggggagctaagagccatgaaggagcaagatatggggcccccgatacaggcacagatgtcagctccatccaggaccacccagcccacaccctgagaggaacgtctgtctccagcctctgcaggtcgggaggcagctgacccctgacttggacccctattccagacaccagacagaggcgcaggccccccagaaccagggttgagggacgccccgtcaaagccagacaaaaccaaggggtgttgagcccagcaagggaaggcccccaaacagaccaggaggtttctgaaggtgtctgtgtcacagtggggtatagcagcagctggtaccacagtgacactcacccagccagaaaccccattccaagtcagcggaagcagagagagcagggaggacacgtttaggatctgagactgcacctgacacccaggccagcagacgtctcccctccagggcaccccaccctgtcctgcatttctgcaagatcaggggcggcctgagggggggtctagggtgaggagatgggtcccctgtacaccaaggaggagttaggcaggtcccgagcactctccccattgaggctgacctgcccagagagtcctgggcccaccccacacaccggggcggaatgtgtgcaggcctcggtctctgtgggtgttccgctagctggggctcacagtgctcaccccacacctaaaatgagccacagcctccggagcccccgcaggagaccccgcccacaagcccagcccccacccaggaggccccagagctcagggcgccccgtcggattccgaacagccccgagtcacagcgggtataaccggaaccaccactgtcagaatagctacgtcaaaaactgtccagtggccactgccggaggccccgccagagagggcagcagccactctgatcccatgtcctgccggctcccatgacccccagcacgcggagccccacagtgtccccactggatgggaggacaagagctggggattccggcgggtcggggcaggggcttgatcgcatccttctgccgtggctccagtgcccctggctggagttgacccttctgacaagtgtcctcagagagacaggcatcaccggcgcctcccaacatcaaccccaggcagcacaggcacaaaccccacatccagagccaactccaggagcagagacaccccaataccctgggggaccccgaccctgatgacttcccactggaattcgccgtagagtccaccaggaccaaagaccctgcctctgcctctgtccctcactcaggacctgctgccgggcgaggccttgggagcagacttgggcttaggggacaccagtgtgaccccgaccttgaccaggacgcagacctttccttcctttcctggggcagcacagactttggggtctgggccaggaggaacttctggcaggtcgccaagcacagaggccacaggctgaggtggccctggaaagacctccaggaggtggccactccccttcctcccagctggaccccatgtcctccccaagataagggtgccatccaaggcaggtgctccttggagccccattcagactcctccctggaccccactgggcctcagtcccagctctggggatgaagccaccacaagcacaccaggcagcccaggcccagccaccctgcagtgcccaagcacacactctggagcagagcagggtgcctctgggaggggctgagctccccaccccacccccacctgcacaccccacccacccctgcccagcggctctgcaggagggtcagagccccacatggggtatggacttagggtctcactcacgtggctcccatcatgagtgaaggggcctcaagcccaggttcccacagcagcgcctgtcgcaagtggaggcagaggcccgagggccaccctgacctggtccctgaggttcctgcagcccaggctgccctgctgtccctgggaggcctgggctccaccagaccacaggtccagggcaccgggtgcaggagccacccacacacagctcacaggaagaagataagctccagacccccagggccagaacctgccttcctgctactgcttcctgccccagacctgggcgccctcccccgtccacttacacacaggccaggaagctgttcccacacagaacaaccccaaaccaggaccgcctggcactcaggtggctgccatttccttctccatttgctcccagcgcctctgtcctccctggttcctccttcgggggaacagcctgtgcagccagtccctgcagcccacaccctggggagacccaaccctgcctggggcccttccaaccctgctgctcttactgcccacccagaaaactctggggtcctgtccctgcagtccctaccctggtctccacccagacccctgtgtatcactccagacacccctcccaggccaaccctgcacctgcaggccctgtcctcttctgtcgctagagcctcagtttctcccccctgtgcccacaccctacctcctcctgcccacaactctaactcttcttctcctggagcccctgagccatggcattgaccctgccctcccaccacccacagcccatgccctcaccttcctcctggccactccgaccccgccccctctcaggccaagccctggtatttccaggacaaaggctcacccaagtctttcccaggcaggcctgggctcttgccctcacttcccggttacacgggagcctcctgtgcacagaagcagggagctcagcccttccacaggcagaaggcactgaaagaaatcggcctccagcaccttgacacacgtccgcccgtgtctctcactgcccgcacctgcagggaggctccgcactccctctaaagacaagggatccaggcagcagcatcacgggagaatgcagggctcccagacatcccagtcctctcacaggcctctcctgggaagagacctgcagccaccaccaaacagccacagaggctgctggatagtaactgagtcaatgaccgacctggagggcaggggagcagtgagccggagcccataccatagggacagagaccagccgctgacatcccgagctcctcaatggtggccccataacacacctaggaaacataacacacccacagccccacctggaacagggcagagactgctgagcccccagcaccagccccaagaaacaccaggcaacagtatcagagggggctcccgagaaagagaggaggggagatctccttcaccatcaaatgcttcccttgaccaaaaacagggtccacgcaactcccccaggacaaaggaggagccccctatacagcactgggctcagagtcctctctgagacaccctgagtttcagacaacaacccgctggaatgcacagtctcagcaggagaacagaccaaagccagcaaaagggacctcggtgacaccagtagggacaggaggattttgtgggggctcgtgtcactgtgaggatattgtagtggtggtagctgctactcccacagtgacacagacccattcccaaagccctactgcaaacacacccactcctggggctgaggggctgggggagcgtctgggaagtagggtccaggggtgtctatcaatgtccaaaatgcaccagactccccgccaaacaccaccccaccagccagcgagcagggtaaacagaaaatgagaggctctgggaagcttgcacaggccccaaggaaagagctttggcaggtgtgcaagaggggatgcaggcagagcctgagcagggccttttgctgtttctgctttcctgtgcagagagttccataaactggtgttcaagatcagtggctgggaatgagcccaggagggcagtctgtgggaagagcacagggaaggaggagcagccgctatcctacactgtcatctttcaaaagtttgccttgtgaccacactattgcatcatgggatgcttaagagctgatgtagacacagctaaagagagaatcagtgagatgaatttgcagcatagatctgaataaactctccagaatgtggagcagtacagaagcaaacacacagaaagtgcctgatgcaaggacaaagttcagtgggcaccttcaggcattgctgctgggcacagacactctgaaaagccctggcaggatctccctgcgacaaagcagaaccctcaggcaatgccagccccagagccctccctgagagcgtcatggggaaagatgtgcagaacagctgattatcatagactcaaactgagaacagagcaaacgtccatctgaagaacagtcaaataagcaatggtaggttcatgcaatgcaaacccagacagccaggggacaacagtagagggctacaggcggctttgcggttgagttcatgacaatgctgagtaattggagtaacagaggaaagcccaaaaaatacttttaatgtgatttcttctaaataaaatttacaccaggcaaaatgaactgtcttcttaagggataaactttcccctggaaaaactacaaggaaaattaagaaaacgatgatcacataaacacagttgtggttacttctactggggaaggaagagggtatgagctgagacacacagagtcggcaagtctccaagcaagcacagaacgaatacattacagtaccttgaatacagcagttaaacttctaaatcgcaagaagaggaaaatgcacacagctgtgtttagaaaattctcagtccagcactattcataatagcaaagacattaacccaggttggataaataaatgatgacacaggcaattgcacaatgatacagacatacatttagtacatgagacatcgatgatgtatccccaaagaaatgactttaaagagaaaaggcctgatgtgtggtggcactcacctccctgggatccccggacaggttgcaggcacactgtgtggcagggcaggctggtacatgctggcagctcctggggcctgatgtggagcaagcgcagggctgtatacccccaaggatggcacagtcagtgaattccagagagaagcagctcagccacactgcccaggcagagcccgagagggacgcccacgcacagggaggcagagcccagctcctccacagccaccaccacctgtgcacgggccaccaccttgcaggcacagagtgggtgctgagaggaggggcagggacaccaggcagggtgagcacccagagaaaactgcagaagcctcacacatccacctcagcctcccctgacctggacctcacctggtctggacctcacctggcctgggcctcacctgacctggacctcacctggcctgggcttcacctgacctggacctcacctggcctccggcctcacctgcacctgctccaggtcttgctggaacctgagtagcactgaggctgcagaagctcatccagggttggggaatgactctggaactctcccacatctgacctttctgggtggaggcatctggtggccctgggaatataaaaagccccagaatggtgcctgcgtgatttgggggcaatttatgaacccgaaaggacatggccatggggtgggtagggacatagggacagatgccagcctgaggtggagcctcaggacacagttggacgcggacactatccacataagcgagggacagacccgagtgttcctgcagtagacctgagagcgctgggcccacagcctcccctcggtgccctgctgcctcctcaggtcagccctggacatcccgggtttccccaggcctggcggtaggtttgaagtgaggtctgtgtcactgtggtattatgattacgtttgggggagttatcgttatacccacagcatcacacggtccatcagaaacccatgccacagccctccccgcaggggaccgccgcgtgccatgttacaattttgatcgaggacacagcgccatgggtatggtggctaccacagcagtgcagcccatgacccaaacacacagggcagcaggcacaatggacaggcctgtgagtgaccatgctgggctccagcccgccagccccggagaccatgaaacagatggccaaggtcaccccacagttcagccagacatggctccgtggggtctgcatcgctgctgccctctaacaccagcccagatggggacaaggccaaccccacattaccatctcctgctgtccacccagtggtcccagaagcccctccctcatggctgagccacatgtgtgaaccctgagagcaccccatgtcagagtaggggcagcagaagggcggggctggccctgtgcactgtccctgcacccatggtccctcgcctgcctggccctgacacctgagcctcttctgagtcatttctaagatagaagacattcccggggacagccggagctgggcgtcgctcatcctgcccggccgtcctgagtcctgcttgtttccagacctcaccagggaagccaacagaggactcacctcacacagtcagagacaaagaaccttccagaaatccctgtctcactccccagtgggcaccttcttccaggacattcctcggtcgcatcacagcaggcacccacatctggatcaggacggcccccagaacacaagatggcccatggggacagccccacaacccaggccttcccagacccctaaaaggcgtcccaccccctgcacctgccccagggctaaaaatccaggaggcttgactcccgcataccctccagccagacatcacctcagccccctcctggaggggacaggagcccgggagggtgagtcagacccacctgccctcgatggcaggcggggaagattcagaaaggcctgagatccccaggacgcagcaccactgtcaatgggggccccagacgcctggaccagggcctgcgtgggaaaggccgctgggcacactcaggggctttttgtgaaggcccctcctactgtgtgactacggtgactaccacagtgatgaaactagcagcaaaaactggccggacacccagggaccatgcacacttctcagcttggagctctccaggaccagaagagtcaggtctgagggtttgtagccagaccctcggcctctagggacaccctggccatcacagcggatgggctggtgccccacatgccatctgctccaaacaggggcttcagagggctctgaggtgacttcactcatgaccacaggtgccctggccccttccccgccagctacaccgaaccctgtcccaacagctgccccagttccaacagccaattcctggggcccagaattgctgtagacaccagcctcgttccagcacctcctgccaattgcctggattcacatcctggctggaatcaagagggcagcatccgccaggctcccaacaggcaggactcccgcacaccctcctctgagaggccgctgtgttccgcagggccaggccctggacagttcccctcacctgccactagagaaacacctgccattgtcgtccccacctggaaaagaccactcgtggagcccccagccccaggtacagctgtagagagactccccgagggatctaagaaggagccatgcgcagttctgccgggaccctcggccaggccgacaggagtggacactggagctgggcccacactgggccacataggagctcaccagtgagggcaggagagcacatgccggggagcacccagcctcctgctgaccagaggcctgccccagagcccaggaggctgcagaggcctctccagggggacactgtgcatgtctggtccctgagcagccccccatgtccccagtcctgggggcccctggcacagctgtctggaccctccctgttccctgggaagctcctcctgacagccccgcctccagttccaggtgtggttattgtcagggggtgtcagactgtggtggatacagctatggttaccacagtggtgctgcccatagcagcaaccaggccaagtagacaggcccctgctgtgcagccccaggcctccagctcacctgcttctcctggggctctcaaggtcactgttgtctgtactctgccctctgtggggagggttctctcagtgggaggtctgttctcaacatcccagggcctcatgtctgcacggaaggccaatggatgggcaacctcacatgccgcggctaagatagggtgggcagcctggcgggggacagtacatactgctggggtgtctgtcactgtgcctagtggggcactggctcccaaacaacgcagtcctcaccaaaatccccacagcctcccctgctaggggctggcctgatctcctgcagtcctaggaggctgctgacctccagaatgtctccgtccccagttccagggcgagagcagatcccaggccggctgcagactgggaggccaccccctccttcccagggttcactggaggtgaccaaggtaggaaatggccttaacacagggatgactgcgccatcccccaacagagtcagccccctcctgctctgtaccccgcaccccccaggccagtccacgaaaaccagggccccacatcagagtcactgcctggcccggccctggggcggacccctcagcccccaccctgtctagaggacttggggggacaggacacaggccctctccttatggttcccccacctgcctccggccgggacccttggggtgtggacagaaaggacacctgcctaattggcccccaggaacacagaacttctctccagggaccccagcccgagcacccccttacccaggacccagccctgcccctcctcccctctgctctcctctcatcaccccatgggaatccggtatccccaggaagccatcaggaagggctgaaggaggaagcggggccgtgcaccaccgggcagcaggctccgtcttcgtgaacccagggaagtgccagcctcctagagggtatggtccaccctgcctggggctcccaccgtggcaggctgcggggaaggaccagggacggtgtgggggagggctcagggccctgcgggtgctcctccatcttcggtgagcctcccccttcacccaccgtcccgcccacctcctctccaccctggctgcacgtcttccacaccatcctgagtcctacctacaccagagccagcaaagccagtgcagacaaaggctggggtgcaggggggctgccagggcagcttcggggagggaaggatggagggaggggaggtcagtgaagaggcccccttcccctgggtccaggatcctcctctgggacccccggctcccatcccctcctggctctgggaggagaagcaggatgggagaatctgtgcgggaccctctcacagtggaatatccccacagcggctcaggccagacccaaaagcccctcagtgagccctccactgcagtcctgggcctgggtagcagcccctcccacagaggacagacccagcaccccgaagaagtcctgccagggggagctcagagccatgaaagagcaggatatggggtccccgatacaggcacagacctcagctccatccaggcccaccgggacccaccatgggaggaacacctgtctccgggttgtgaggtggctggcctctgtctcggaccccactccagacaccagacagaggggcaggccccccaaaaccagggttgagggatgatccgtcaaggcagacaagaccaaggggcactgaccccagcaagggaaggctcccaaacagacgaggaggtttctgaagctgtctgtatcacagtggggtatagcagtggctggtaccacagtgacactcgccaggccagaaaccccgtcccaagtcagcggaagcagagagagcagggaggacacgtttaggatctgaggccgcacctgacacccagggcagcagacgtctcccctccagggcaccctccaccgtcctgcgtttcttcaagaataggggcggcctgagggggtccagggccaggcgataggtcccctctaccccaaggaggagccaggcaggacccgagcaccgtccccattgaggctgacctgcccagacgggcctgggcccaccccacacaccggggcggaatgtgtgcaggccccagtctctgtgggtgttccgctagctggggcccccagtgctcaccccacacctaaagcgagccccagcctccagagccccctaagcattccccgcccagcagcccagcccctgcccccacccaggaggccccagagctcagggcgcctggtcggattctgaacagccccgagtcacagtgggtataactggaacgaccaccgtgagaaaaactgtgtccaaaactgactcctggcagcagtcggaggccccgccagagaggggagcagccgccctgaacccatgtcctgccggttcccatgacccccagcacccagagccccacggtgtccccgttggataatgaggacaagggctgggggctccggtggtttgcggcagggacttgatcacatccttctgctgtggccccattgcctctggctggagttgacccttctgacaagtgtcctcagaaagacagggatcaccggcacctcccaatatcaaccccaggcagcacagacacaaaccccacatccagagccaactccaggagcagagacaccccaacactctgggggaccccaaccgtgataactccccactggaatccgccccagagtctaccaggaccaaaggccctgccctgtctctgtccctcactcagggcctcctgcagggcgagcgcttgggagcagactcggtcttaggggacaccactgtgggccccaactttgatgaggccactgacccttccttcctttcctggggcagcacagactttggggtctgggcagggaagaactactggctggtggccaatcacagagcccccaggccgaggtggccccaagaaggccctcaggaggtggccactccacttcctcccagctggaccccaggtcctccccaagataggggtgccatccaaggcaggtcctccatggagcccccttcagactcctcccgggaccccactggacctcagtccctgctctgggaatgcagccaccacaagcacaccaggaagcccaggcccagccaccctgcagtgggcaagcccacactctggagcagagcagggtgcgtctgggaggggctaacctccccaccccccaccccccatctgcacacagccacctaccactgcccagaccctctgcaggagggccaagccaccatggggtatggacttagggtctcactcacgtgcctcccctcctgggagaaggggcctcatgccgagatccctgcagcactagacacagctggaggcagtggccccagggccaccctgacctggcatctaaggctgctccagcccagacagcactgccgttcctgggaagcctgggctccaccagaccacaggtccagggcacagcccacaggagccacccacacacagctcacaggaagaagataagctccagaccccagggcgggacctgccttcctgccaccacttacacacaggccagggagctgttcccacacagatcaaccccaaaccgggactgcctggcactagggtcactgccatttccctctccattccctcccagtgcctctgtgctccctccttctggggaacaccctgtgcagcccctccctgcagcccacacgctggggagaccccaccctgcctcgggccttttctacctgctgcacttgccgcccacccaaacaaccctgggtacgtgaccctgcagtcctcaccctgatctgcaaccagacccctgtccctccctctaaacacccctcccaggccaactctgcacctgcaggccctccgctcttctgccacaagagcctcaggttttcctacctgtgcccaccccctaacccctcctgcccacaacttgagttcttcctctcctggagcccttgagccatggcactgaccctacactcccacccacacactgcccatgccatcaccttcctcctggacactctgaccacgctcccctccctctcagacccggccctggtatttccaggacaaaggctcacccaagtcttccccatgcaggcccttgccctcactgcctggttacacgggagcctcctgtgcgcagaagcagggagctcagctcttccacaggcagaaggcactgaaagaaatcggcctccagtgccttgacacacgtccgcctgtgtctctcactgcctgcacctgcagggaggctccgcactccctctaaagatgagggatccaggcagcaacatcacgggagaatgcagggctcccagacagcccagccctctcgcaggcctctcctgggaagagacctgcagccaccactgaacagccacggaggtcgctggatagtaaccgagtcagtgaccgacctggagggcaggggagcagtgaaccggagcccagaccatagggacagagaccagccgctaacatcccgagcccctcactggcggccccagaacaccccgtggaaacagaacagacccacagtcccacctggaacagggcagacactgctgagcccccagcaccagccccaagaaacactaggcaacagcatcagagggggctcctgagaaagagaggaggggaggtctccttcaccatcaaatgcttcccttgaccaaaaacagggtccacgcaactcccccaggacaaaggaggagccccctgtacagcactgggctcagagtcctctctgagacaggctcagtttcagacaacaacccgctggaatgcacagtctcagcaggagagccaggccagagccagcaagaggagactcggtgacaccagtctcctgtagggacaggaggattttgtgggggttcgtgtcactgtgagcatattgtggtggtgactgctattcccacagtgacacaaccccattcctaaagccctactgcaaacgcacccactcctggggctgaggggctgggggagcatctgggaagtatggcctaggggtgtccatcaatgcccaaaatgcaccagactctccccaagacatcaccccaccagccagtgagcagagtaaacagaaaatgagaagcagctgggaagcttgcacaggccccaaggaaagagctttggcaggtgtgcaagaggggatgtgggcagagcctgagcagggccttttgctgtttctgctttcctgtgcagagagttccataaactggtattcaggatcaatggctgggagtgagcccaggaggacagtgtgggaagagcacagggaaggaggagcagccgctatcctacactgtcatcttttgaaagtttgccctgtgcccacaatgctgcatcatgggatgcttaacagctgatgtagacacagctaaagagagaatcagtgaaatgcatttgcagcacagatctgaataaatcctccagaatgtggagcagcacagaagcaagcacacagaaagtgcctgatgccaaggcaaagttcagtgggcaccttcaggcattgctgctgggcacagacactctgaaaagcactggcaggaactgcctgtgacaaagcagaaccctcaggcaatgccagccctagagcccttcctgagaacctcatgggcaaagatgtgcagaacagctgtttgtcatagccccaaactatggggctggacaaagcaaacgtccatctgaaggacaacagacaaataaacgatggcaggttcatgaaatgcaaactaggacagccagaggacaacagtagagagctacaggcggctttgcggttgagttcatgacaatgctgagtaattggagtaacagaggaaagcccaaaaaatacttttaatgtgatttcttctaaataaaatttacacccggcaaaatgaactatcttcttaagggataaactttcccctggaaaaactataaggaaaatcaagaaaacgatgatcacataaacacagtggtggttacttctactggggaaggaagagggtatgagctgagacacacagagtcggcaagtctcctaacaagaacagaacaaatacattacagtaccttgaaaacagcagttaaacttctaaatcgcaagaagaggaaaatgcacacacctgtgtttagaaaattctcagtccagcactgttcataatagcaaagacattaacccaggttggataaataagcgatgacacaggcaattgcacaatgatacagacatacattcagtatatgagacatcgatgatgtatccccaaagaaatgactttaaagagaaaaggcctgatgtgtggtggcaatcacctccctgggcatccccggacaggctgcaggctcactgtgtggcagggcaggcaggcacctgctggcagctcctggggcctgatgtggagcaggcacagagctgtatatccccaaggaaggtacagtcagtgcattccagagagaagcaactcagccacactccctggccagaacccaagatgcacacccatgcacagggaggcagagcccagcacctccgcagccaccaccacctgcgcacgggccaccaccttgcaggcacagagtgggtgctgagaggaggggcagggacaccaggcagggtgagcacccagagaaaactgcagaagcctcacacatccacctcagcctcccctgacctggacctcacctggcctgggcctcacctgacctggacctcacctggcctgggcttcacctggcctgggcttcacctgacctggacctcacctggcctcgggcctcacctggcctgggcttcacctggcctgggcttcacctgacctggacctcacctggcctgggcctcacctgacctggacctcacctggcctgggcttcacctggcctgggcttcacctggcctgggcttcacctgacctggacctcacctggcctgggcttcacctgacctggacctcacctggcctcgggcctcacctgcacctgctccaggtcttgctggagcctgagtagcactgaggctgtagggactcatccagggttggggaatgactctgcaactctcccacatctgacctttctgggtggaggcacctggtggcccagggaatataaaaagccccagaatgatgcctgtgtgatttgggggcaatttatgaacccgaaaggacatggccatggggtgggtagggacagtagggacagatgtcagcctgaggtgaagcctcaggacacaggtgggcatggacagtgtccacctaagcgagggacagacccgagtgtccctgcagtagacctgagagcgctgggcccacagcctcccctcggggccctgctgcctcctcaggtcagccctggacatcccgggtttccccaggcctggcggtaggtttgaagtgaggtctgtgtcactgtggtattactatgatagtagtggttattactaccacagtgtcacagagtccatcaaaaactcatgcctgggagcctcccaccacagccctccctgcgggggaccgctgcatgccgtgttaggattttgatcgaggacacggcgccatgggtatggtggctaccacagcagtgcagcccatgacccaaacacacggggcagcagaaacaatggacaggcccacaagtgaccatgatgggctccagcccaccagccccagagaccatgaaacagatggccaaggtcaccctacaggtcatccagatctggctccaaggggtctgcatcgctgctgccctcccaacgccaaaccagatggagacagggccggccccatagcaccatctgctgccgtccacccagcagtcccggaagcccctccctgaacgctgggccacgtgtgtgaaccctgcgagccccccatgtcagagtaggggcagcaggagggcggggctggccctgtgcactgtcactgcccctgtggtccctggcctgcctggccctgacacctgagcctctcctgggtcatttccaagacattcccagggacagccggagctgggagtcgctcatcctgcctggctgtcctgagtcctgctcatttccagacctcaccagggaagccaacagaggactcacctcacacagtcagagacaacgaaccttccagaaatccctgtttctctccccagtgagagaaaccctcttccagggtttctcttctctcccaccctcttccaggacagtcctcagcagcatcacagcgggaacgcacatctggatcaggacggcccccagaacacgcgatggcccatggggacagcccagcccttcccagacccctaaaaggtatccccaccttgcacctgccccagggctcaaactccaggaggcctgactcctgcacaccctcctgccagatatcacctcagccccctcctggaggggacaggagcccgggagggtgagtcagacccacctgccctcaatggcaggcggggaagattcagaaaggcctgagatccccaggacgcagcaccactgtcaatgggggccccagacgcctggaccagggcctgtgtgggaaaggcctctggccacactcaggggctttttgtgaagggccctcctgctgtgtgactacggtggtaactcccacagtgatgaaaccagcagcaaaaactgactggactcgcagggtttatgcacacttctcggctcggagctctccaggagcacaagagccaggcccgagggtttctgcccagaccctcggcctctagggacacccgggccatcttagccgatgggctggtgccctgcacaccgtgtgctgccaaacaggggcttcagagggctctgaggtgacttcactcatgaccacaggtgccctggtcccttcactgccagctgcaccagaccctgttccgagagatgccccagttccaaaagccaattcctggggccgggaattactgtagacaccagcctcattccagtacctcctgccaattgcctggattcccatcctggctggaatcaagagggcagcatccgccaggctcccaacaggcaggactcccacacaccctcctctgagaggccgctgtgttccgcagggccaggccgcagacagttcccctcacctgcccatgtagaaacacctgccattgtcgtccccacctggcaaagaccacttgtggagcccccagccccaggtacagctgtagagagagtcctcgaggcccctaagaaggagccatgcccagttctgccgggaccctcggccaggccgacaggagtggacgctggagctgggcccacactgggccacataggagctcaccagtgagggcaggagagcacatgccggggagcacccagcctcctgctgaccagagacccgtcccagagcccaggaggctgcagaggcctctccagggggacacagtgcatgtctggtccctgagcagcccccaggctctctagcactgggggcccctggcacagctgtctggaccctccctgttccctgggaagctcctcctgacagccccgcctccagttccaggtgtggttattgtcagggggtgccaggccgtggtagagatggctacaattaccacagtggtgccgcccatagcagcaaccaggccaagtagacagacccctgccacgcagccccaggcctccagctcacctgcttctcctggggctctcaaggctgctgtctgccctctggccctctgtggggagggttccctcagtgggaggtctgtgctccagggcagggatgactgagatagaaatcaaaggctggcagggaaaggcagcttcccgccctgagaggtgcaggcagcaccacagagccatggagtcacagagccacggagcccccagtgtgggcgtgtgagggtgctgggctcccggcaggcccagccctgatggggaagcctgccccgtcccacagcccaggtccccaggggcagcaggcacagaagctgccaagctgtgctctacgatcctcatccctccagcagcatccactccacagtggggaaactgagccttggagaaccacccagccccctggaaacaaggcggggagcccagacagtgggcccagagcactgtgtgtatcctggcactaggtgcagggaccacccggagatccccatcactgagtggccagcctgcagaaggacccaaccccaaccaggccgcttgattaagctccatccccctgtcctgggaacctcttcccagcgccaccaacagctcggcttcccaggccctcatccctccaaggaaggccaaaggctgggcctgccaggggcacagtaccctctcttgccctggctaagacagggtgggcagacggctgcagataggacatattgctggggcatcttgctctgtgactactgggtactggctctcaacgcagaccctaccaaaatccccactgcctcccctgctaggggctggcctggtctcctcctgctgtcctaggaggctgctgacctccaggatggcttctgtccccagttctagggccagagcagatcccaggcaggctgtaggctgggaggccacccctgtccttgccgaggttcagtgcaggcacccaggacaggaaatggcctgaacacagggatgactgtgccatgccctacctaagtccgcccctttctactctgcaacccccactccccaggtcagcccatgacgaccaacaacccaacaccagagtcactgcctggccctgccctggggaggacccctcagcccccaccctgtctagaggagttggggggacaggacacaggccctctccttatggttcccccacctggctcctgccgggacccttggggtgtggacagaaaggacgcctgcctaattgtcccccaggaacccagaacttctctccagggaccccagcccgagcacccccttacccaggacccagccctgcccctcctcccctctgctctcctctcatcactccatgggaatccagaatccccaggaagccatcaggaagggctgaaggaggaagcggggccactgcaccaccgggcaggaggctccgtcttcgtgaacccagggaagtgccagcctcctagagggtatggtccaccctgcctggggctcccaccgtggcaggctgcggggaaggaccagggacggtgtgggggagggctcagggccctgcaggtgctccatcttggatgagcccatccctctcatccaccgacccgcccacctcctctccaccctggccacacgtcgtccacaccatcctgagtcccacctacaccagagccggcagagccagtgcagacagaggctggggtgcaggggggccgccagggcagctttggggagggaggaatggaggaaggggaggtcagtgaagaggcccccctcccctgggtctaggatccacctttgggacccccggatcccatcccctccaggctctgggaggagaagcaggatgggagaatctgtgcgggaccctctcacagtggaatacctccacagcggctcaggccagatacaaaagcccctcagtgagccctccactgcagtgctgggcctgggggcagcccctcccacagaggacagacccagcaccccgaagaagtcctgccagggggagctcagagccatgaaggagcaagatatggggaccccaatactggcacagacctcagctccatccaggcccaccaggacccaccatgggtggaacacctgtctccggcccctgctggctgtgaggcagctggcctctgtctcggacccccattccagacaccagacagagggacaggccccccagaaccagtgttgagggacacccctgtccagggcagccaagtccaagaggcgcgctgagcccagcaatggaaggcccccaaacaaaccaggaggtttctgaagctgtctgtgtcacagtcgggtatagcagcggctaccacaatgacactgggcaggacagaaaccccatcccaagtcagccgaaggcagagagagcaggcaggacacatttaggatctgaggccacacctgacactcaagccaacagatgtctcccctccagggcgccctgccctgttcagtgttcctgagaaaacaggggcagcctgaggggatccagggccaggagatgggtcccctctaccccgaggaggagccaggcgggaatcccagccccctccccattgaggccatcctgcccagaggggcccggacccaccccacacacccaggcagaatgtgtgcaggcttcaggctctgtgggtgccgctagctggggctgccagtcctcaccccacacctaaggtgagccacagccgccagagcctccacaggagaccccacccagcagcccagcccctacccaggaggccccagagctcagggcgcctgggtggattctgaacagccccgagtcacggtgggtatagtgggagctactaccactgtgagaaaagctatgtccaaaactgtctcccggccactgctggaggcccagccagagaagggaccagccgcccgaacatacgaccttcccagccctcatgacccccagcacttggagctccacagtgtccccattggatggtgaggatgggggccggggccatctgcacctcccaacatcacccccaggcagcacaggcacaaaccccaaatccagagccgacaccaggaacacagacaccccaataccctgggggaccctggccctggtgacttcccactgggatccacccccgtgtccacctggatcaaagaccccaccgctgtctctgtccctcactcagggcctgctgaggggcgggtgctttggagcagactcaggtttaggggccaccattgtggggcccaacctcgaccaggacacagatttttctttcctgccctggggcaacacagactttggggtctgtgcagggaggaccttctggaaagtcaccaagcacagagccctgactgaggtggtctcaggaagacccccaggagggggcttgtgccccttcctctcatgtggaccccatgccccccaagataggggcatcatgcagggcaggtcctccatgcagccaccactaggcaactccctggcgccggtccccactgcgcctccatcccggctctggggatgcagccaccatggccacaccaggcagcccgggtccagcaaccctgcagtgcccaagcccttggcaggattcccagaggctggagcccacccctcctcatccccccacacctgcacacacacacctaccccctgcccagtccccctccaggagggttggagccgcccatagggtgggggctccaggtctcactcactcgcttcccttcctgggcaaaggagcctcgtgccccggtcccccctgacggcgctgggcacaggtgtgggtactgggccccagggctcctccagccccagctgccctgctctccctgggaggcctgggcaccaccagaccaccagtccagggcacagccccagggagccgcccactgccagctcacaggaagaagataagcttcagaccctcagggccgggagctgccttcctgccaccccttcctgccccagacctccatgccctcccccaaccacttacacacaagccagggagctgtttccacacagttcaaccccaaaccaggacggcctggcactcgggtcactgccatttctgtctgcattcgctcccagcgcccctgtgttccctccctcctccctccttcctttcttcctgcattgggttcatgccgcagagtgccaggtgcaggtcagccctgagcttggggtcacctcctcactgaaggcagcctcagggtgcccaggggcaggcagggtgggggtgaggcttccagctccaaccgctccactagccgagactaaggaagtgagaggcagccagaaatccagaccattccatagcaaatggatttcattaaagttaccagacttcagtgtaagtaacatgagccccatgcacaacaatcccttatgaaggggaagtcagtgtcgcctcggatttcttgaaaaacacaaaaacttatcaatgcctgtaaaagtctgttggaaagaaaatatgattcaagaatgttatgcccaacaaagctggcatattttctacccggacacactcagggaatgtggtcgcttgagtgcttctctcactgcgtaaatcctacgtggtgtttaagcatattcataaatgtgtatgtctatttttatgtgtaagatggttcatttttattttatttattcaatatgtacaataaagaatattgacaaataggctggacatggtggctcccacctgtaatcccagccctttgggaggccgaggcgggcagatcacctgaggtctggagttcgagaccagcctggccaacatgatgaaaacccatctctactaaaaatacaaagattagccaggcatggtggtgcatgcctgtaatcccagccactcaggaggctgagacaggagaaatgcgtgaacccggaaggcggaggttgcagtgagccgagatcacaccactgcactccagcctggcgacagagcaagattccatctcaaaaaaaaaagacaaagaaatttgtttttttgaataaagacaaatttcatcacacgaagataaagatgcaaagctccagacaggaaggcacggacagcacagtgaagcctggagcgggcgctggggggccaggggcatggcgggggtgccagcgtctctcagtgcctaccatggccactccagcctgtgttctcacgaggatggctgtgcaatgctaggagcgtgttcgaagctctagggcaaccactggaagtgaggctgaggagcagagcccagaggcccgtggagctgatgaaaagaaagctggagaaagtgtttgctgcctcccaacatggtaagaaaagatagaaagagagagcacacggcaaagggagcttgctgagggactctttacaatggcttgcacagagctcagggggtctgggaggctagggccctgcgcagggcagtcaccccagcctgctgaccaaggtttgctgcaggcagctctgggggtggttgaggcgcggtccctggagccacccctcaagggaacgaggcagcagagtgggccaaggcccaggtcggctgcaaggctgcccaggacttggggtccttacatcagcagccactgatgcagctggcccagagagaggcgccgagcaggttgcctccaggggacaaaccaggtcggagagggtgaggcagtggatggagccacaacaaccccgggcacgggtgacacgcacgttcatgcacatctgacccttcctccctcaccaaacaggtccccctgccttccccatggttgcgaaaaagcaaaatgtagacgttttttcttttttaattcatgttttaattgacaaatgaagccgtatatatttattgtgtacaacatgatgctttaaaatatgtatacatcgtggaacagcaacgtcgagctaatttaacacgcattacttcacatacttgtcatcttttgtggcgagaatgcttaaaatccactctcttagtattttttaagaatgcaatacattgttgtcaactgtggtcaccgtcatgcatagccaagctcccgacctcaccctcctgccagctcaggctgtgcatcctttcaccagcatcccccaccccggcccctggccctggtaactaccactctatactctacgtatgagttcagctttttaagattccacagatgaatgagatcatacagtatttgctttctatgcctggcttattttagttaacacactgtcctccagatccatccgttgttgcaaatgacagggtttcattctttttaaagtctaaagagtattccattgtgtcaatggacctcatttgctttatccatgcatcaactatggacatttaggttgattccatttcttagctgttgtggatggtgctgcagtaaacatggggctgcagatgtctcttcaacatactgacatcatgtcctttggataaatacccagtagtgggatcgctggatcacaatgtacagttttttttttaatggaaactttcattttttggtgaaattaggaaaacagataaaacccacagaatccaaaatatatgtgaagatgccaaaaacagttgacattgggcagaggtcacatggaaggaagtgaatacatgacggggtgtgagggcccagaggcagctgaaatacgctttctaaacacaaggacctcttctgagagggcagaagttttatcctgcacatgcaatgaccagcacagctaaaatacactttctaaacatgaggacctcttctgagagggcagctttatcctgcaaatgcaatgaccagcacaggacccagaataaagagagttgccagcggacgcctggtgtccatgtgtccaggtgagttcgagatgcggacggcgctggccagccagtcacaccctaagtcaatctgctgcatgcatttgtccttgccacagcagaaaacgagaaagcctttgggctgcaaagcttcacaggctcctcttctcccgactccatggaaacagctacaaagagcaggcccagtagagcttaattcatgaaaatgagtaataaacttgaactggaacagtatcgactttttagaaacggcagcaaagtgtataaaaaatattcaccagaacaatatttccaaacgatgagatgagaatttcagccaagtaatcctccatggatagaaaataatgaagggattggatttatgaaggaaaatcatggagctcaaatacaagagaagagaatcaaaaatgaacaggaggagataaaatatggtttggccaaagttacaaaataaattttttaaaaacccttcatcatggcaagtagaaagagcgagaggaaaaacagatcccgtggaagacacaaataggacatggggagaaaaatgaatgagatgaaacagagcagaaataaaattttacggaactaaagacaagtgatctgaacctgcctggggcctgggggacctcgccaccctgaagggaaagaacatgcctggctggctttgccacctgctcattgcagagccccacagcttgcaacaaacataggcggtagccagggagtggttacagcaggccttgagcaagacccagtgttgtgctgacttcaggtctgacccagcactgtcatagtggtggtgtccatagtggtagtgggggtgcttgtgtcactccacccccatctccaggaggctcagaacagacagagagagactccatttgtttgggagaaagtaagggatgagaacaagagtctctgcctggtaatccagagaattattctagatcttggccaagattatcaaagcagtacctctatgagtcttttgggcttggagtccccctaaagcagatatagctaagatcacaacacccaagtccttttgaatatgtgggaagacttcccaaggacaggagcaaacaaacaagcccagactgcaaaaaaacaagcccagactgcaataaacacctcactcttcaatgcccaggcactgaagaacatctcctagcagcaacaccatccaggaaaacatggcctcaaccagtgaactaaataaggcaccagggaccagtctcggagaaatagaggtatgttatctttcagagaattcaaagtagctttgttgaggaaactcaaagaaattcaagataacacagtgaaggaattcagaatcctatccgataaatttaacagagattgaagcaattaaaaagaattaagcagaaattatggagctgaaaaatgcaattggcatactgaaaaatgcatcagagtattttcatagcctcatatatcaagtagaagaaagaattagtgagcttgaaaacaggctatttggaaaagcacgataaaaggagacaaaagagaaaagaataaataacaatgaagcatatctacaggatctagaaaatagcctcaaaaggccaaatctaagaattattagccttaaagaggaggtagagaaagagggatggagagtttattcaaagggataataacagaaaacttcccaaacctagagaaagatatcaatatccaaatgcaagaaggatgtagtacaccaaggagatttaatgcaaagaagactacctcaaggcattcaatactcaaactcccatatgacaaggactttaaaaagatcctaaaagcagcaaaagaaaagaaatgaataaaatactatggagctccaatatgtctggcagcagacttttcagtgaagactttatatgccaggagagagtgtcataatggatttaaagtgctgaaggaaaaaacttttaccctcgaacagtatagctggtgaaattatccttcaaacatgaaggagaaataatttgtttccagacaaatgttgagggatttcatgaacaccagacctgtcttttaagaaatgctaaagggagtacttcaatcagaaagaaacacgttagtgaacaataagaaatcatctgaaggcacaaaactcaccggtaatagtaagtacacagaaaaacacagaatattataacactgtaactgtggtgtgtaaactccttttgtttgtttgtttgtttgtttgtttgtttgtttttgtttttagacggagttttgctccagcccaggctggagtgcaatggcacaatctcagctcactgcaacttccacctcctgggttcaagcaattctcctgcctcagcctcccaagtagctgggattacaggcatgtgctaccatgtccagctaattttgtattttagtagagacggtgtttcaccatgttggtcaggctagccttatcttgagtagaaaaactaaatgatgaagcaatgaaaaataataactacaacttttcaagacatagtacaataagatataaatcataacaaaaagttaaaaggtggagggatgaagttaaggcatagagtctttattagttttctttttacttgtctgtttatgcaaacagtgttaagttgtcatcagtttaaaataatgggtcataagatactatttgcaagcctcatggtaacgtcaaaccaaaagcaatacaacagatacacaaaaaacaaaaagcaagaagctaaattacgtcatcagagaaaatcaccttcactaaaaggaagacggagaaaagaatgaagagagagaagaccaaaagcaaatagcaatatggcaggagtaagtccttacttatcaataataccattgaatgtaaatggactaaactctccaatcaaaagacatagagtggctgaatcaattaaagaaaaaacaagacccattgatctgttgtccacaagaaacacactttatctataaagacacacatagactgaaaacaaagggatggaaaaagatactccacgccaatggaaaccaaagaaagagcaggagtagctacacttatatcaggcaaaatagatttcaagacaaaaactataagaagagacaaggtcactaatgataaacaggtcaattcagcaagaggatataacaattgtaaatatatatgcacccaatgctggagcacccagatatataaagcaagtatttactagagctaaagagagaaatagactccaatgcaataatagctggagatttcaacatcccactttcaacattgaacagatcctccagatagaaaatcaacaaagaaatattggacttaatctgcactatcgaccaaatggatctaacagatatttacagaacatttcatccaacagctgcagaacacacattcttttcctcagcacatagatcattctcaaggatagaccatatgttgggtcacaaaacaagttttaaaatattcaaatacattgaaataatatcaagcatcttctgtgaccacaatggactaaaactagaaatcaataacaagaggaattttggaaactatataaatatatggaaattaatgaatgctgagtgggtcaatgaagcaattaagaaggaaactgaaatttttcttggaacgaatgatcatggaaacagaaaataccaaaacctatgggatacagcaaaagcagtactaagagggaagtttacagctacaaatgcttacattaaaaaagaagaaaaacttcaataaaaaaacctaacaatgcatcttaaagaactagaaaagcaagaggaaatcaaatccaaaattagtagaagaaaacagtaaaggtcagagcagaaataagtaaaattgaaatgaagaaaacaatacaaaagatcaataaaacaacaggttgttttcttgaaaagttaaacaaaattgacaaacctttagccagactaagaaaaaaagacagaagatccaaataaataaaatcagagatgaaaaaggtgacattacaacttacaccacagaaattcaaaggatcattagtggctactataagcaactatatgccaataaattggaaaatctagaagaaatgcagaaattcctagacacatacaacctcccaagattaaaccaagaagaaattcaaaacctgaacagactgataacaagtaatgagatcaaagccgtaataaaaagcctcccagtaaagagaagcccaggacccgacggcttcactgctgaattctaccaaacatttaaagtagaactaataccaatcctactcaaactattccaaaaaatagaggtggaaggaatacttcaaaactcattatacgaggccagtattaacctgacaccaaaactagacaaagacacatgaaaaaaagaaaactacaggccaatatgtctgatgaatattgacacaaaaatcctcaacaaaatactagcaaaccaaattcaactacacattagaaagttcactcatcatgaccaagtggaatttatctaacttgggatgcaaagatggttcaacatatgcaaatcaatcaatgtgatacatcatatcaacagaatgaacaacaaaaaccatttgatcatttaattgatactgaaaaagcatttgataaaattcaacattccttcataataaaaattctcttctatactaggtacaaaagaaacttacctcaacataataaagccatatatgacagtcccacagtatgatactaaatgaggaaaaactgagagcctttcctctacgatctggaacatgacaaagatgcccactttcatcactgttattcaacatagtactggaagtcctagctggagcgatcagacaagagaaagatataaaaggcatccaaattggaaaggaataagtcaaattatcctcatttgcatatggtatgatcttctatttagagctaactaaagactccaccaaaaaaagttattagaactgacgaacaaattcagtaaagctgcaggatacaaaatcaacatacaaaaatcagtagcatttctatatgccaacaatgaccaatgtgaaaaagaaattaaaaagtaaccctatttacaataaccacaaataaacacctaggaattaaccaaagaggtaaaagatttctgtaatgaaaactataaaacactgatgaaagaaattgaagagtacaccaaaaaatggaaagcaattgcatgttcatggattagaagaatcagtgttgttataatgtccatactatccaaagcaatctacagattcaatgcaatccttatcaaaataccaatgacatcattcacagaaatagaaaaaaaaaatcctaaaatttacgtggaaccacaaagacccagaatagccaaagctctcctaagcaaaaagaacgaaactgtaggaatgacattgcctgtcttcaaattctactacagagctatagatagtaaccaaaacagcgtggtactagcataaaaacagacacagagacaaacagaacaaaatttaaaaacccagaaataaatccacacacctacagcaaattcatttttgacaaagttgccaagaacatactctggggaatagataatgatatctcttcaataaataatgtggggaaaactggatatccatatacataacagtgaaactagacccctctctctctcactatatacaaaaatcaaatcaaaattgtttaaggacttaaatctaagacctcatactatgaaaccactgcaagacaaccttggcggaaactctccaagacatcagtccaggcaaagatttcttgagtaatatcccacaagcacagacaaccaaagcaaaaatggacaaatgggatcacatcaagttaaaaagcttctgcacagtaagggaaacaaccaacaaaatgaagagacaacccacagaatgggagaaaatatttgaaaaatacccatctggcaagggattaaaaaccagaatatatgcagaatatataaggagctcaaacagtgctatagaaaaaaaaatctaataatctgatttaaaaatgggaaaaatgttagaatagacatttcttaaaataagacatacagatggcaaaccgacatggaacggtgctcaacatcatggattatcacagaaacacaatcaatcaaaactaaaactaaaatgtgctatcatctcaccccagttaaaatggctgatatccagaagacaggcaataacaaatgctggcaaggatgtggggaaaagggagcccccatacactgttgctgggattgtaaattagtacaaccactgtggagagcagcatgaaagttcctcaaaaaactgaaagaaagctaccataggatccagcaatcccactgctgtgtatatactacaaaagaaaggaagtcagtatatgaagaggtatctgcactcccatgtttgttgcagccctgttcacaacagccaagatttggaagcaacctaagtgtccatcagcagttgaatgtataaagaaaatgtggtgcatatacacaatggagtattattcaataataaaaaggaatgagattgagtcatttgcaacaacatggatggaactggagatcattatgtgaagtgaaataagccaggcacagaaagacaaacattacaatgttcttacttattaatgagatctaaaaatcaaaacaattgcacccatgttcataaagagtaaaaggatggttaccagatgctgagaacggtggtggggggatagggaaaggtggcagtggttaacgggtacaaaaaaatagaaagaatgaataagacttactacttgatagcacagcaaggtggctatagtcagtaatttagttgtatatttttaataatgaaaggtgtataattggattgtttctaacacaaaggataatgcttaagaggatggataccccattttccatgatgtgattatttcacattgcacgcctagatcaaaacatccaatgtaccccataaatatatacatcttctatgtacccataaaaattctgtaaaataaaatatataaaaagaggtgacagatatggaagacaggcaaagaagagacgacatccacataatccgagtacctaagaaagaatggagtccagtgcatctcaggagccaccattctaagccaattttctctggttctctcagtcaccctaccaatacgtgggcaatcttgttttatttcaggatagagtttttgaaattatagatttaagtatgctttctgttctattacttttggtaattaattttagaaagaactaatttgggcacaaatttgaaaaaattctaaatccaaaaaaaaaaagaaaaaaacacacacacaatcatctataagggggatgatgaccagtcctagatttctcaccagccacattcaagatcagtaaatggtaggacaaaacctgtagggtccttaagggggaaagaagtagtggatagtccagagtctatatacagccaactgttcttgaagaaaaaaggctgctgaaaaggagttccaaacattctataatccataatctcatgatgaaactactagaggaagaccaccagccatcaaaaggtgcttggagaacccagggccaagaaccaaaagtaaatattaagtgtccttaactgcgagactaagatagaaatgactgtgggggaccatgtggcctcaacagaggtgaaatggtgtctgcctgacaaagtggacattttacaatgatcaaaacacagaatatgagatagagagcacttctgaattactgcctcactccaaataactctcagccaaaggacttcagtaaaaccaaattgggcatattagacagtacaaacaaattctaagaaaataatattactgattacaatcacatgatgctagagatggaggggaaaaggaagaggaaaccaggtaatttcatactcgtatatagtaaagaactaaagtacattgtccaaagaagaacaaagaatattttggaaagttataaaggtagccactacacatagaagatagcaaagaacaagaaaacttaagatggaaaactttttggaagcataaaaatagaaaatataaactactaagataagattgaagccaaacagatctatgaaaacaacaaacatcaatggccttaacttgcctattaaaaggaagagactttcaaattggaccacaagataaaacccaactctatatagcatatgagtattacacacaaaatgggaaaagctgaaaaaacttgggcaaaattcaccccaagcaaattccactgtttcctttgggacaaaatgccaagctccatgccagggaagatgattctcctcagaccttctcctcactctcccagtcctcttagggaaggaattgggtgttagaggagggagactctgtcgattatcagctgaagcagtggtgtgctcctgcgttgcttctgacctgggaaatgaagcagcaagactctttctgctgtgtctttgcccagaagggccatccccccagagcagagtacccaggccggcaggagcagtggtggaagcgtggaaaccacgtctcctacagcagagaccatcagaagcggagcctcgggtataagggaaacaacgcgttctccctaacctgggagtgacagacagcgtcattcctcacagtgataccctgtgttctagccatctggcccatgacagagccagcccagagccagcccagagccagcccctcaccaacctggagcctggccagctcgccaagctgcaccataggcctggaaggcgtggagacctgcggcagtgccctgtcctcccgtgaggcctgccatccctgccaggggtcgcctctggcttctccttctccaggaccgcacggtccagaggctcagtgcctggagtaggtgttgcccccctgcttctaggcccagaccctcccttgttcctgaccccgggcctttccctctggcttggacatccagggccctgtctcagctggggagctgctcctgctcaaggactgtcttccgcgggatcgaaaggccgcgtcctgaacaatgcgtgggccacgtgagcggagcaggctctaaaggccgcgtcctaaacagtgcgtgggccacgtgagcggagcaggctctaaaggccgcgtcctaaacagtgcgtgggccacgtgagcggagcaggctctaaaggccgcgtcctaaacagtgcgtgggccacgtgagcggagcaggctctaaaggccgcgtcctaaacagtgcgtgggccacgtgagcggagcaggctctaaaggccgcgtcctaaacagcgcgtgggccacgtgagcggagcaggctctaaaggccgcgtcctaaacagtgcgtgggccacgggagcggagcagactctaaaggccgcgtcctaaacagtgtgtgggccacgtgagcggagcgccctctccactgccctcggggccgcagctcccagctcagctcccagccctgctcagggcagccaggccaggaggtaccatccaggctaagtgaccctcaggggggacaggtgccccaggagatgccagctgttgggagaggctgggggaccaactcgacctggcctgtgggccctgccctggccacccattgtaggatccagccgccacgcctgtgacactcgtgtgctttccctggtgtgtgcttgtggcaggtgggggcagagggtcctcaggccagagagccactcccccagcgccagaccaccctcttcctcactcccccacctcaccccctcacaggtgcctcccaggccatcagggcccaaccacccctaaacaaatgggttctcggcccctcgtggctggaggtgggttctctcaccattcccagcctaagactccatccccatgctggcagctgttcaaccatgtctagagagatccactgtcccagacagcacctcagggtcccccgtcctgcctggaaccctgtaggaaactccacaaaccgccgccattctgtccacacccctacaggagccccaaccctctccccacatccaggcttccctcccagacccctcatccctgcccgcacggtgcctgagggggccttcttgggcagcgcctaagcaagcccccagcacccttcggccccttcaaggcacacaggccccctttccacccagcctcaggaaaccacctgtgtcctccaacgacaggtcccagcctcccagcctttgccttgcctgttcctctccctggaactctgccccgacacagaccctccccagcaagcccgcagggcacctcccctgcccccagacaccctgtgcccatcagttcatccccagcagaggccctcaccaggcacacccccatgctcacacctggccgcaggcctcagcctccctgagggccccacccagcccgcgtctggccagtggtgcgtgcaaagcccctcacccagactcggcggaaggcagccagtgcaggcctggggaggggctctccttagaccaccttgcaccttccctggcacccaccatgggaagagctgagactcactgaggaccagctgaggctcagagaagggacccagcactggtggacacgcagggagcccacgccagggcgccgtggtgagtgaggcccagtgccacccactgaggcctcccgttcagtgggacgacggtgaacaggtggaaccaaccaggcaacccccgccgggccccacagacgggatcagagcaggaaaggcttcctgcccctgcaggccagcgaggagccctggcgggggccgtggccctccaggcgaggaggctcccctggccaccgccacccgggcctctctgctgctgggaaaacaagtcagaaagcaagtggatgagaggtggcgtgacagacccagcttcagatctgctctaatttacaaaagaaaaggaaaaacacacttggcagccttcagcactctaatgattcttaacagcagcaaattattggcacaagactccagagtgactggcagggttgagggctggggtctcccacgtgttttggggctaacagcggaagggagagcactggcaaaggtgctgggggcccctggacccgacccgccctggagaccgcagccacatcagcccccagccccacaggccccctaccagccgcagggttttggctgagctgagaaccactgtgctaactggggacacagtgattggcagctctacaaaaaccatgctcccccgggaccccgggctgtgggtttctgtagcccctggctcagggctgactcaccgtggctgaatacttccagcactggggccagggcaccctggtcaccgtctcctcaggtgagtctgctgtctggggatagcggggagccaggtgtactgggccaggcaagggctttggcttcagacttggggacaggtgctcagcaaaggaggtcggcaggagggcggagggtgtgtttttgtatgggagaagcaggagggcagaggctgtgctactggtacttcgatctctggggccgtggcaccctggtcactgtctcctcaggtgagtcccactgcagccccctcccagtcttctctgtccaggcaccaggccaggtatctggggtctgcagccggcctgggtctggcctgaggccacaccagctgccatccctggggtctccgccatgggctgcatgccagagccctgctgtcacttagccctggggccagctggagcccccaaggacaggcagggaccccgctgggcttcagccccgtcagggaccctccacaggtagcaagcaggccgagggcagggacgggaaggagaagttgtgggcagagcctgggctggggctgggcgctggctgttcatgtgccggggaccaggcctgcgctttagtgtggctacaagtgcttggagcactggggccagggcagcccggccaccgtctccctgggaacgtcacccctccctgcctgggtctcagcccgggggtctgtgtggctggggacagggacgccggctgcctctgctctgtgcttgggccatgtgacccattcgagtgtcctgcacgggcacaggtttgtgtctgggcaggaacagggactgtgtccctgtgtgatgcttttgatatctggggccaagggacaatggtcaccgtctcttcaggtaagatggctttccttctgcctcctttctctgggcccagcgtcctctgtcctggagctgggagataatgtccgggggctccttggtctgcgctgggccatgtggggccctccggggctccttctccggctgtttgggaccacgttcagcagaaggcctttctttgggaactgggactctgctgctggggcaaagggtgggcagagtcatgcttgtgctggggacaaaatgaccttgggacacggggctggctgccacggccggcccgggacagtcggagagtcaggtttttgtgcaccccttaatggggcctcccacaatgtgactactttgactactggggccagggaaccctggtcaccgtctcctcaggtgagtcctcacaacctctctcctgctttaactctgaagggttttgctgcatttctggggggaaataagggtgctgggtctcctgccaagagagccccggagcatcctggggggctcaggaggatgccctgaggcaacagcggccacacagacgaggggcaagggctccagatgctccttcctcctgagcccagcagcacgggtctctctgtggccagggccaccctaggcctctggggtccaatgcccaacaacccccgggccctccccgggctcagtctgagagggtcccagggacgtagcggggcgccagttcttgcctggggtcctggcattgttgtcacaatgtgacaactggttcgacccctggggccagggaaccctggtcaccgtctcctcaggtgagtcctcaccaccccctctctgagtccacttagggagactcagcttgccagggtctcagggtcagagtcttggaggcattttggaggtcaggaaagaaagccggggagagggacccttcgaatgggaacccagcctgtcctccccaagtccggccacagatgtcggcagctggggggctccttcggctggtctggggtgacctctctccgcttcacctggagcattctcaggggctgtcgtgatgattgcgtggtgggactctgtcccgctccaaggcacccgctctctgggacgggtgccccccggggtttttggactcctgggggtgacttagcagccgtctgcttgcagttggacttcccaggccgacagtggtctggcttctgaggggtcaggccagaatgtggggtacgtgggaggccagcagagggttccatgagaagggcaggacagggccacggacagtcagcttccatgtgacgcccggagacagaaggtctctgggtggctgggtttttgtggggtgaggatggacattctgccattgtgattactactactactactacatggacgtctggggcaaagggaccacggtcaccgtctcctcaggtaagaatggcctctccaggtctttatttttaatctttgcctatggagttttcagagtattgcatactaaccccggagatgtgtcaagctggccgggagaagctagggactaaactgcctaggggatctcagagccttggggataaactaagaatctctttgatggtgttggtagagtccctaaatgatggagcagggattttggagcctcatttgagggagatgctaaaaagattccatggctaaagggatagtttgggctgtggttggagattttcagtatttagagtaatagtgttagctgagaaatataattcaggaccctctgagacagcatctgtacagtatctgatgcacagggacaaagagtggagtgggacactttcttcagatttgtgaggaatgttctgagtagattgtttaaaacatcatttgttgaaaagagaacttttagtgaatcaatcaaggaaggaaggaaggctcagtctcaaaagggtagctgatatccagaggaatctggataagcctgcaaaagtctagctttcaaaggaatgcagaagtatgcatgtggaaaattagaagatttttttttacccttaaagtggttcctatgatagttagaatactgtgactttactatgtgagagagttttcaagtattcacttttttttttaaatgtccaagtacgaaaaaattttgtcagtttgaagtcaggtttgtacagaattgatattgttgaaagtttaaccaaagaatgggaatgaggctctttcacaccctattcagaactgacttttgacaataataaattaagtttaaaatgtttttaaacaaattgagcaatgttgagttgcagtcaagatggccgatcaggaccaggacacctgcagcagctggcaggaagcaggtcatgtggcaaggctattttgggaagggaaaataaaaccactaggtaaacttctagttgtggtttgaagaagtggttttgaaatgctctgtccagccacgcagaactgaaagtccaggctgagaaaaacaacacctggataatttgcatttctaaaataagttgaggattcagtcgaaactggaaaggtcctcttttaacttagtgagttcaatcttttaattttagcttgagaagttctagtttccctcaaacttaagtttatcgacttctaaaatatattcattttcaaaattaagttatgtaaaaaaattgaaggacttcagtgtctttaatttctaatgtatttagaaaactttttaaagttactttattattcttccctctgattattggtctctgttcaattcttttcccagtacccaaagcatttacagtgactttgttcataattttttttaagttagttgttttctgccttactattaagactttagcattctggtcgaagtggcttcataaatctttttcaaggccactttttaggagaaagacatcttttttttaatgaatgcaattatctagaattatttcagttaaacatgttagttggtggttgagaggacactcagtcagtgcagaaggtctgtaagccagtccacagagacattcctgggtgaactccctctggccctgcttcttgttggagaactggccagaggtctgagaccaggctgctgctgggaaggcctggactttggtctcccagtaccgcccagacctggggatgtatggttgtggcttctgccacccatccacctggctgctcatgaaccagccagtcttgatggctttgaaggaatgattccacacaaagactctggacctccctgaaaccaggcactgcaaacggtaagccagcggcagccacagctgtggccgctgtccttaaaccttgtaattgtttctgcttgattgagtcttaagtcattgctttaggaggagaaagagacatttgtgtcttttgagtaccattgtctgggtcactcgcatttaactttccttgaaaaacttataagagaaaaacgttgcctgttaaccattaactacagggctcgtgatactttgagaaaatcttagaaaaaaatgtatacagttgtctggaattatttcaatgaagtgtattagttggggtactggcgctgtctctacttcagttatacatgtggttttgaattttgaatctattttgtctcttcttaagcaccaagtatagatacagtggatacactcactggtttttaacggtggttttaatctagaaggaatttaaactggaggctaatttagaatcagtaaggagggacccaggctaagaaggcaatcctaggattctgaaagaaaagatggttttagtttttatagaaaacactactaccattcttgatctacaactcaagacggtctaatgaattttgaagttactggtaaatatacttcctggttgttaaggaatgattatcaaatggatcagtgcttggatctgaggtcagtgtgagaggacagggcctgggctgtggatatacagaaggaaggccacagctggatagaattgaaaaagaatggagacctgctgctgaggcaagcagatcagccggactctttccagccatagcaaagaaccagattaataaagagaaggccagattaataaagcttgctgagcaaaatttagtgaacaaggttgacagcctggctaggaagctaggctctagttaagcacagttggactgagatgtgtaggcttccctgagcccttcaaaaatgtgctaagctgagatgattactctgaggtagccaaagctggacttgagcaggaacgaggtagactgcaatgagctgaattgagctaggccggctaagctaaactaggctgacttaaccaagatagccaaattggaatgaattgtcttgatctgggctgattggagctaaactctactggactgctctgaactgagctgtgttgggctgtgttgtgctggggtgagctgagctagcatgagctactctgtggtagctggggtgagctgggatgagctgagctgggtgagctgagctgggtgagctgagctgggttagctgagctggggtgagctggggtaagctggggtgagctgagctgggtgagctgagctgggtgagctgagctgagctgggtgagctggggtaagctggggtgagctgggctgacctgaggtggttgagctgagctgggtgagcagagctgaggtgagctgagctgagctgggtgagcagagctggggtgagctgagctgagctgggctggggtgagctgagctgagctgggtgagctgagctgggtgagttgagctgagctgggtaagctgagctgagctgggtgagcagagctgggggtgagctgagctggatgagctgggctgaactggggtgagctggggtggggtgagctgggtgagctgagctgggctgagctgggctgagctggggtgagctgagctgggatgagctgggctgagctgggctgagctgagctgggctgggctgagctgagctgggctgagctgggctgggctgggctgggctgggctgggctgagctgggctgagctgggctgaactggggtgagctggggtggggtgagctgggtgagctgagctgggctgagctgggctgagctggggtgagctgggtgagctgagctgggctgagctgggctgagctgggctgagctgagctgggctgggctaagctgagctggactgagctgggctgagctgggctgagctgagctgggctgggctgggctgggctgagctgggctgagctgggctgagctgagctgggatgggctgggatgagctgaactgggtgagctgagctggggtgagatgagctgaacagggctgaactggggtgagctgagctgggatgagctggggtgagctgagctgggtgagatgagctgggtgagctgagctgagctgggctgagctgggtgagctgagctgggtgagatgagctggggtgagctgagctggggtgagctgagctgggtgagctgggctgagctgggctgggtgagctgagctgggttgagctgagctgggctgagctgggctgagctgggctgagctgggctgagctgggctgagctgagctgagctgggatgagcagggctgggatgagctgggctgagctgagctgggatgagctgggtgagctgagctggggtgagatgagctggggtgagctgagctggggtgagctgagctgggatgagctaggtgagctgagttggggtgagctgagctggggtgagctgggctgggtgaactaaactagggtgagctgggctgagctgatctggttgagctgggctgggtgagctgagctgggtgaactgagctggggtgagctgaactgagctgggtgagctggggtgagctgagctgagctgggtgaactgagctgagttgagttgggtgagctgagctgggtgagctgaactgagctggactgagctggggtgagctggggtgagctgggctggatgagctgagctgggtgagatgagctgaacagggctgaactggggtgagctgagctgggatgagctggggtgagctgagctgggtgagatgagttggggtgagctgaactgagctggactgagctggggtgagttgggctaggtgagctgaactggggtgagctgagctggggtgagatgagctgaacaggtctgaactgggatgagctgggatgagctggggtgagctggggtgagctgagttgggtgagctgagctgggtgagctgagctggggtgagctgagctgggattagctggctgagctgggatgagctgggtgagctgagttggggtgagctgagctggggtgagctgggctgggtgaactaaactagggtgagctgggctgagctgatctggttgagctgagctggggtgagctgggctgagctgggctgggtgagctgagctgggtgaactgagctggggtgagctgaactgagctgggtgagctggggtgagctggggtgagctgagctgagctgggtgaactgagctgagttgagttgggtgagctgagctgggtgagctgaactgagctggactgagctggggtgagctggggtgagctgggctgggtgagctgagctgggtgagctgagctgggctgagctggggtgagctgagctgagctgggctgggtgagctgagctgggtgagctgagctggggtgagctgagctgagctgggtgagctgggctgagctgagctgagctggggtgagctggggtgagctgggctgggtgagatgagctgtgctgggctgggtgagctgagctgggtgaactgagctgagctgagttgggtgagctgagctgggtgagctgagctgggctgagctggggtgagctgagctgagctggggtgagctggggtgagctgggctgggtgagctgagctgggtgagatgagctgtgctgggctgggtgagctgagctgggtgaactgagctgagctgagttgggtgagctgagttgagtgagctgagttgggtgagctgagctggggtgagctgaactgagctggactgagctggggtgagctgagctggctgagctgagctgggtgagctgagctgagctgagctgagctgagctgagctgggctgagctgggctgggtgagctgggctgagctgggctgggtgagctgggctgagctgggctgggtgagctaagctgggtgagctgggatgggtgagctggcctgagctgggtgagctgagctgaaaggatctgggttggagtcagctttgcttgggtgagctgagcagggtttagctgagctaggatgagttgagttggctgggctgagctgggatgaagtaggctaaataagctagcttgagctaaatagagctggggtgagctgtacttaaatgagctgtgattgaagtgggctgggatgagctcagctgaactgggctagctgatgtggatgatggtgaggctgagttaggatgagcatgactgagctggtttggacatgaatgagctggacccggctgacttgggctggttgagctttgcaagatgatgtggactaaactgggctagctggcaggatgagagaggttgaactaggctcagatgagctaggctgagcagggcttaggtgaggtggtttgggatgagctgggataagttgggctcagatgagctaccatgaactgggctgaggtggcctgggagaacatgaatcgagttgcactgagtacagccaggatgaactgggataaactgggctaaactgggttgggctaagaatggactgcctgagttatgctaagctgagctgggatgaattggggattgtcaagacttaaatgagccagactgaactggttggacttgggtgagctgaggggacctgctgcagggccggcatagctgagttgaatttagatgaggaagggtgagctagactgagcaaggctagactgcttatgctgagctacactaacctggcctgagttgggccaggctttgttggccatgtctaaactgagttaagatcaacagggagtctagaggggtaggggatgaactaagatgaattacactagctgagctgaattgagataaggtatggtaacctgagctgaactggaaagagatgtactggataaccttaactgggctgagatgagctaggtctacccaggcctggatcagcttaattagggtaggctagaccaaactgtagcagtatgtattagcctgtgccaagctgggctacattaaactaaactggacttagctaggctcagattagtttcgctactctagatggggtaagttgggccaaactgggatgaactaatttaactagcctgagatgggcagatctgaagtgtagcaaacacagccagggtgaactgaatgagtttgaccaggcctggaccagttaggctaaggaccttgtcctgggcagaccgtgtgctatggtggagtttcatgatgatgccataagagttcccccaccataacccacgtttctcctaccccatatacctgtctggtgtgtaaacctaatctttgtgtgctgatacagaagcctgagcccatcccccttccaccaccacctacctattgctttggaatgagcaaggttatctcagcgaatgtctcaaagggaagccgggacctaggcctgtccctgagagcagatgttcatgcccctggagtggctgccggtggctgaagggccagaaccacctactctagaggcatctctcgctgtctgtgaagtcttccaaagacattcctgtggttagaaggcagccctgctgtggctctgtcccatagaccaaacttacctactatctagtcctgccaaccttaagagcagcaacatggagacagcagagtgtagagagatctcctgactggcaggaggcaagaagatggattcttactcgtccatttctcttttatccctctctggtcctcagagagtcagtcctccccaactgtcttccccctcgtctcctgcgagagccccctgtctgatgagaatttggtggccatgggctgcctggcccgggacttcctgcccagctccatttccttctcctggaactaccagaacaacactgaagtcatgcagggtgtcagaaccttcccaacactgaggacaggggacaaatacacagctacctcgcaggtgttactgtccgccaaaaatgtccttgaaggttcagatgaatacttggtatgcaaaatccaccatggcaacaaaaacaaagatctgcatgtgccgattccaggtaagaaccaacccttcccgaggggatggggagagggggcaggcccaggcatggcccagagggagcagtggagtgggtcttaagccagcctgagctcacacctcaacctttcattccagctgtcgttgagatgaaccccaatgtgagtgtgttcattccaccacgtgatgccttctctggccctgcaccccgcaagtccagactcatctgcgaggccaccaacttcagtcccaaacagatcacagtatcctggctacaggatgggaagcctgtgaaatctggcttcaccacagagccagtgactgtcgaggccaaaggatccagaccccaaacctacaaggtcataagcacactgaccatcactgaaagcgactggctgaacctgaatgtgttcacctgccgcgtggatcacaggggtctcaccttctggaagaacgtgtcctccacatgcgctgccagtgagtagcctgtgctaagcccaatgcctagccctcccacattagagcagtcctcctacggttgtggccaatgccacccagacatggtcatttgcttcttgagccttggcttccaacagtggccaaggccaaggatgagcagtaggcagcagggggatgagagtcagatggagggaatcagcatcttcccttaagcagatttggaagatggagactgagcttttatccaacttcacaactagacacatcacaacctaacacagtgttctcttgactgcaggtccatctacagacatcctagccttccccatccccccctcctttgctgacatcttcctcaccaagtctgctaagctgtcctgtctggtcacaaacctggcaacctatgacaccctgaatatctcctggtcttccaaaagtggtgaaccactggagaccaacactaaaatcatggaaagtcaccccaatggcaccttcagtgctgtgggtgtggctagtgtttgtatggaagactgggataacaggaaggaatttgtatgcactgtgactcacagggacctgccttcaccacagaaaaaattcatctcaaaacccaatggtaggtatccccctttccttcccctccaattccagagcataccctgtacctcacagggagggcaggtccccttctaccctatcctcactattatctttgcttacagaggtggccaaacatccacctgctgtgtacctgctgccgccagcccgtgaacaactgatcctgagggagtcggccacagtcacctgcctggtgaagggtttctctcctgcagacatctttgtacagtggcttcagagagggcaacccttgtcctcagacaagtatgtgaccagtgccccaatgccagagcctggggctccaggcctgtacttcacccacagcatcctgactgtgacagaggaggaatggaactccggagagacctacacctgtgttgtaggccacgaggccctgccacacatggtgaccgagaggaccgtggacaagtccactggtaaacccacactgtacaatgtatcgctgatcatgtctgacacaggtggcacctgctattgaccatgctagcgctcaaccaggcaggccctgggggtcgagttgctctgtgtatgcaaactaaccatgtcagagtgagatgttgcattttataaaaattagaaataaaaaaaaatccattcaaatgtcactggttttgattgtccgatgctcatgcctgctggggcaactgttgtgttatgcttgtcctgcacacaccctgtatacttgcctccaccttggcccttcctctaccttgccagttacatccttgtgtgtgaactcagaaaggcttacaacagagtgtgagcatgccattcctccagctacttctagatatggctgaaagcttgcctaccttggtgcaggcagcattcaggcacatccacagacacacagagacagacatgcatttatacatagatctagagatggacatgtatagatacatgcacgaatatgtattcatagacacacagatagaggttccgcatgcgtgcatggacaaatacaaacaccttcagagacaaatatgcacagacacacaaccacacatggaaacaggcacaaacacacatgatcatgtgtgcaccaaaacagaatataggcaaatatagacaagtgaactacatagacatgaagacatgcatacacagacatgtaaagaaacatcttgaaatgtgtacactaacatgtggacagacatggcacacagttacacctggtctctgaccaggaccataatctccagggttcagggctcagagagtccatactaggctgggtggcactgatactcctcagggtcccactctatgattaggggaaatagcccgaggagcaaaatgtgcatttttggctcaacaccatggggcagaagataccccactaaccacccatgacagaaaattagccttggttgtgtctccattaatagaatacctcaggagatcaatgagagagcgcttgacccactcacttcccagtccagatgcagaagacacaatgcaattgtccaaaagaattgtacacacacacacacacacacacacacacacacacacacaccaacaaaggaacctctataaggagtcaccacccaataacattgcctctttggattcacatcctggacattcttcatattcatatccatttgggacctgggctttagaaatccccaagggctcatctttacagaggtcagagatcccaataaatgccctggtcccacagcctctctatctcttggtaccaagactcaacactgctggcaggggtagaacaatcaacacacaggaactctgatcaaagagaggcatgagatgcctgggtccttcaggaagtaaggagggataacctctgatatgcctactcttattcccaaagcccaggagaagggaaacctgctctgaattctcagtctaacagccccgatggtgccacctgctcagagaaagtccaaagaacacaaaaatcattatgccacatttcctgagtctgcctttacccatgtccgtatgttgcatctgccttgcttgctctgctgccccagagttcctgggacaaggccccaagttagtgcctcctccagtttgacctgtgctttgtctctgtctagcttgagctattaggggggccagtcaattctccagaaccagcagaacacccccaaccctgaggcaaatgttcaatcaccccaaggcttggcttgaccctccctctgtgtgtcccttcacagagggggaggtgaatgctgaggaggaaggctttgagaacctatggaccaccgcctctaccttcatcgtcctcttcctcttgagcctcttctacagcaccactgtcaccctgttcaaggtagtgtgtgtggtggggctgaggacacagggcagagacagggagtcaccactcctcactgcccctacctctactctgtaaaagggaacagcaattcacactgtctctgtcacctgcaggtgaaatgactctcagcatggaaggacatcagagagcaagagaccctcccacagggacactacctctgggcctggggttcctgcctgtatgactagtaaacttattcccacatctttcctgtgttgccctccagctttgatctctgagacgggcttctttctagactggccaaagactttgtccacttgtgcaacctggaacaatgtctggaaccacagacagctgtgctgtatacaaatgtcactttgaaataaatacttcaccttgcgaacccactctattgtgaaggaatttgttcttgttttcaaacttttcctgtggtgttgacatcccaaagactctctaaatagagcctgggaacttgaagtgaacagtctgatggggcttaagagtgaaagagggaaaggaggtgtggaagaagagagagagagagagagagagagagagagagagagagagagagagagagaaaccaccctgacagcaaagtatagcacaggcagccaatgggtagcagtctggtttatccaccctgatagaagaaagtagggcagagaaaactccaggcctgatctcacaaaagcaaccgaatctgaaaagtagcctctagcctggggtgtctgctccatccctcagcccaccctcttgggctggcgttgcttccagctagtgcaatactttggtgttagccaaacctttgtggtatgtggggtgtgccttgggagagttggctgagatctctaggatgtttgtatcccttctgcaacatgacaagccctaggggttagcccataacttgaggactcaaaccctctgtctataacaactgctgtggtcactggagaaggacagctaaaggcctgctcacacagcaggaaaggaaagggaggtaggtcatgtacttcagctcagaggaggaagcacagcagatacaaggtgagggcagtgctaggggttctgctgttcaccgtgtggatggctggaggaacctcacagaggtgggactagctggttacattgagagcaggacctgggagcagggcataagaaagaatatcagacagtgggagggaactgtgtagatgccagggtcctaaagagagtctttaaataagcatgtatggtagcaccttggtgatggcccctttctgagttgggtttctagtgggtagctgcaggagagcaacaagcatctattgagaaaacactgtaaagacgatagggcccaccaccaaattccagatatattttaggcattcacctcaataccctactttccataccagcatctgttttagtttccctgggctgcgggtgcaaagtgccacatgtggcagtttgagcaacagaactctgttctttcccagttctaaaggccaggattctgggcttcagcaggctggttcctctgtgcggcagggagaatgtgtcacagacttccagctctgaagccatagcatttgactaatacttgtctcctggcaccaacaccccagttactgtttcaaatgcatagcccatccccatgtgtgtttcctttgtacttactgccacgtttcacgaacccagttctgctgggtttgatgcccaccctcattcagcacaagttcatctcaggcagattccacccactacgacctcagagctagaagtctatgacacgttctccctgctgcacagaggacactagcctgctgtagcccagactcctggcctctagaactgtgaaagaacagagttctgttactcaaactgccacgtgttgcactttgccccagcagcccaagagagctacatagatgttagtatatgacgtaaggtgcagaggtgactttggaattgggcgatgaacctccaggcagtaaacagcctgctgacctttgcattagctgtgtgactgagatcacatcagttcccgacccccaagccccttcagacgtcacatcaatagagtcaaccgttagagtccatcgctataggaatgatgtcgcttgcactttagaaaggttttataaccaggactgtagttgtaccttaagctttgtgatatgtaaagaagtgagctaattatcaaaaggaaacattctgccaagtgatgttgtacttgaatgtgcccaaaacaaacatcccagcatcaaacgctagtatcttaaaccaacacaggtactgagtcatattaaactgaacgtacttcttgattcacacagacctacactgctgtctctgtttgcggagacccatgcagactaggtactggtgcacatagtcaacgagatgctgagggaggagagcacatactttaaggtagattaaaagggcactggacttggctattgacctccaggccacgctcaatgatgaggcaactaagagtctctgtacagccagaaatgtccccatatgctggccaggtataagatagatggtactagacacttggtgcaagagaaagagagtgtatatgacagacataggcacttgtagacttagtacacagcccactcagggccctaactgtctaaaaatgtgaaggagaatccataactcagtccatgagcattacatacacacctgtagctccacccacctcatcttcacaccttttaacatacagatcatcaggttatatcaggcctgtggcactctgaacccatctccatggctagtctatatccagaatgctgatggaccagcggtcaaggaagcctctctacctaccactctgatgccttttcctcctgagcttcatggtcaaagagaggatccatgagagcatccagggaccaaccacagccctatcagcacatggttctccagccatgtcgtcaactctgtctacccttggttattgctctttaataggtaccttgtctcactgtggcttataggttccatacgtgactatgatatgatagttcttcatctcaggtcctctgagtatcaacattctcacagacctagagcctgcctttgctctgaaagctgtatcttctcaacttggcactgacacagacagcaccctccattcctgtgtattgacccacatcctacccggagatattcctcaagaagcctcctccttaacctatgttcttccccggccagcacaagctcctaaatctgtgtcctgggtctgagccttggacctcataacgtggatcttctgtttacagaggttcaccccagcatcctacactacaattacccagcatgggcacctctgaccagacataaccttcctgattaacaatctgcttcttgttctccacattgcagtctttctgatgaggcccacataacctacaggctcctcacctctttctctgacacttcacaacacattcttccttcccttccattacatactgtcagtgtctctaaacccagagaaacacctggcttttcctagcagtcccaatcattcaagttaaggaccctcactttagtgaggatggccagtcccatgacccttcagaatttgttcccatctacatagttctgaggccctgaaggtcaccctctcccaatatctgtacctaactcctcctgcaaagacctgcaatgagctcctctactctgggggatccactaacctgtgtatcatgtgccagagcaggtttgattacttcattccgtattctcatgagcccctgagaccagaactggaatccctgattccacaatctaaaccatcaggttcccatggcagtccattttagagaccttctggtccgtgcctcttcttaatttatccaaggcattctcctgagtctcagcaatgcttctgtctgaagacataatttcctctacttggacactcaggcagagactcgagcctcttctttaaccgattcagtttggatggcacaccaggcttatcagtgttttcttgagatagcactagctagagacagggacagagaggtttagccaccaaagctggacttagatcacacatgaacaagaggcccagaggctatgaaccctctccaatgagctggtcaggaaagagtgggcataatcactcagcctcagccagctcagggacccagaaggcccaggtgcacagagtaggagcacatccaggcttcctaccttgtcccctgagtctcaagagtaccacatcaactactcccacacatccacatgaactaatctcagtcagctttggactccccctcatgtccagatacagaaacctccccagaataaaggggaacctcaggaaataccttatgccacccactgtcaatcatgttcttactcaatcatagggtggaaatagggtggcattcgcatctctggaacaaaggctgtgactctgggaaagacaagagaaagccaggaacaaatacatctgctttcacagcttccacatgtcaaaggggtcagcactaaatgaagctgcagaagaagaagacctcacagacagccagcatctgtagcccttccagatctttgagtcatcctatcacaggagattgagaaggagttgacggaccagcccaagcagaggaagcctgtgtgttcaacagtaaatgtgtttgccagcagcctgatgtcaactgagaagactgtggcgagtgcttgggagacaatcacgggcagctagagctgcacaaccccatagacaacaagcctgaaacacaaggagatgatgaaatatatccagaagactgcggaatcagtttggcctggaccacaggttgatagaaccaaggcagctgagccctgtggtaagtgaccaggagggcagagggagggagcttccaggagcatgcctgggaatgccttcaggccttctgagaagcagaaagtaggcaccctggggttccaggaaccatcccagcactcaagagttactaagggaatagaagcaaacctgagctgaaggagagaaagaaaagtggagggaagcccaagccactcaaagtaacaggcaggacaacttccagtgagctgagagaacaggagtgctggagaaggcagagcaagcccagcagatcaggagaacctgcataggagtctggatgactagagaaacccagaaggtgagagaacaggcttaacagctgtcatggacttagggatatgcaagcctggggcaccaagctgatctgcatagagggcaagggtaagtgggaatccaagagatctaagaatgaccagcgctgggcagagaggtggcctgggagaagatggctggtcttccccatgagtccaatagcaagattgtcggaataggttatcctatgacagatggcagtatcagtgaccaaatgaagacgctatggaagaattggaccatgtgggagttaagagttgaggacacaaggctgacctgcccatgggaactacagctgataaaagtgctgtgattcagggcatttctggaagctctgtgatccaggttgcagtacacaagtaaactgggacagacgggagttctgggggttcagttcagatactaggaacttaggaaactgggaaaagggaagttggggctgatggcagaactatgagaaggcactggaattctgaagaccagaccttctaatcaactatagaggaaatggagtgggtaggagtggtggatacagctgagcatcacaggggacctggggattggggacagctatactggggctagcagtgcaaacacagaaattgggggaccaaagggggaattgaggatgaccttgggtagatagaaatgctggatgcctaaggtacctccaggagcttagggaacctcgcagagcagctacaaagctggtggtgttagtgacactttcagaaccagatcgggcaggttggcatgtagaaatggggttaatggagacccaggacagtggcagattcagaataaaatacaaacaaccgaaagagttatgtgccctgtaagaagttgatctgacacccacagcagagacatctaaggtctcacagcccacatcaaacaggcttctgatctaaggacagcacaaaaggaaggaggcatcaaaccatcctggggaagacagtgcagtagtagccagaagtgtaagcccaacagcagtgggactggtgtagcagccagggacagggtccctgccaagatgagcctcaggggagctgagcagctgagaaactcaccagctgagaagctcaggggaatcagggtaagtggaggttccagagaatcaggggaagtcaagagctcagaacccaagaaggggcacctgcaaaagagctaaggcctatgagagtgtggggaacactttaagcagctttaggggagccaagacaggtagaagtgtggggacccaaacagggaagctccaggggagctaggaaaggtggaactgtgggaatccaggcagagcagcacctggggagcaaggaaagaagtgtggggatccaggcagagcaggtccaggggagccaaaaagtggaggtgtggagacacaagcagggcagcatctggggaaccaggacaggtggaagggtagggacccaggcagagcagcaccaggggagccaggacaggtggaactgtggggatccaggcagagtagcaccaggggaccaaggaaagaataagtgtggggatctaggcagaacaggtccagaggagtcaaaaagtagaagtgtggagagccaagcagggcagcatctggggagccaggacaggtggaagtgtggggatccaaccagagcagcaccaggggagccaggaaaggtggtagtgtagggtcacaggcagagtcgaaccagggaaccaaagaaagaagaagtggggggaccaggggagccaggacaggtagaagggtggggacccagacagagcagctccaggggagccaggacaggtggaagggtagggatccaggcagagcagcaccagggaagccaggacaggtggaagggtagggacccagacagagcagctccaggggagccaggacaggtggaagggtaggggcccaggcagagcagcaccagggaacgcgggacaggtagaagggtggaaacccaaacagggcagcaccaggggagcaaggaaaggttgtactgtggagatctaggcagagtaataccagggaagccaagacaggtagaagtgtggggacccagacagagcagctccaggggagccaggacaggtggaagtgtggggacaaaaatggggcggcttcagtgtgtctggggagcaaggaaaggtagaagtggagagacccaggcagagcaataccaggggctaacaaggtagaagtgtggggaccagaacagagcagcaccaggggagccaggacaggtggggatgtggggacccaggcagggcagctccaggggagccaggacaggtggaagggtagggagccagacagagcagctccaggggagccaggacaggtggaagggtggggaccaaggcagagcagctccaggggagccaggacaggtggaagtgtagggacccaggcagagcagcaccaggaaagccaggacaggtggaagggtagggatccaggcagagcagcaccaggggagccaggacaggtggaagggtagggacccagacagagcagctccaggggagccaggacaggtggaagggtaggggcccaggcagagcagcaccagggaacgcgggacaggtagaagggtggaaacccaaacagggcagcaccaggggagcaaggaaaggttgtactgtggagatctaggcagagtaatgccagggaagccaagacaggtagaagtgtggggacccagacagagcagctccaggggagctaggacaggtggaagtgtggggacaaaaatggggcggcttcagtgtgtctggggagcaaggaaaggtagaagtggagagacccaggcagagcaataccaggggctaacaaggtagaagtgtggggaccagaacagagcagcaccaggggagccaggacaggtggggatgtggggacccaggcagggcagctccaggggagccaggacaggtggaagggtagggagccagacagagcagctccaggggagccaggacaggtggaggtgtggggacccaggcagggcaccaccaatggccaacaaggtagaagtgtggggacccaggcagagcagctccatgggagccaggacaggtggaggtgtggggaccaaggcagagcagctccaggggaggcaggacaggtggaagggtggggacccaggcagagcagctccaggggagccaggacaggtggaagtgtggggacccaggcagagcagctccaggggagccaggacaggtggaagggtggggacccagacagagcagcaccaggagtgtcaggagaggtggaagttaagtagttataggggaacaggggcagaatagaatgagggatgcaggctgagaggatacaggggaaatgtggcaagtggaagggcaggaagagaggcagagtggctacagggaagttgaggcaggtaagactgtctgttccaggtcaaaaaacactgaagaccagtagaaaggaaactggtgcatgtggtagtgggggattcttagcttagcagtcacagggaaagtgagccaagtaggaatgcaggcatggggggcaggcacagctgagcaaacactaaagagctgtagctgaagggttataaggtaccaagctgagaagctgctgggaatctggagctaatggggtgtgggggagcaggctgagcaactacacaggatcagggataggtaactgtgtaaggaggcaggctgagcatctccatgacagctggagctactatgaatgttaagctccagactgagcatctgcagggaaacagaggcaagagggagtgtggggatccaggctgagtaggtccagggaagctgtagtaggtggaggtggaggcccaggctgaggagctacaggagagatgggacactagggagggcagggatcatggccaagcagatactcagtagctgagatagatgtggggaatcagcttaagcagcagacacaggggagcaggatctagtcagcttctagggatccaggctgtgtagacatggagggactgggggagctataagtaaatacactaggcataaaattacagggaaacggaggccagtgggaacgtgggcctcctactgaacaagtaacagagagccagaactgacgggttgaagaggaaccaggctgatgagctccaggaaatctgtggggactcggtcaatgggagaacagggtgagcagctatagaggatcagggataggcaaaaacgtatggagtcaggctgagcagttacatgagagctggagccctagttatgtggaggtccaggcagaggggctggagggtagctgagggaaatggtgctagagaatcaggctaggcagacacaggggagcaggttctagtctacatatgagtggggatccaggatgtgtagagaaaggatagcaaaggtcatggaggattccaggcttaggggtcactgggaaactaagactggtggaagtgggattgtcctaagtgaacaaattccatgaagctagagccagtgggtgtaaaggtagcagactgaaggactatagagtatctgggggtggatgggaatgtggggaatcgtgctgagccactacaaggacagtgtggctagcaggctgtaggagaccaagctgagtatctgaagggaaaccaagggaagtggaagtgtaggattccagaaatgagcaaatgcagggcacttgaggcaggtatcagtgtagggaacgagactgagcagttcacaggtcacccagggtaggtaagagttctggatcatcagagaagcctctggaagccctaagcacctacagtagacctaaggcaggtggggtgcagggaataagttgtgcagctcctgaggaggaggacaggttggagtagaggaggttctgactaaagagttgaatgggagcagggcaggtgggaatgtagaggaactagctagacagaagtccagatgagattgagggccacatgatgccctgagccgatgagctggccttagaaatcactctgctgggaccagggccaggggtttgaggaacaaggctgaggtgaaatggtagcatgacagggaggcaatggcagagaggaaggagaaggcatgcttaattcatggtggagtgcagggagggaaagagccaggaggtctaggctggagctgatccagctttctgcactgatgagaggggcgggactgagttcttttggctccaggagccagggcaacaagacaaaggcgcctagcatagcaaggacacatctggatctaagaccaggagaagagggcaagaccgaaagttcaggaggtcatgggagggagtgggaaatctacaagggactgtctttagaaaagagtaagtgcccagtggagggagtgcccaagcaacaagtccagtgttgggagagatcggggtgggcaaaggctgtatgtgcagtaggcaggcccaagtccccaggaaggaaagaagaagtgcataggaaaacgggtcaggtctagcaggagccaaccgaggtgctcaggactgagaggcagagcccaagacacaggaatcgctgagctcatgcaggtaccaagaataactgagagctaagagaaaaattatctagggaatagggggacatgaggaaggactgttggctgagaagggaaagggacagggagaatcctaagggttggcatagacaaaggaaacacacaggctttgggttgttagtccggggctctgcatatgatccaccgagattgtggaaacagaagagcaggaagatcaaatctgtcccaactatacagggacacacggtcaacctacaaaaggaaggagatgtgaggatcaggggctgagcagtgaggaggtgtgtggaggtgttagagctcaggtgcagcagagactagcatggccctggggatagagggaaggacccaagggacagtagggacaggagggcgaggtgaggtgatgaccagcattatacaaatggtggcgctgtccaacttctagggccctgtgctactgagaaaggaaagggacttccgaggtttggcaatacaagccccgtgcaaaggcagaacccagggcactgtgaagacaacactgcaagacaggagaagccaaggctgagttcaccgaggtcacattagtgagaatacactgcgaggagaggggaggcgctgagcacccagccacaccagacaggcccatgctgagtccctggacagtgggggaggggagcacctggtgacctgtaagaactgtgagactggaggagaaccaaggtaaaaggtgtgtcaaaggacacatgtttagcaggctgggccgacttaatgcaggacacacgtggtggcaaagccaagagggctgcgtatgagccacaagtgaatcctgacccaagaatagagagtgctaaacctacttacatcaaagccaactgaaaggacaaggccagcaaaacgaagctaaggccagagatcttggactatgaagagttcagagaacctaggatcaggaaccattagtgaacagacaaaggcaggtaaagcagcctaggagtggacaaagacaggagaatacagaagacggcagggatgacccgacttcagtttgggcttcactgttgtccaaactgtgtgcagattatggcccatgggtaagaggtttagcattagaacacagatacccacattggacaatggtgggggaacacagatacccatactgcaaggctcttcgggccctttcctaaaagtgtactaggagtgggactgggctcaaagggattaggtgtgatctggcctggtgaggctgacactgacaagcccaatggttgggtgttgcatcctccatttatacagccagggacttggggagggtacaaaatggaggacttgtaggagcttgggtccagacctgtcagacaaaatgatcacgcatactttttcttgtagctgaaacaacagccccatctgtctatccactggctcctggaactgctctcaaaagtaactccatggtgaccctgggatgcctggtcaagggctatttccctgagccagtcaccgtgacctggaactctggagccctgtccagcggtgtgcacaccttcccagctgtcctgcagtctgggctctacactctcaccagctcagtgactgtaccctccagcacctggcccagccagaccgtcacctgcaacgtagcccacccggccagcagcaccaaggtggacaagaaaattggtgagagaacaaccaggggacgaggggctcactagaggtgaggataaggcattagactgcctacaccaaccagggtgggcagacatcaccagggagggggcctcagcccgggagaccaaacattctcctttgtctcccttctggagatttctatgtcctttacacccatttattaatattctgggtaagatgcccttgcatcatgacatacagaggcagactagagtatcaacctgcaaaaggtcatacccaggaacaacctgccatgatcccacaccagaaccaacctggtgccttctaacctatagacaccaataacacacagccttctctctgcagtgcccagaaactgtggaggtgattgcaagccttgtatatgtacaggtaagttactaggccttaaattccagccccaggtccaacaaatgtcctctgaggcccatgttggaggatattggcatatttccacctttcttcttcatctacaggctcagaagtatcatctgtcttcatcttccccccaaagcccaaagatgtgctcaccatcactctgactcctaaggtcacgtgtgttgtggtagacattagccaggacgatcccgaggtccatttcagctggtttgtagatgacgtggaagtccacacagctcagactcgaccaccagaggagcagttcaacagcactttccgctcagtcagtgaactccccatcctgcaccaggactggctcaatggcaggacgttcagatgcaaggtcaccagtgcagctttcccatcccccatcgagaaaaccatctccaaacccgaaggtgggagctgcagggtgtgtggtgtagaagctgcagtaggccatagacagagcttgacttaactagacttctgccctcttactgacctccatgctgaccactctctgtatccacaggcagaacacaagttccgcatgtatacaccatgtcacctaccaaggaagagatgacccagaatgaagtcagtatcacctgcatggtaaaaggcttctatcccccagacatttatgtggagtggcagatgaacgggcagccacaggaaaactacaagaacactccacctacgatggacacagatgggagttacttcctctacagcaagctcaatgtgaagaaggaaaaatggcagcagggaaacacgttcacgtgttctgtgctgcatgaaggcctgcacaaccaccatactgagaagagtctctcccactctccgggtaaatgaccccagagtcagtggcccctcttggcctaaaggatgccaaaacctacctctaccacctttctctgtgtaaataaagcacccagctctgccttgggaccctgcaaaaatgtcctggttctttctgagatacagagtccagcgaggtcatgggctgaggggcgtccagggtttgaggcctgaggtttgactaaggaaaaagggtgatctacactgccagacacagcacttttgatttgctggcatgaacagaatttacctctcactgaaaagtggaggctttatcccgaggcaatccctcttgctttctcttcctctacctaatacatctatagtgggcacagaatatatcatgaaagtaaggacgacccaaactccacctccctagtccacctttacccctcttcctagccaaggatcccactgaaggcactcaatggacacatatggtcacagacagacccttgctattccaccactcaatgcaagaagcgttccagagactaagtctaatgtaacgatgcacatagctgtcactgctctctcactgcccatgagaatcaacatggacccattagacacaacctgatgagcaacactgagggcaaaaggcccatatgtatgcatgcacacacatcttcaaatgcacagcacagtgacacacacacacacacacacacacacacacacacacacacacactggaacctcacatgggcatcctgtgcagtactcccagatgaaaagaaaccaggtctacacacaggatcatcccaacattcacaagtgggccagctgagacagatacaacttttctctgccttggatgcccacagacatcttcatgcacacatgagtttcctggggtcaatctgtccctgaccctgggatggtgccccaacctcacacagttggcacccatccgaaactgtataacttactcacttcccactgtggatcttaactgcagtcctagcatcatggggaatcagctctgcaatccctctggccctcagttctcggtcatcagcagatacaggatcaggcagaccacacagacactacccatgagaggcacaggccctgactcagcctagccaggttcagaactcaaggctggagcacacacagaatgacctagtgtataggccaggccaccatcaggtccagggtgtctggtgagctcagggacaaaactacagcactttggggaactgaagtttctggtccagagagagatcagaaaggagagatggcctcagggagggtctgctggcccagtcaggctgtaactttctcctggaactccacacaacctcatctgacacagggaatggccctagtcacgccgtgttgggataaacaaacgctgacttccctctctgtccagggatggaagtggacgatgcctgtgctgaggcccaggacggggagctggacgggctctggacaaccatcaccatcttcatcagcctcttcctgctcagcgtgtgctacagtgcagctgtcacactcttcaaggtcagccacaccatctccacagtgtccacaccatcctcacactgttcctcatactgtctctgtgatcagctatgccccacactgtcccatgctattgacctgtcttacatgctgggcaatgccacctaaccttctctatgatacagtctcacagtgtcccatgcagtctccctaattccccaagatgtccgcactctattgctgtgttgcctcatgctgcccccacactgtccatccctccctggtatgctatcccaggctgttgtctctattttcatgctctcctcacactgtccctagtgtctcatactgccaatgttggctcccacattgtccccacactctgcacacaaccggacaataaaccctgctgtcccataatgttccctgtggtccccaactctatccctgcacatttgtctatgttccctgaattctcatgttgtttgcacactgttagtgtctaacgaactctctcccaggtgtaccttcttccatgctgtctcacctcatctcccattctgtccttgtactaaccccactctatcacgacactgtccctattcactgtccctatgaagtgcccatgctgtctgcattctgtcccatgttgtatcctcatcccggtctcatgcagttcagatctatctgacactattcccactctatgcacacatttccccctataccatccctgtctgatcaacatgcaatcctctagacacccatgtagcaggttagagactctagggatgggtacctgcctgactgagctacctctcttggtgggagaggaaacacaggtgagagtgcagtcctgatcttatcttattcaccctgtcccacaggtaaagtggatcttctcctcagtggtagggttgaagcagacgctggttcctgaatacaagaacatgattggacaagggccctaagccacctcctataatggcaaaggattccccacgccctagaggaccctgtccaatgtgccaagcagtctgactcagatcacactgtctgctcacttcactatcttctgtctatgagacccaacctccctcaattcttctctctctggaggactatgtggacattagatttccacaagccacagcctccaggacctaaaataccatcacagcagcagccaggacactagatagggtcagaaggaccatagtttcctgactagtttatccaatctgttgggacagaagaatcactgaaaaagtgacaagtgcccaagttgcctgtgttcagcttggaagggaccaaccttggaaccagtcctgtcagcatcatcttctaaaacacaagaattgagtatgtaaatggcagattttggatccccagggtaagacagacttcaaccaggccacgacctgggcaatcatggcccagctgaagttgactgaattattccagtggccttcacatcgtcttgccaggttccttcttaccacttccatgaaccctgggatacagaaaagaactgtgcttctcgggatcttgggacagaactgtctaattggtgggatccttaggtagatctttcttccagtcacgggtataatacaatacactagattctcacataaaggaaaaaattcacacacaactccggccagtcctgaggcctagacaccaccacctctctggaattctgagctctatgctggaggcacaagagaggaaggcctggacttcatggcctctgtgtagccctagtaggtgcagaggcccctaagccggggttgggtgaccagcaaggacctcctggagagggatctgatgagtagattccacctgggacagaaggaaaaagatgaaaagcaacagaggtggaagggcactggagagagccatggtatagcaggtttatcttgcagacctgacatctgtccatgactctgagacttagctaatgacagctggggcagcagtccaaggaattaccatgccccctaacaccaggctcctggagtgtggagtgggtctactccagagctccaatacctgtttctccatcacttctcagccaatgagaaatcggtttccagacaggaagaaaaatgaaggcaggaaggaaaagtgggcacctgttcttctgtgagtggcaggaagttctcaaaagactcaggactttggcttctaacttcctgtggatcattgatgtctctaaggtctctgtctgctttgttggttttgtttgtttttggtttggtttttttttttttttttttggtcaataaaacgttttttcaaacattccacaatctctgtgttcttcctatgtgaaccagccctggtacttagaaacagcactgttaagtagaccagtgagtcatgaagaacatactacctctcctggtcctgtgtcctaccagttctcctctaagggtcccttcacagctgtgtgccagctctgctatcctataccagataggtcctccgtctttcttccctatgggcagtttcttcccagccagaagctgcctttgtcctgtaggttgcccactcatggcctcccacaccagccacacaaactaagaagcaggtgtctcagtgacctcaggctcagtgataacatttctatggaaaagtgaaggaataagaaagagaagaaatactccagagtcagggaagagaaagattataagggatgtttgctttctcaagtatgtttggagaagttccagatcaggcgttgacaaggtcgggttctcagcagggctcttcttgcctggtaggtgccttctcctccttgtgacctcacaggctttccctctgtgtgtgtctctgtcttgatctcttctcataagtacacagtcaggctagaagaggtacaccctagccctaattataacttatcagtttatgaccctgtctgcaaacataggtcatggtggcttaaatgtcatttgctgaatcttctggggacagaatttagtccacatcagctctccctatggaccccaaaagttcatatccttcccacatataatgtccctcaccccatacaaacaccccaaagtctcacccttccaccatcagctctgtctcaattctcctccaagactgctagttaggtaagtgtgagatgtgggtgtgactcattcaggatcaagttcaagccatgactgtcaggaaagaggtttaggccgtcagcgcagagcagattccaggaccatctgagcagttgctgaggttcaaaggcagattatagactgattccttgctatagagaagatagcccattgtgatcctctcatactagttcagtgataacaattctatggaaagtgaaataataagaaagagaagaaatactcgagtcagggaagaaaaagaacctgcaggggctgccaattgtctcttgttctgctgggcgtgtctgtgccctactagagttggattctgtcttcccatggagacaaggagacaccggctccatggcctgagatagcaccgtagaggggcccagaatttgcttctggaatgtaggagtgttagcaccaatggagagctaaggtacacaaaggcctcctaagcaaagacccaaaaacaggagctaggtgctaagtgtgcagttgagttctcagatggtgtttagatgtcctcaggtatatccttgactgttagagactgttcaagccattatgacctctagtgatggctatatgagggaaatcaactgggctggactggtcaagagaagatcctgtcaccacagctacagtggtgaggggctgggtggggggcagaatccaaactggccaatgccattacagtttctggtatagggaaagacatgcttttcctcggacagagaagcagcagatccctgtgagtggtattgctgctggggaagccatagggagatggacctcggagggatttgttgctcatgtgcagacagctgcaaggagcctgggctttggccaagcacactgggcagccgctacaatgctacacactttgggagttaggacagtggaacctagactacaaagaggacagctgcactaaccctgagaaaagttacttaattcttcacaaacctctgtttaatgtgtgaccaaacatccctccctgcaaagcgagggaagaagaacatagaatagtgaatttaaagaacatttaggcctgggacagtttccttgctcagataagaggaaatgtttgttttatctcatagttcaagtgtacagtctgtcacagcaagagtcttagtttcatttctgttgcaatgataaagtaccctgaaaatagcaactttattcagcctgctgtttaaggttacagtctatcaccgtgaaaagtgagagcaggaacttgaggcagccagtcattcacacaatcaggaacagagagaggggtgtgcacgtgcccactacccagtgacacgtgacgttagaaaggaaatttggtggggataaaagaggaaatggaggagagggagtagggacggattttatatattacatgtattatgaaattccctaacaataaagagagctacaaacggctcattaggagaaggtacaatgtgtgaagctcttcagtgggttatgaagtagggatggtgaagcccaggtgcactgaaaatgaatttaccccagaagccgcccttcatatgtgcaccatgacatgtgcacgcacacacatgtacacaattatacatagacacattcaacataaacacaacatacatgtacatacaccacaacaccacacacacacacacacacacacacacacgaaacacatacataaacacacacaatcattcatggacacactcaacataaatacaacacaccacatgccctcatacataccacacatacacacacacatgcacacacacacacacaaaacacatcaatacatgcaccaccacacacataccacacacacaccttcatatacaccactcagcacacacagagacacaaaaaaaatacatatttacacaccacacacacatacataaacacacacaatcatgcatggacacactcaacataaatacaacacaccacatacactcatacataccacacacacacacacacacatacaaaacacataaatacatgcaccaccacacacacataccccccaacacacacacacacacacacacacacacacacactagaacacactaatataataatgtttaaggactgcatcatttttctatctttctgcaggcacttgtctgaggtgctgaatgttttcatgctcccatccttgccaaacagcactttatgaggagttataaccatgccacagcctcagtgtggtgctgacttaaaagttcctccaccaaataaactattccattccttccgaaaatagccagatactttcccagaatgtaatacaggtcatcaggtcttgatgagatcttgtctccccaccctgaaacctcatgagctggatccttgctgtccttaccccctttttaatgttccctgcactgggctttctcgtcccacagcatccatgtaagttatcctgaaagatgccacatcctttcctctgctgacaaatctgtccaccttactgtttaagttcctagagtaggtatattctgagaaagtacttatttatatccagagaatatatacatttcacatagttccttttgttctggttattgatgtcattgggtcctgaagttgtgtttggaccttacaatgacaaaaacccatctttccctttcttttaccaccaattctatctcatctatctccctgtttctctctgtccatatctctgtctttttctctgtgtgtgtgtttctgtgtgtgtgtttgtgtttctctctctctctctctctctctctctctctctctctctctctctctctgtgtgtgtgtgtgtgagagagagagagggggggggggagacatgtgtgtaggtgcgagtgaaggtcagaaaaggcatctgatccctgaaacgagaattacaggaggttgagaaccacctgaccagttacagagaaccaaaatcagggtcctgtacaagagcaatatgctctcttaactgccccgacatctctccagcaccccagctttcttctgaggtcttgtatgtcatacataatgaactcagatagggcacacccagtgtagctcagcgtagccagtacagccacagctagagatttgaagaactgggccatccttccagctgggcactgtggcctggtttctgctcaattagagcttcaatcctcaagatgaaggaatcgagtctgctgggccatggagcaggcctgagtgcttgctctctgtgggcaagcatgtgtcctgtttgttaccacagctagaaacagatgcttctgctgagaagctgcctgcgaggaggctgttgatgcagagtcgtgaagcgtggcgaccgcggcaacccacatgacaaggctgacttacagactgtggcttcagtgctggggcaaacaacaaccaagaggtcctacagacactccagagccacaaggtcaccacatgtctggagcagatggatttcagtcaacacttctaccacccaagaagcttttgtggtgctgggtatagatgaactcaagtagcaaggttcgggctgtgcttgggaatcccggcaacagaagggtttgctggagtggtaccacaagcattgctgtagtgcaatttccatcttctatgtggagaaaagcccaagtacagactgtcaggacaaaaccaggcagcttccatccccaaaactgcccatgagtctccagccttggtaccctatggcctccgaaaccgcccaggggtgtgtgtatgtggtctctaatgaaaaacatcaagccaaaaatccagaaaggaatctgggcacaacctcccagtggccacaatccttccaggaagattttcttcagtaggctgaggtaaacagtcttacggaaagtgccatccagtatctccagtggtctggaagaccctgagaaacacttgctgaccaacatggtcatttgtctactcattactgcaggcgtttgttttttaagtgtgcatccgcctgcgcgtgcccgtgagcctgagcgtacgcgtgtgcgtgcgtgaggtgcggtgcggtgcggtgcggtgcgtgcatgcgttgcttgcgtgcgtgtgggcgggcgtgcaggcgtgcgtgcatgtgagagagagaacacatgccgcaggacacaaagaaaccagaggacttgcaaaagtcagttctctcaacaggtcagtcctagatacggatcttcggcagccttacccgctgagccaccacactggcccattctttcagtcatttctccatccatctggctctcctgaggtgagaaaccttggccctccaatccttgcagtcagcattggaagcagattgacagtgatgggcacataggagagggagcagtgccagatgacagggcaccgggagacattgcccatatcttacaaagggtgaagatccaaggactggtttgggagccttaggggatcagccagggcctctggtgtagcagagacccagcactcctggtcaactgtacctacagaggtttaatcatttctctttggtaggctgctatgaccaatggatgctttgaaaggtctgtactgacctgtggggctcacgcagaactgggcctagcaggtggggtttgaagtttggcagcctccgtgggaaggatgtgaggaggtagacaatgctctggagagactggagccctgaaaggggggcactggatgtttgctgctcagattgggggtgatggccactcctgggtcacaaagaaaggcagggacttctcatgggatcactcaggaaagagatctggagaacctggaaagagagattatcaggaaagtactccaaagccctctgggagcttttgctgagtctctaggttggtaccctaaagcttgccagggccacaaacctctcttggtgggattaagctgctgcaagggtcccagattttttttctttcacatttgagttgttacttatgggtggcacataaaattactcttgttttcccatcaacgtcgtagggtaggaacccaagatcggagaactgatttcttccatatagtcccaaattcacacccaagtgacttgcttcctctcttagctcctcccccaccatcaccacctcccagtaacactgtcatgctctggatccatcaccaagggcttgacccgatggttagttcagagcactcacgatctcacagtctctggaaagtcctgcatagacagaagtcccatcacttaatccactcgaggggacaagcaaatgaaccgtctcatcggaggatgaagaatcttactaccgggtcccgacatcagcttccatcctgctgccttgtcccaggaatgtcagacttaacacccacgtttccaacccaactgcatggctagtcccttaaaactcttcattccctccccagtctctctgcatctgtgtccatatctgtctaaagaaccatccttccgcaattggagctgtggccataaattttgcgtgtgtcatttatcggttgtttatgtcaaccatctcccttctctgttcctgttgtctgcctatcacctccatcctcatcaccctctgtccctatcatatatatatatatgtatatatatgtaaatatatatatacagttgatatgcaggaaatatatattcagtttatatgcaggatatatatatgcagttgatattgatatgcaagatatatatacagttgataggtaggatatatatgtgtatatgtatatattgtatatatatacagttaatatgcagaatatatatacagtttatatgcagaatatatatgcagattttaagtggactagcaagccccgagccctcaagaaccgctaggatccctgcccagtcatgttactgtcattggaagtcatcttctgtttccactccaccaccacagaaaagatccacttcatctgttgggcagggtggttgaggagaaccaagaccagggccctttaattctgtggaggaaccaaagacagctcctgctacataggagcctgtccggtggtatggggaccagggagaagttagaggtgtggaatacagggatagaatggtgtacaacgagggatcatggtgtaagggagggtactgtgaggacagtgtgtgaacagagtgtagacagtgagaagaacttggaggacagcatccgcagcatgggagagcaaaggaaggtgtgacgacattatgaagatattgtgggaactgcacgtgagtgtgaaagacagcatggggtagcaagggaggagctgtgggacactaagtgtataggagggaagtagcatgagacgctctagagcagttgttctcgaccttcccagagctgtatcctttaatacagttctcatgttgcggtgacccccagccataaaattatttcattgctactttgtaactgtaagtttgctaccgctatggagtatattggaaatacttgttggtatgcaggatatctgatattcagagtggctacccatggcataagaaccactgtgctaagtgggtagaagggccaccatggaaatagcatggggacactagaaagacagcatgatgagagtattgtgatagcattgggatggtgtggggtcttgtgaggatagggtggggacagaagagtagacagcataggtcgtcacagggacagtataggaacagtgtgaggacagtgtggacactgtggagatgttgtggctgaccttgaagagtgtgacagctgcactgtagtacacactgagcaggaagaggctgatgtagatgatgatggccgtccagaccccgtccagctccctgtcctgggagtcagcacaggtcttgtccagttccagccctggacaaagagggtagtcagtctctgtcccaacaaggctgggacaattccctctatggcaggtgcatcagcaatgaggtacccactggactgggccagtagattgtttctggggccagccttctgccctctccagaccagcagactacactctcccaactgctccaacccaagtcccggactcagccagacacaagatggcaatctggactgtgtaagaacccttcccacctgctccactcctcagatttggggctgtctgggctgaatcagagcctgtgaccactgaccctctgcctatgaccaagcccagaaagccagtgtaatggtggaccccaggcctagtgatgcctggccttcagagttccacactgggaagtgaattgggccactcagctatgtgggaaggggactgtcatctctatgggatgaaagcatgggtctgaaggtccagaagcagaatggcatgagagagtgtgtattgtgggacaagttgcctttggaatcctttggcagtgctatctgtctcagctgagccagatgtgaggaagagcctcagagaaggcctggtgccttgatgggtctgagttctgtactgggagctcctatgaggtctcggagtgtaaggcttgtgtctgtgctcatgcacaccagtgtacaagtctgtgtaaatgtcatgtgggttgaccgatggtcatcagactgctaggcactggagtcatctgatggctctgaattctgcattctgtgtcttcaagataagagacataggtatctagcccagaaaactagtctcaaggaggagagagggtcatggcaaaggtagacagacagaaattccagtgctttgacctgagatcctctccctgggcacaactgttcatcctggttgatctagagaagaaaatgacataagcctgacctccaatgggccatacctctgctgagcatcctctcatcagttttcctgtccatcttggtactgctgaccagatgggtcacacacaggtaatagcctggctcgtccagaagctgccaggcatgatcactgagctcctgaaggaagacagcttgaactataagacagatgtcgagtttcacataccagtgaacaaagctccagacttccaagacatgattgctggctcagggaagtagcccttgaccaaacaacccatgttgccatgggaaccaggaaagagatggacagggccatggctcttgctgcaaaggggggaagagatgtgaacatactgtccagcctggagaagtctttttctccatgcagccctgggtcttctaagatgggatctgctcctactcttcacgaacctagccagtttctgttttctctgaccccagcccctactcttagtctcaggaccttgcttttcacccccatccttacactgtaccccagccctgccagcatcgaatctggtcccaatgggttctttccttccaatctatagggttaactcccctgagcattcccactctcccctgttcctgtgaggccccaggatcagaattgtggaccacaaccccagaaataaaacccatggaatcccagcccccagagaccctccctgtgcacggcctccctcagtttagcaaagagttacttctggacccctgcctagcttctctctgcagccatatgacccactgcttataaacacagccagaagcgccagttccctttctcctctccacctggcttcactctgcactctgtactctcactccagacttcactttcctcctggagccacagacacttctgggctctagagagattgcatcagctggagagggaatggcagaggctgccaagtaggctggttagaggtcagacctgagagaaggtcttctccaaaaaggtggtcaggagaatggacataatcactcagccccaagcaatccaggaacactgggtgacagctagtctctacatcttcttctaagggtctcaagaggaccacttcacctacccctacaggaggtaacccagaccatgtctggactccccctggtctccccctaccccaaacactgaaaccaacagaagaaagaggaacctcaggaagtgtcccgtgtcacccagtttcgatcctgttcttagtctgtactgggttgggagaagtgtgatgttcacacctctggggcaaggactgtgaatcctggaaggatgagacagatctcagagctgggctgttagcagcccagcaccaatgcaaaaagagcagcagtcacaaggttccacacgtgaatgtagtcagcagagaagctggagaaagccacagcctagggagagcagtgagcttttccagacctaatagacggcagaacacaggaggatgaggagttgacagatcagccccaacagaggggcctgtctgttgcaaagaaaaggtgcctacctgcaacctggtgccaaccaggcagacaccagactttccacggacagaagccaagaccactaaagccgtgcccacctacagacaaccagagtaagcctcaaggagttaatgggatagacccggaaacctgagggtctagccaggcctagaggccggtggacccaggacagctgaaccaacagagaaaagaaaacccagtggagcaagggcagaggcatacagaattgagagagttggtaaagaggggatggggaacgttcacctgggaggactgatacacctattagaaagagctagagtcagagtggatgcccttgtgactcccggcattggatagcagatcccaagaacaaagctgaaagaaggtaaatttctcaagagaaagtcttccagaggaactatgggtaccaggcaataagtagtacatccgtaggagggaaccagacagtagtacatctgtaggaggggaccaggcagtacagctgcaggtagggaccaggcagtatatctgtaggagaggaccaggcagtatatctgtaggaggggaccaggcagtagtatacctgtaggaggggaccaggcagtatatctgtaggagaggaccaggcagtagtatatctgtaggagaggaccaggcagtatatctgtaggagaggaccaggcagtagtatatctgtaggaggggacaaggcagtacagctgcaggtaagctaaggacagtaagagtagtagagagccatgatgactccaaaagctcagaagacctggcagagcagctacagggaatccggggctggtggagttgggaggaccaagccaaagagctataggtaagccgaggctggtgaaggcacaaaaacaagctaaggagctacagagggggcaagggctgtggcaggtgtggctaagagaggtccagggcacccccaggaaccagaaagagctttacaggagttctagaggaggaaggagttggggagacaggctgggcatctgtaaagataaggtagcagttgtcacagtttgggtctcagagctgcccaggggattaggggaaaattctgagaagctgtgggagagtaggggatggtaggaatgtggaggaccagtcctagcagctgtggggaagctggggatggtaggaatgtgggggatcagtcctagcagttttggggggagctggggatggtaggaatgtgggggaccagacctagcaattttggggggagctggggatggtaggaatgttggggaccagtcctagcagctatgggaaagctggggatggtaggaatgtgggggaccagtcctagcagctatggggggagctgggatggtaggaatgtgggggaccagacctagcagtttttgagagctgggaatggtagcaatgtggggtccagtcctagcagctatggagtagctgtagatggtaggaatgtgggggaccagtcctagcagctgtggggaagctggggatggtaggaatgtgggggacaagacctagcagctatgggtgagctgtagatggtagaaatgtgggggaccagtcctagcagctgtggggaagctggggaatggtagaaatgtgtgggattgttcctagcagctatgggggagctggggatggtaggaatgtggaggaccagtcccagcagctatgtggggggctgtggatggtaggagtatgggggaccagtcctagcagctatgggagagctggggatggtaggaatgtgggggaccagtcctagcagctatgggagagctggggatggtaggaatgtgggggaccagtcctagcagctatgggagagctggggatggtaggaatgtgggggaccagtcctagcagctatgggagagctggggatggtaggaatgtgggggaccagtcctagcagctatgggagagctggggatggtaggaatgtggaggaccagtcctcacagctgtggggaagctggggatggtaggaatgtggaggatcagtcctagcagctatgggtgagctggggatggtaggaatgtgggggaccagtcctagcagctatgggagagctagggatggtaggaatgtggaggaccagtcctagcagctatgggagagctggggatggtaggaatgtgagggaccagtcctagcagctatgggagagctgggaatggtaggaatgtgggggaccagtcctagcagctatgggagagctggggatggtaggaatgtgggaggcctgtcctagcagctatgggagagttgaggatagtaggaatgtgggggaccagacctagcagctatgggagagctggggatggtagtagtatgggggaccagtcctagcagctatgggagagctgggaatggtaggagtgtggaggaccagtcctctcagctgtggggaagctggggatggtaggaatgtggggggcctgttctagcagctatgggagagctgggaatggtaggaatgtgggggaccagtcctagcagctatgggagagctggggatggtaggaatgtggaggaccagtcctctcagctgtggggaagctggggatggtaggaatgtgggaggcctgtcctagcagctatgggagagttgaggatagtaggaatgtgggggaccagacctagcagctgtgggggagctgggaatggtaggaatgtgggggaccagtcctagcagctatgggagagctgggaatggtaggaatgtgggggaccagtcctagcagctatgggagagctggggatggtaggaatgtgggggaccagtcctcccagctgtggggaagctggggatggtaggaatgtggaggaccagtcctctcagctgtggggaagctggggatggtaggaatgtgggaggcctgtcctagcagctatgggagagttgaggatagtaggaatgtgggggaccagacctagcagctgtgggggagctgggaatggtaggaatgtgggggaccagtcctagcagctatgggagagctgggaatggtaggaatgtgggggaccagtcctagcagctatgggagagctggggatggtaggaatgtgggggaccagtcctcacagctgtggggaagctggggatggtaggaatgtggaggaccagtcctagcagctatgggtgagctggggatggtaggaatgtgggggaccagtcctagcagctatgggagagctagggatggtaggaatgtgggggaccagtcctaggagctatgggagagctggggatggtaggaatgtgggggaccagtcctagcagctatgggagagctggtaatggtaggaatgtgggggaccagtcctagcagctatgggagagctggggatgataggaatgtgggggacctgtcctagcagctatgggagagctggggatggtaggaatgtgggggaccagtcctagcagctatgggagagctggggatggtgggaatgtgggggaccagtcctagcagctgtgggggagctggggatgataggaatatgggggacctgtcctagcagctatgggagagctggggatggtaggaatgtggaagaccagtcctcacagctgtggggaagctggggatggtaggaatgtggaggatcagtcctagcagctatgggtgagctggggatggtaggaatgtgggggaccagtcctagcagctatgggagagctagggatggtaggaatgtggaggaccagtcctagcagctatgggagagctggggatggtgggaatgtgggggaccagtcctagcagctgtgggggagctggggatgataggaatatgggggacctgtcctagcagctatgggagagctggggatggtaggaatgtggaggaccagtcctcacagctgtggggaagctggggatggtaggaatgtggaggatcagtcctagcagctatgggtgagctggggatggtaggaatgtgggggaccagtcctagcagctatgggagagctagggatggtaggaatgtggaggaccagtcctagcagctatgggagagctggggatggtaggaatgtgagggaccagtcctagcagctatgggagagctgggaatggtaggaatgtgggggaccagtcctagcagctatgggagagctggggatggtaggaatgtgggaggcctgtcctagcagctatgggagagttgaggatagtaggaatgtgggggaccagacctagcagctatgggagagctggggatggtagtagtatgggggaccagtcctagcagctatgggagagctgggaatggtaggaacgtggaggaccagtcctaggagctatgggagagctggggatggtaggaatgtgggggaccagtcctagcagctatgggagagctggtaatggtaggaatgtgggggaccagtcctagcagctatgggagagctggggatggtgggaatgtgggggaccagtcctagcagctgtgggggagctggggatgataggaatgtgggggacctgtcctagcagctaagggagagctggggatggtgggaatgtgggggaccagtcctcgcagctgtggggagctggggcaggtgggaatgtgagaaaacaatccttgagctatggaggagctggggatggcaaggatgaaaaggggcaaatcctagcagctagagggaagctggggcaggtgagggcgggtgtaaggaaccagacctagaaactatgggggaagtggagcaggtaaaaatgtgataaaccagttatgcagtccagaggctggtaggagtgtaagggagcagacatagtggctatggggaactgggatatatgggagtgtaagggaccagattcagtagctatggtggaacttgggagtgtagatgagcacgctgaaaagctatggtgcaactgcaacaggttgtcagggtgtaaagaaccagacccagcagccatgggaaacctggggaaagtagcgatgtgggggaccagatttggcacctataagggagctggggcatgtggacatatgaggggccagaagcagcagttatagggaaactttgaaatataggcaagtgtaccaagaagccgtagtggagctgaaacagatcctaggtcctatggaggagctgaagaaggtgggagtgtgagggaccaggccgagcatctgtggaagggctgaggcagggctctgggtcggatgggagtggcaccccagagaagccctagaagctctggcgatggagctgagcagttacagtggacttggggctggtgggatcgtaggagaccatgtagctgcagaagagctggagaaaacaggagtatgaaagacccagccaagtagccactgaagagctggggtgttattggggtgtgtggggacacagtcccagcaggtttatagaggttggagccttggcagtatgtgcagtaccaaacccagcagcttggttcaggggcttgagtagaggcaggctaatggggtccacggtaaccctaggcacttaggggactggattgcgaatcttcaggggagctggaacaggcaaagttaaaaggaatcaagcacctggaagaaagcaaggaaagataggattgatggggatccaagaaactcccaggaagtaaccccagcagggacatctgggagctcagttcagacactgaatcaaaagcacagaggaaggagaggtggtaggtttccaagctatcctgtccaggccaatggagcagccaggaaggagggaaggagaccaacaggaatggggcagctgtagccagcagggtgtgagagacagggatgaggctaggtggctagcaagaagggcaacttagtgggagaggggtgaattaaccaccctgacctcatgctgacaggggctgagcaacagacaaaagaataagaaagccaagagctcatggctggaactattctggctgtctgctctgactgtgttgaaggggctaagcacctgttagctaatgaggctaaaacagttaaatgagcaaagtagagcaaaaagctcccacagcggagagcatgggagaacgggagactgtgagatcctcggggggtctaggagtttatctcagagtgaagaacagtgaaaagctctgcttgggagttctttggggaatggcgatcatcctgggaactcccttatagacctcatggcatggaggagagcaggagctcaggcagacagagtagctgtgtgtgagctggataagaaagaaaagagacaacagggagagaagagaaaagggatgggaaaggactcagggctctactgaattcaggcagaagagcttggcttcaggatgctgggggccaaggaaggtgtctgattgagcaggaacatagtcaggaaaagaccctggtgctcacattcccagacaaatcttacaggttaaagttctagtatcagaacccctcgctcagatcctaggggcttatgggaacataaggcaggaagtgaaacctcttaggacagcacgaagtagcctgtgttggcccacagaagaagagcaaggtaactctcagagtttgagcaggggattgaggaaggtagtgtacaggagaggcagaaagaccagaaaggtccccagagtaagaatgaatcaagaatttatgtgtggtttggttcgatgaaggcaaaggcagggaagatagatgagaaactgatcctctttcacaaccaagaactcattgttcagtgtgagttttgatatatagaaggggggggaatgtgctattaaaagtaaaaaagaatgaaccagattcaaaagggaaaggggactaaatgtcttcctgaataatgcagcatacattcctatttcaagagctaccggcaagagaaagggacacttctgggatgtgcccagtaacattagcactgtcagagagaacccagggcagtgcgaagggtgaggtgggggaggaaggtgtctgcactcatcagcgtctcatcagggggcactgagctgtgtagaacaagagtggccagctaggtcaagacagaaaggatgcccacacacagaaggtgtagggtagagggttggtagtaatccccaggaagcagggagcaaggtccaaggagagctaaagtcacggatagagacctagggcacagatttaggagccagagtttgtgtaatgttagtagattcagtaggggcttctgaagggcctcatcactgaaagatcaaggctcctagggctggagagttggctcagtggttgctgctcttccagaggacccaagtccagttcccaacaaccacatggcatcttacaactatctgtaagaaactccagtttctcgagattcaataccctcttctaacagcacaggcatcaggcacacacatagtacacatagtcatacatctaaaataaaatacctaaaaaaaaattaaggtcagagtgcagggtctagaagtggaagctgctgacaccacttaccccagagcaacttgagaagacacagtctttttagagcaaagctaaggccagagcctctccaaatatctgaggccacgcatgttggaaaagctcacactccctcctctcttgcagcccaaacaacagccccatctgtctatccactggctcctggatgtggtgatacaaccagctccacggtgactctgggatgcctggtcaagggctatttccctgagccagtcaccgtgacctggaactctggagccctgtccagcgatgtgcacacctttccagctgtcctgcagtctgggctctacactctcaccagctcagtgacctccagcacctggcccagccagaccgtcacctgcaacgtagcccacccggccagcagcaccaaggtggacaagaaagttggtgagaggacaaccaggggacgaggggctcactagacgtgaggataaggcattagattgcctacaccaaccagggtgggcagacatcaccagggagggggcctcagcccgggagacactgtctctgcctccctcctggaggcctcctggaggcctctgcctatggccacccaccccctaagacatgatcctctggtatagatgtctgtgtcatgcataggatcataccagggacaaactttcctctctggtttggtgccttctctccttgaaaacccagtaacatccagtcttctctctacagagcgcagaaatggcggcattggacacaaatgccctacatgccctacatgtcacaaatgcccaggtaagtcactagacctggaccccagctccacaatgatggcaagagctgtaagcatcccagcactgcaggataagccacgtactgacccatttctatctctcctcatcagttcctgaactcttgggtggaccatctgtcttcatcttcccgccaaagcccaaggacatcctcttgatctcccagaacgccaaggtcacgtgtgtggtggtggatgtgagcgaggaggagccggacgtccagttcagctggtttgtgaacaacgtagaagtacacacagctcagacacaaccccgtgaggagcagtacaacagcaccttcagagtggtcagtgccctccccatccagcaccaggactggatgagcggcaaggagttcaaatgcaaggtcaacaacaaagccctcccaagccccatcgagaaaaccatctcaaaacccaaaggtgagagctgcaggccgactgcctggggactgggataggtataagaatgaatgcccgtgtggacggccatgacctctgtgtctgtttctatccccacagggctagtcagaaaaccacaggtatacgtcatgggtccaccgacagagcagttgactgagcaaacggtcagtttgacctgcttgacctcaggcttcctccctaacgacatcggtgtggagtggaccagcaacgggcatatagaaaagaactacaagaacaccgagccagtgatggactctgacggttctttcttcatgtacagcaagctcaatgtggaaaggagcaggtgggatagcagagcgcccttcgtctgctccgtggtccacgagggtctgcacaatcaccacgtggagaagagcatctcccggcctccgggtaaatgagcacggcacccagaaagctctcaggtcctaagggacactgacacccatctccacccttcccttgtgtaaataaagcacccagcactgccctgggaccctgcaaaactgtcctggttctttccggggtatagagcctaggtcacgggctttaaggtctggctggggtttaaggccagagttgtcttcaggaagagagtgaggtttccacactgccagactcagagctcatgagtcatcagggcctggagtgttggggcttagctttaggaagtgcctattccttgacttcaaactaaccagcagctgccagacggagagatacacctaggaaacctccaagggaagaaacacacaaactccaccaccctctgcctgttcctatccccatgtcccactcctctgcctatgggtttctctgagtctattgcacacatggccatgggcgtgccagagacccttgctatccctacactcaactaaacccaggcagcttttcatgggctaggtctgcacacccatacagactgcccactcatgcctgtgccacgtgagactgaggcagatggctcttgccgcccaaagggagggtctgttagccacatgcatactgaatcctgacccattcaaatcagcctgccgaacatcatccagtccgtatagcacatgtatccacgtgcacatgtgcacacacatttaacacaccaggactccgcctgtgtgccctgcacagcacctacacccagcagtgtatcaggatacccacaaccaccacttgagtgcccacgtttctgccatcacaaccagacacacctttccccttctaaggtcactgcattctaggctcagcacaagtcctctgaagccagatccgtctctggtacctcagggtcacgcttcaaccccacatgaattatacaacccagagccataatggtctgagtcacttcacactctggaattttctcaagttcaggcaagaccaggcacaggctccgctggtgattgagggacaggtaaagggtcagaccagctgtatagccactgtccactggggtcacaggccctgctgacccttcaccttctcctgtactgcaaacagagagggcccttgcacaatccaggccgccatgaggtccactgtgtctggcaaaccccaaggccttatccaactcagccggagggaacttagactgatgtcccagagggaaaagaaaggaaagtagggagtagaaagtctcccagggagactctgctggcccagcccaaatggagctttctcctctgccacatggggaattgctcccagccccccactttattgggacaaattctgactgccctctctgtccagggctagaagtggatgatgattgtgctgaggctcaggacggggagctggacgggctctggacgaccatcaccatcttcatcagcctcttcctgctcagtgtgtgctacagtgcctccatcacactcttcaaggtcagccacaccatcccccaccatctgctgtgatgcctgtgtcaaccctgcgatgtcctcacactcctctcctgacgtagtaggatgttcccttgctgtccccactctgccccacacaccattcccaccgttccctgagccgtcccacattgctctgtgtggctacccatggcgtccatactgtctgacattctatctctcttgctgtcctatgtgatctccatactgtcttacgaaacctccttgcatgccacactacccttcatgacgtccctgctatctaccatgctacccctctgggtgtccccatcagcctcaccatgtattctttgagctatcctcataccatctcaacctcaactcccacgatgtctccacaccggctcctagtctatgtcaccctgaccccttgccatccccagtctcctgcctgtatgaaaggaactgcaggagggacgggcctctgtcttgcccacagggctgaagggcctaagcatgggtgtgttctctgacttactcccacctccccacaggtaaagtggatcttctcctcagtggtggagctgaagcagacaatctcccctgactacagaaacatgattggtcaaggagcctaggccacttcctctgggatgagcttcctgggccccgcacaaccccatccatcctactgtgcagcctaatgtggaggccacactgccgtctgacagtgccaccctctagccctgtgactctgatccagaactctagactgtcttccttttggaggatcatgtggacaatgagctataccccagacccaaacagcacctccacagcagttgccaggaaactaactggttgggaccagaagaaccatctctaggatgtttgcctcagaggagctgggagtccacggtgcctgagtcgagctccatgggaatcagccgtgtctgaaatgggtcttcccagaaagagcaatgttttcagatccttgaaaggaaacatctgctaggaagaccatggtcgccacagccccaaagagtcacttcactctggtagcctttgaaccagttatatctggacaccttctttcccggtacttctgtgaaccctgggctgagtaaggggtttatgtttctcaaactgttgggatgagcctccccgagatgaagctccttgtgcagtcttctcttcccgaaacccactcaacatgctggactcttgggttcaggatccgatccgaagacaccattgacgacgcaacctcaagacaaggccactgtcacctccatagagactccatccacactctgcagggacaggaggactgctttgtgtaacctccgcaaagccctagcagggacaagtgcacagaccactgagtattggtgaggtgaccaggcaggaaaacctccaggagagggccctgatgagaagattcatattgggctcaaaaaatgggatggggggaggggggcgggtgggaaagaacagtgggcagggtgtgaacagatgattagaagacagtcacagtgccgcagatctgccctgcaggcctgctttccagactggaccacttacagcagaaaacaacagttacagtaagcatctaggagagtggacctggaataccagggctgctgtggccagtggagagtagccctgcatctacttctccattacctctcatggccaataagaagccagagcatccaggcagaaagaaagagtgtgcgtttctgtgactggtaggaaatgcttagagaacttggatctttaaaacagcttttttctagactgtgaatgtctttaagcactctctttcctctccattccctccctctctctttctctctctctctctctctctctctctctctctctctctctctctctctctgtgtgtgtgtgtgtgtgtgtgtgtgtgtgtgtgtgtgtgtgtgcactcacacacactgttgttttggcattttaaacaataaaacattcttttaacattttgtatctcatggtgtcccttcttaatggattagccctaacaccaaggaacagggcacagttaacagatcaattagccatgcacatccctcctgaccctgtcctcccagggttccctcagtgggtccctcatggctgggttccagccctaccagagccacaaaaagcttgggcatattcctccacacacacagcttttttccccagctggagactgctctgctgccatgggcaggctgtggagcagggctgatgcccagggtagaccctaggctagccagacaaaggtcccatgacagcagagaagcatgtgcctctcactggccttgggctgctacagagtcagcaaaggacatggatccagctacctccacagctggtgctcattgtctcaagccatgtccagagaagttccagatcaggcattgacagggtggagagctctctccttggttggtaggtgtcttctcctccatgtgacctcagagccccccccctttctgtgtgtgtgtgtgtatgtgtgtgtgtgcgcgcgcgcgcgcgcgcgtcctagcctcttctcataagtgcacagtcaggccggaagaggtgcatcctagccctaatcataacttaccagtttatgatcctgtctgcaaacataggcatagtctgaggtcctggtgatttaaatgtcaattggtgagtcttctggggcttcctacatacaatgccccttccccatgccaacatcccaaagtctcacccatccagcattcagctctatcccaagtcacctccaaaggcctgctagtcaagtaaggatcagatcgtgtggggttcgtcctgagataggattcagccatggtttccaggaggaaggggcaggagagaggcacaggggagagacgtataccgtgatgaactggacagactgataatgtgctgtccagaagaaagctgagggcaaacaggggcccctcccacttacactgaggtgacagttcctaagggagagtgagggatttgtagagagaagtggaggttccacagagttggagaagcaaaagattactagaggtagcctggtgtttgcaatgtctgttttctgttatggttgacatcaggattccatgctactctgtagatcaagggatacaggttccacatctttgtgtggcactgtggtggaggggcttgggcccagatactcccgggacatggaaaatacagacatcggcaggggaagaaatgggatgattcacaaccaaaggcctcctcatccgatgcttactgatctccgagagcaggagtcgggtgctggctgggcagttatcatctcccagtatttcccaggtggcatttagtagctgagacatcttcagattgtggccttggctgttagacactctatctgtttgggtctgtgtaggtgatggtggaggctgaatgaaggactggacaagggacaaaaggatcaggtcaacaaagctgcagcagagacaggagccaacctgaccaacaccactgtggcttccatgggacagttctgttttagccaggacagaagggaacagagctgcgtgaatggcattactcctatgggagtcacacagacaggctaatcacccagacaacaccaactggccagtgagaccagtgagatcctgcccacgcttcctcttaggtctggctctgtttctctagttgtcttccctggagcaaatgttgggaattgagcccatatcctctgcaagaccagtaaatgttaactactgaggcatttctccagccctgcctcaacctcttactggaagatggtcccaaaccaaaactgacggcatggtctcagaaagtacagattcgccacctccaaacccttctctcatgtctgtctgtctgtctgtctgtctgtatgtatgtatgtatgtatggccctgcaccatcacccaccacctcctggtgtcctgcagcaggggcttcccacagcaggacgtaccatagctcccaccccttacacctccatcagcactataaacatatagacacaagtgccataaccctggacacaccttctgaccccgcccccatctctgagaccaactgatctcaggctgtgttttactgaatgtgtccattcggtaaaagctatctgagtcctgccctcctgacctctatagtgtgacatccatggtgtgtgtcctgtgtcataacacgtaggtatgtcataccgtgtgttaccacatatgatatgtgtgtgaaacatccccacatgatgcctgtggtggacatgtatatatatatcttttatgacttctataggggacatcaattgcagaatacctgtgctagccagtagccatgactgaccagacagctactgacacttgacccacttgcattctgtcacagtctgggaatcataacatgacacaaacgccgattgtagcaccaggtcatgggcctgcatgagacttgacatgtgtacacacatgacatgtgtacacacaaaccacacgaaaaagtgtctcggaaaacacacacagacacatccacatgagcatcatagtgtggtcacagacatgtccacatgggcatcacagtgtggtatcatgtagtagccacagcatacatgacacagtcacacaagttcttacaagaacatacatgtctgccagttcccagaactcctggcctcaggctcagcactggccaccctggcccagcacacttcccatgcttcaagctttgcacacacagatccactgtattcccttcctgtgtttaccccattaccttcagcacaccacccacctctcttccatgactgcccccatcccacctagcacggcgccccactactgtgctagctttgttcactcagtgaccatgtgtgtccatcttccagtgaagcttgagctctggggacaagaacgtccctccagattcatgttcctgcagttctatccaactgttcagcatctgtgatgaagtcacaccaagtccctcaccccctaactagtcttctaatctggcatagttatgtgctgggaactaagtagatggtcaaagtaggatatgatgctggccaatggtgcagaccagtaggtccatgtgctgacccttcaactctaaagtcttccccacgcctaccatgtagccataagatctttcccccaaggcagggtacagacaccacatagaggaagaagaccaagtggatgggccccccatagcaggtatgggagagtcaggctgacatagcaagtgtgggagagtcaggctgccatagcaagtgtgggagagtcaggctgccatagcaagtgtgggagagtcaggctgacatagcaagtgtgggagagtcaggctgacatagcaagtgtgggagagtcaggctgccatagcaagtgtgggagagtcaggctgacatagcaagtgtgggagagtcaggctgacatagcaagtgtgggagagtcaggctgacatagcaagtgtgggagagtcaggctgccgggcacaaaggatatgctggacttagggaagccatcctccctgttttctgcccaagcacatatgtatcctactatcagctctctcattgttcactccatactcaagcatctgcccataggaggaagacctcagcctcaagtcaggatgtacatgagagcagccacagagtgagtccatatagttctgttcttttgccccaaaatgtcatgttccagaactacttgttcctttgacctagaccccagaaaagagaccagacactatagtagacacggaagtaagaacaacacagtgctgttgtttctctgctggcaaaggttgttgccacacttatccctggcaaagatataaaacagatgtcatcaaaatgccagtcctggttgtaaatacatatttagaaatgtctgtgtgtgtgtgtgtgtgtgtgtgtgtgtgtgtgtgtgtgtgtgtgtgtgtgtggagacaacaggtaaaaaaataaagacgatgttagagggaggaaattaaagttggaaatgatataatcatatttttattggataatttatatttacatttcaaatgttattccttttccaggtttctcgtccataagccccctgtcccatctccctcccccttcttctataagggtgttccccctctccaaccacaccccattcccgcctccctgccctgacatttccctgcattggggtgggggggatggggttccagccttggcaggaccaaggacttctcctcccattggtacccaacaaggccatcctctgctacacatgcagctggagccatgggtctgttcatatgtacactttgggtagtggtttagtccctgggagctctggttggttagtattgtttgttcttatggggttgcaaaacccttcagctccttcaatcctttctctaactcttccaacagggaccccatgctcagttcaatggtttgctgctaacatccgcctctgtatttgacacactctggctaagcctctcaggagacggctatatcaggctcctgtcaacatgcacttattagcttaatcaataatgtctagttatggtgggtgtatatatatggactggatccccaggtggggcaggctctgaatgtccattccttcagtctctactcagaaatttgtctcaatatctcctcctgtgcatatttttgttcccccttttaagaaggactgaagcatctgcaccttggtcgtcattcttcttgagcttcatgtggtctgtggattgtatcttgggtacttcaagcttctgggctaatttccacttatcaatgagtgcataccatgtgtgtgtttctgtgattgggttaccacactcaggatgatattttctacttccatccatttgcctacagatttcatgaagttattgtttttgatagctaagcattcattgtatagatgtaccacattttctgtatccattcctctgttgaagggcatctgggttctttccagcttctggctattataaataaggctgcaatgaacatagtggagcacgtgtccttgttatatgtcggggcatcttttgggtatatgcccaagagaagtatatctgggtcctcaggtagttcaatgtccaattttctgaggaacctccagactgatttccagagtgtttgtaccagcttgcaatcccaccaacaatggaggagtgttcctctttctccacatcctcgccagcatctgctgtcacctgagttttttttttttttttttagagagacatggaagaagattgtttgttggtctatatttatggcttgctcagcctgtggttttgttttttattaacttgagtatttcttatatacatttcgagtgttattccctttcccagtttccgggcaaacattcccctcccccctctccttccttatgggtgttcccctccccatcctccccccattgccgccctccccccaacagtctagttcactgggggttcaatcttagcaggacccagggcttccccttccactggtgctcttactaggatattcattgctacctatgaggtcagagtccagggtcagtccatgtatagtctttaggtagtggcttagtccctggaagctctggttgcttgacattgttgtacttttggggtctcgagccccttcaagctcttccagttctttctctgattccttcaacgggggtcctattctcagttcagtggtttgctgctggcattcgcctctgtatttgctctattctggctgtgtctctcaggagcgatctacatccagctcctgtcggcctgcacttctttgcttcatccatcttgtctaattggatggctgtatatgtatgggccatatgtggggcaggctctgaatgggtgttccttctgtgtctgttttaatctttgcctctctcttccctgccaagggtattcttgttccccttttaaagaaggagtgaagcattcacattttgatcatccgtcttgagtttcatttgttctaggcatctagggtaattcaagcatttgggctaatagccacttatcaatgagtgcataccatgtgtgcttttctgtgattgggttacctcactcagtcacctgagtttttgatcttagctattctgactggtgtgaggtggaatctctgggttgttttgatttgcatttccctgatgactaaggatgttgagcatttctttgggtacttctgagccattcgatattcctcagctgagaattctttgattacctttgtaccccattttaataggattatttgactctctggagtctaatttcttcagttctttgtatatattggaaattagccctctatcagatgtatgattgataaaaaatcttttccgatctgttggttgccattttgtcctaatgacagtgtcctttgtcttacagaagctttgcagttttatgaggtcccatttgtcgattcttgatcttacaacataagccattggtgttttgttcaggaaattttccccagttcccatgtgttcgagggttcttcccactttttcttctattagtttgaatatatatgattgcatgtggaggtccttgatccacttggacttaagctttgtacatggtgataaaaatggatcaatttgcattcttctacatgctgacctccagttaaaccagcgccatttgttgaaaatgctaatttttgtccattgaatgattttagatcctttgtcaaagatcaagtgaccatacttgtgtgggttcatttctgggtactcaattctattccattgatcttcctgcctatctctgtacgaatatcacacagtttttatcactattgctctgtagtactgcttgaggtcatggatggtgattcccccagaagttcttttatggttgaggatagttttcgccatcctggattttttgttattccaaatgaatttgcaaattgctctttctaactctatgaaaaattgagttggaattttgatggggattccattgaatctgtagattgctttaggcaaaatggccatttttactatattaatccagcctatccatgagcatgggtgatctttccatcttctgagatcttcctcaatttctttcttcagaaactcgaagttcttatcatacagatctttcacttgcttggttaaagtcacaccaaggtattttatggtatatgtgactattgtgtcataatttctttctcagtcttttatccttggagtagaggaaggttactgattggtttgagttaattttatacccagccactttgctgaagttgtttgtcaggttaagtagtctcttgtggaacttttcgggtcacttaactatatactatcttatcacctgcaaatagaggtattttgacttcttcctttccaatttgtatctatttgacctccttttgttgtctgatttctctgggtaggactttgaatgctatattgaataagtaggaaaagagtaggcagccttgtctagttcaattttagtgggattattcaagtttctctcgatttagtttaatgttggctactggcttgctgtatattacttttacattttatattactttttttatgtttaggtataggctttgaattattgatctgtccatgacttttatcatgaaggggtgttgaattttgacaaatgctttctctgcatctaatgaaatgatcatgtggtttctatctttgagtttgtttatatagtggatcacgttgatggttttctgtatattaaaccatccctgcaaccctgggatgaagcctacttgatcatgatggatgattgttttgatgtattcttagatttggtttgtgagaattttattgagtatttttacgtccatattcgtaagggaagttggtctgaagttctctttctttgtcgagtcttgatgtggattaggtataagcataattgtggcttaatacaaggaattgggtagtgctccttctgtttctattttctggaatagtttgggcatagtttagtatgaggtcttctataaaggtctgatagaattctgaactaaacccatcctctcctgggcttttttttttttttagttggagacttttaataactgctcctatttctttagaagttatggtactgtttagatggtttatctgaccctgatttaactttggtacctggtatccatctagaaaattgtacatttcctccagattttccagttttgttgaacttaagtttttgtaatagaatctgatgatttttttaatttcctcggattctgttatttctcccttttcagttctgactttgttaatttggatacgttatctgtgccctctgattagtctggctgaggatttatctatcttgttgcttttctcaaagaagcagctcctggttctttgtatagtcctttttgttactacctggttgatttcagccctgagtttgaagggctcttcaaactcctctactcctcttgggtgtatttgcttctttttgttctagagcttttaggtgtgctgtcaacctactaatgtatgctctcccctgtttctttttggaggcactcagagctatgagttttcctcttagcactgctttcatttgtgttccataagtttgggtatgttgggccttcattttcactaaattctaaaaagtctttaatttctttctttatttcttccttgaccaagttatcattgagtagagcgttgttcaacttccatgtatatgtgggctttctgttgtttttgttgttattgaagaccagccttagtccatggtgatctgataggatgcatgggattactgcaatcttcttgtatctgttgaggcctgttttgtgacagattatatggtcaattttggagaagctaccatgaggtgctgagaagaaggtatattcttttgttttaggataaaatgttctataaatatctgttaaatccatttggttcataacttgttagtttctctatgtctctgtttggtttctgtttccattatctgtccattgatgagagtgggatgttgaaatctcctactattattgtgtgaggcgcaatgtgtgctttgggttttagtaaggcttcttttatgaatgtaagtacctttgcatttggagcatagatattcaggattgagagttcatcttggtggatttttcctttgatggatgtgaagtgtcctttcttatcttttttgatcacttttggttgaaagtcgattttattcaatattagaatggttactccagcttgcttcttcagaccatttgaggtagtgtctgtctttgtctctgaggtgtgttttctgtatgcagcaaaatgctgggtcctctttacatgtccagtctgttactctatgtctttttattgggaaattgagttcattgatgttaagagatattaaggaatagtgattgttctttcctgtttatatttgttagaggtagaattgtatttgtggggctttcttcttttgggtttgttgcaagaagattactttcttgctttttctagggcataatttcctttattgtgttggagttttccatgtattatcctttttaggactgtgtttgtggaaagatattgtgtaaatttggttttctcacggaatatcttggtttctctatctatgttaattgagagttttgctggatatagtagcctggcctggcatttgtgttctcttagggtctgtatgatatctgcccaggatcttctggcttttcatagtctctggtaagaagtctgctataattatgataggtcttcctttgtatgttacttgaccttttttccttactgcttttaatattctttctttgttttgtgcatttggtgttttgacttttatgtgatggaaggaatttcttttctagttcaatctatttggagttctgtaggcttcttatatgtttatgggcatctctttctttaggttagggaaattttcttctataatttttgttgaagatatttactggccctttaagttgagagtcctcactctcttctatacctattatccttaggcttgatcttctcattgtgtcctagatttcctggatgttttaggttaggaactttctgcattttacattatctttgatggttgttttctatggtatcttctgccctgagattctctcttctatttattgtattctgttggggattctttgcatctatgactcctgatctcttccctaggttttctatctccagggttgtctccctttgtgatttctttattgtttctgtttccgtttttagatcctggatggttttgttcaattccttcacctgtttgattgtgttttcctgtaattctttaaggggtttttgtattttctctttacaggcttctacttgtgtttcctctttaagggcttctacttgtttatctatgttgtcctgtatttctttaaggaagttacttatgtccttcttaaagtcctctatcaccatcatgagatgtgatttttaaatccaaatcttgcttttcctgtgtgtttggatccagtatttgctttggtgtgagaactgggctctaatgatgccaagtgtccttagtttctctttcttaggtgctgcgcttgcctcttgccatcaggttgtctctggtgttagattgtcttgctgtctctgacactggcttgaccctcctgtaagcctgtgtgtcagcactcctgtagacctgttttctttcagctggatctgggaacagagagctgctcctgggtttgtgtgtcctgaggccaccaggcaggtcgcttggagcagaagtgttggtcttacctctgctctcaggtgtgtcagcacttctggcaactggctttcagctctggacacaggcagaaaccagaagatttctgcccctgactgctcctagcttcctatgtccagagggcacagagggcactaggtgggttcctcttggtccatgaatgtcagcagaagtagttgtctcctctgagctctcaggactgtccacacttttgagagtccatctctctcccccacaggatttgggaacagagagctgtgggagcggttcagctccgggtgcaggtagaaaccaaaagtatcctgtactagacttctactgcctttattgatataaccatattttaatcccaaaagcaaaaataaatgctttatttctggtcttgagctaagggtatagttcaattgttagagtacttgtctgtaatgcaggagccctggatctgatctccattacagaataaaccaaatgtggtaatgcatgcctgcaatcccaaatcccaaatctccaaaggcgtacacaggaggatgagactttcgaagtcattcttgtctacatagcaaattagagaccaaccttatctttaaaaatagtaataatcctgatcttccacttgaagtaaatgtatccagtaactgtacctgataccattctatgttagattttgtttcagggtttcgaagataagttctccagagaagcacaagtagtgggagatggcggagagagggctggtagatgaacccataaacaacaaacaacagagctggaggacaattaggatgatatgtagttagaaacagagggacagcatataagagacaacagggagataacacataagagacaacacagggataacacacaaaagacagaagagagataatacataagagacaacagagggacagcgcataagagacaacagggagataacacgtaagagacaacagagggataacacataaagacttagagttttatggttcgccttgactagattaaggaatgaatgcctgtggaggtgtctatgaaggactttccagaagtgttaggtcttagggggctctgacttagccctttggtggagtgagaatgtggtggcattatagaaaaatgctgaacagtaagaagtccaggtggaggaagcagattactgggggtgtgcatgggccattacatctgaccctggacactacattccctttatctctacttcccatcagtcaagaaataaatagcctcttccacacaaccccactgtcattatggccctaagcacataagccccccaccctttaagtttctttgaggtatctggtcatcctggctcccagctccaagtcacccaaagggttcatataggcaagcatttccacctctaccgtgttccatcacaaaccactggctatttgagaaatttcagacagctaaagaatggttctcttagcactgatggccttgcattcaagagacttgcctgctggtttgcaaacctagaggctatggcactgaacttggacacccggtggcgtgctgcttttggcatagagaaagctgacatccagcagctaagtgactgctcctgagctttggaactcgttctcctgtatcaccctctacatccaactcttctcagcttgtcttctcaatatttccactgtccctcatcaccttagattcttgtagacgctgccctcaatggcttactggctcctcaactacttcctgccactgtcgccctcagggctggaaacctggagccttgtctgctcttggcacagccacacagcttactctacccatgacaaataaggagacttggagaccatttggggaaagcctttatcagggcctaatgggtgcacacttggatcaggagtcatccattggagagaagcctcaaggaatagtggggaacatactgtatctagagacagtatagggtcatgatggcgtggattatactccccacaaagacagccctgcatgtgctctgcttccagtctcaccaatcacaaccctcccgtatgaacccatcacagcccttgcacagattgcaggtctcaaatatgttcacctttctttctgacataaccaggattttttttaatttgcttgcgtgtttattatttctatttattttattcattttttatttattattttacatcccactcactacccctctccccatcatcccctcccaagatccttcccccatcccctctccctttcacctctgagccagtggtgccccctccgtgtatctcccaaccctaataatcaggtggtttgagccaccagggaagatgctcttcttcctttctgaccttgagagctgctattccaaggtcctctggagctgtgtgtgtgaagtcacctggaggtcataggtggagtggagttttaaggccatggtagaggctggagccatagtagttggaacaaggctgtggtttcagcagcagccatgattgttgtatactttgcagctcaaatatggtctcctcagggctctgtgaggtattcaaagcacctagaatcccatgatgacacttccaccagtctctaaaagagacctaagactactagatatagaaaaaggccaacttaagtacatcaaaaggtcaagccttctggcccctaatggctcattttacatgaagaaaaggtgaccattacactatgcccaataaagacatgttacatttacactacggtccttggcatcccttagcagatgatcctagggagagctgagcaatctcgtccatctcacctccacccagtcaccaaaataacactgttctaaggcacacttctgagacttacagagctactagagagttgggggtagcagtaagacctttccctggccctcaagatacgttcacacccacatcacatatatgagttcgcatacactaacacacacagcacatcttggacatggcccattcaggaacagatctgtcatgatcgcttgagttaaggaaccactcaagggaatgactaaaggaggatcccactggagtcctggcccacaggaggaggtggaataaaggttaggtagggcaagacaagggcactaaagccactatgctgctggggccactgtggacactgatggccagaaatggaatgatcagcctgtaggcaggaggggggagggaggatgattcctgaaaaccagaagagtcaccgtggagtctgaaccaggaaggagagagagctcccagtgtaaccctaaggcttaagtagttgcaactgcctcctctccttccagaggaccacccactgccacctagcatagcactctgaggactcagaaccagcagcccagcataagctgagtgtcaaagaagaatcaggcccaagcaggctggacacaaagtttcttggtcctcaggctatgagggagatggagtccttcccactattcggggcacaccacagacagcagcacctgatccagttggagcaaaggctcctcacccctgtgttttccctcagaaccacaagtctttccaggaaactctgtatttacccctcagattcccacccaggtctgttaggctaaaggccaagcctgtcacctcagactatctgaaagagataaaaccaggcaagacccccaattccctcagatctcacaccccgtgttcccaaagtccctaactaactttcctggggccagcccggggcctacctggttcttccactgtcagttagctctctgatgtcttccaaatacaattaaacacccttctgtgggaagtcagacttggcaaagcctaagtcccccagtcccttgcatcccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggaagctgctgggcccacacaccatctttaccctctccccttccctcagtgcagacgtagaccacaggcctggaagagacgttagctgtttctatggtgttccatgagacccagttactccccagatgtgctctgtccttgccagagtagcaagtagaggaccccaagccgaagggcggccacttgtgagtgattaccagggaagcccactgtctctagcatgccagctccaaagctgagacaggaaccagggggcctctatcagaggccctgcgtgtcatatcgtgcccacaggctgttcctctttgtgtatcgttaataacttacaacgtgactgccacactgccccgaaggactgccaagggaacagaaaaggcaatggcttgagtccagtcccttttcagggcagtagcactccaaaggggcaggcatcgtgactgcaggaacatgcaagtttctaacgtgagagctgtgcagaacaccagacaacgaaaagtgccctgaccagagcgtgcaggtgtgtctcctagaaagaggcctcacctgagacgccactgtcccttagtcaacttcccaagaacagaataaaaaagggaacttccaaggctgctaaggccgggggttcccaccccacttttagctgagggcactgaggcagagcggcccctaggtactaccatctgggcacgaatgcaataatggttactaaagattcacaacgtctgggagcctgcacagggacaggagatggctgcagatgagaagagcctggctagccacagccacttaccagcggacctcaggtatcatagcctgtgggaccctgagccaaagggtttgcccaaggagaatgggcaaacaggttacagggtcctggatggggaagggggcacctgggctgccttctaacaaggacagagtctcttggtcattgcctgtccttcagctgtcactcctctgcattaaggcacacagttattagacactactaccgctatccacaaagacaggggactgtggatctcaaccagacatggctgaaccaagagaaactgaagatgtcgtgagaagctcagaaaacgccaggagaagctgaataggaatctgcctgcaaaccatcagggcaaggaggcaataacaagtgacagagccaacgagtgacagcaaggaattgccctgtgatgaactaacaacaaagctgggctgacctgggctaagctaggagtgggatctgtgctgcactgggctggaaggagccgggatgagccaagcaaagtgggttggactgagttgaattggcctggactagtttgtgttgggctgggctggcctggaataggtaggctaaaccagcttaaactagggtaggctgggcttaactgaatcagactaggctagactaagcagaactgggctgggttgaactgggctacactagcctggtctgatctaggataggctgggctaagctgagctggactggctggactgggctgagctaagttgcactggacagagctgggctggagtggactggactgggttggattgggctggactgggctgggctaggctgagctaaattgcactggacagagctgggctagagtggactggacagagctgggctagagtggactggactgggctgggctgggctgggctgggctgggctgggctgggctgggctgggctgagctgggctgggctgggctgggctggactgggctgggctggactgggctggactgggctggactgggctgggctgggctgggctgggctgggctgggctgggctgggctgggctgggctgggctgggctgggctcagcaggcctaagtaggcctagctgggtttagctaggtttggctaggtaaggctgagctagattggactggactgaaccaggtggggtatattcagctgacattgtttggtctggtctggactgaactggactgagccgggctagcctaagctagatggggggtatactcagctgagatgggctggtctggctagattgaactggactggactaggctgagccaggctgacctgagatgtcctgatctgggctgaactgggcagggctggtctcagctggactacactgagttaacctgggctgaaccagactgggctaaactaggttgtactggctggattagacttggctaaactgggcttggctaaactgagtcaggatggtctaggttgatttttagttgggctaaactaagctgaactacactgaactaggcaagactgggctggaaaggtctgagttaaattaggagggacttggctgggctgggctgggctgggccaggctgggctgagctgggccaggctgggctgagctgggctgagctgggctgagctggattgagccgggctgaactggactgagctgggatgagctggactgagctggactgggttgagctgaacaaaactaaactggaatgggctaaattggcctaaaattggctaggctaagctaagtaaggctgccctgagctgagaaggactggattggcctggactgagtttggatgagcatcattggactatgctaagctaacttgggtgaagtgggctaagcaggactaatctggcctgatctgagctagaccaagctaggccaagctcagctaagtttagcttagctgaattaggctgggctggactgtattgagctacactaaatttaacaggctgagctgagctgagctgagctgagctgagctgagctgagctgagctaagctgagctggttttgtctaaggtggattgacctgggctggactgaactcaattggactacactgaacttatctggacctcactgagctgtgctgcactgggccaaccctggatcactctagatctagcttagctggactgggctgagctagattgggtggactgatctaggctgaactagactattcttgcctgaggaaggctgggctatgctgagttgaactaaactgaactcagctaaggaaggctaagctagactgagctgagctacgttgggttgggctaaactgggctgagctatctcgggtagactaggctgagctagactaaattgggctgagctggagttggttggactggactgggttgggctaagctgagctgatttggtgtaatctgggatcaggtggcttgagctggactggactgtctgagctaaactgggttgagtggagctgagtgggtctgagtgaggctaggctggaatgagctaggctaaactgggctgaactggtttaggttgaatttagctgagatgagctgggctagacttctataagatggctgaactctgctagggtgaactgagctgtgctgagctgaacttggattaactataattagttgagctgggctgaactaggctgagtttagctggaataagagtcaactgggcccaactgagctaggctaagctaggctgaactgggatgagctagaattactgttctagtctgatctggactaaggtagactgggctggggttgagctctgttgggctaagcaaagttgagctatgagatgaactaggctgaattgggtacttctagatcattccaggctgttctgggttgacctgaactgggtgggattgagctaagtggggtaggctatgctgagctctgccaggctgcatgagtttattgatctgaactgggacaggctggaatggactggcctgagctacaccaactgggctaagctgggataggtcaggctaggaggagtcaagctggactaggccaaactattataggtcttttggtctagttgaactttctggtgcttaactgaactgtgtttaagatcgattgctcaaaccagagggaggagaagcccttggccctgccaaggctggaccccacacacacaccagtgtaggggaatgtcaggacagagaggtggaaaggggtgggtggttgggtgggggaaaagtgataacatttgaaatgtaagtttaaaaaaaatccaaaaaataaattaatttaaaaaaaaatagattgctcgaaattttttatggatgtttttaactgttctccaagaagattgtcctgatatagtagccagactatatcagggtaggtagagacaatcaggtttatcagaaatatcctatgctttctgggggcctggcacagagctgaactgggccccaggctcaggagaatgtcacgggcatgcgggcactccagaataatttaggcagccatcaaggtggcttctgaagtggttgtattctctaactgtgtgctgtctaggatctgcagaggtcactaggaggcagaacactttgcaggttagcctgtggtaaagccaagagccccatgaatctgaaaggctgagaccaatagccctaggaaacaagggtctcacagttctgtcattaatgtgtcccaaaacagatttaatgtgtctcgccaaggaactggtgctcctgggaaagctctgaatccccaggtcccaaaagtggggacggaagatacaaaagtaattcactggatctctgggttcccaagccctttggggtacctgtgtcttggatttaaagtatagcctggtccctctggcaatatcatacagcctaccttaaagctactccattcaccctgagaacctaatggcttccagtctgccacccagttctcctgcttcatttatgggcatatcagagataataccactgtcaccctgcttaaaggacagacaggaaataactaacacacacatccccaaaagttctcagtcaagaaagagagcaaagttgcctcttcctccaaagctcatacccagccctcctggaagcccctgtgctaagccagctaggggcagtgagcaaagcttggcagagcatcaataatcaggggcctccctgggtttgtgcttgggtttagagaatgaagacaagacccagaaggagactgtctcctagactggaagagaatccccagaaccctgctcctgtcacagctgccctaatcagtcccctatgctgcaggcatgcagtgatctaaacaaatctaacctaggtccttcctgtcccacagtttctgtcaaggccccttcactctatcccttgaagccctgtagcagcgaaaacacggcttcggtgacattgggctgcctggtaaaggactacttccctgatccggtgactgtgacctggtattcagactccctgaacacgagcaccatgaacttcccgtctatcggttctgatcttaagaccaccaccagccaaatgaccagctggggcaagtcagccaagaacttcacttgccacgtgacacatgccccatccacattcgtcagtgacttgactatccggggtaagcagggttgagctggttacagttaccacaagagggaacatggtcagagcagaaaggaccgctcatatatacctataacagggggccaggggacccaacatactcaggggcctggtttgaggcttgaggggacataaggttagggagatactcacagctcactgcctctgccctagctcgacctgtcaacatcaccaagcccactgtagatctactccattcatcctgcgaccccaacgcattccactccaccatccagctgtactgctttgtttacggccacatccaaaatgatgtctctatccactggctaatggacgatcggaagatatatgaaacacatgcacaaaatgtcctaatcaaggaggaaggcaaactagcctctacctacagtagactcaacatcacccagcagcaatggatgtctgaaagcaccttcacctgcaaggtcacctcccaaggcgagaactattgggcccacactcggagatgctcaggtaggcccacactcgcctgatgctgagacctcagagttctgaagggaaggcaggctcttacgcagcccttcctctcttacagatgatgagccccggggtgtgattacctacctgatcccacccagtcccctcgacctgtatgaaaatgggactcccaaacttacctgtctggttttggacctggaaagtgaggagaatatcaccgtgacgtgggtccgagagcgtaagaagtctataggttcggcatcccagaggagtaccaagcaccataatgccacaaccagtatcacctccatcttgccagtggatgccaaggactggatcgaaggtgaaggctaccagtgcagagtggaccaccctcactttcccaagcccattgtgcgttccatcaccaaggccccaggtgagcacaggagatggagagtgggccggcccttctctgtgttcagatggcacggttaactggttaactcgtgtctgcccacaggcaagcgctcagccccagaggtatatgtgttcctgccaccggaggaggaggagaaggacaaacgaacactcacctgcttgatccagaatttcttccccgaggatatctctgtgcagtggctgcaggatagcaagctgatccccaaaagccaacatagtaccacgacacctctgaaatacaatggctccaaccaacgcttcttcatctttagccgcctggaggtcaccaaggcactctggacacagacaaaacagttcacctgccgagtgatccatgaggcacttcgggaacccaggaagctggagagaacaatatccaagagccttggtaacacttccctccgtccctcccaggcctccatgtagctgtgatggggaaggtgaatggcagacatctgcccactgttgtaacactgggaagccaccccaataaacactcagtgcctgattagagccctgggtgcccttcttcggggaaggtgggttgtgggcagaagtatcttggcctgaaagaagggaaaccccaagagagggacaggagtgaagcatggctcacccatctgtctatgtgttgggtatttgacaaataggacatcacagggcttcagcatagataaccctggtccttcctgcccttcactgtatcatgcacctgaaagggatccaaagagccagagaggtggtctctagagatgtaggtaaaatgaaccaacctgagaggcctcggcacccacccctcagtcttgcaagctcctgctcccaggtattcctggatgctggaactccttaaggtagagaaacagccaaagtcaacatctggaaaggcagaagtcagcatggccctgctccttccctctgtactcagcagccattgaggctgagcctacggccctgacctcctgtgtgccatgtgatcataccagacccggatcagaacctggtgctcctcatctttcaacccaaagtcatcccaaggcccagaatgggaagccagcttcacacagttgggttctcccatctatgccatgttctcacacacacacacacacacacacacacacacagagccacaaacactcaggccaccaagtcttaaagagactccaccaacagcacacacttgcagccacctgacacaacaacacacctcacccatgttcacatgtggcctgcgctaggcttcagtctgtttccagtcctttaccttttacacttgagtccaaaataaaaacagaagacttacgccctgagggagagaccagtgtcttcttcctgtggcctcagctcccagaacactcttccctaccttctacaacactaagacagtaagatacacccacacgaacataaatacatacacacacacacacacacacacacacacacacacacacacaccccaagtaggcttcatcatgctctttggtttagcaatagcccaaagcaagctatgcatccatctcaggcccagagggatgaggagaccagaatcaagacatacccacgcccatcccacgcccaaccaccaaccaccagcacatacggttcacacacctgagaccagtggctcccatcacacacacacacacacacacacacacacacacacacacacacacacacaagcccgtacacatccaccatatccagagacaagtgtctgagtctgagatacctctgaggatcaccaatggcagagtcggccagcacctcagcctccaggccaatccttatactttggcccactgcaggccatgagagatggaggaggtggaggcctgagctgtggaaaaccagagacaggaagatggtctgtatggagagagtagtaaaccagattatagggagactgaggcaggagtagagctcctacaaggccagtagtctaccttagagtcctataagtctgggctgggagtccatgtgtcctgacttgctcctcagatatcacaaccaagattcctggagccagagtgtgcatgcaggccttagaaatggagcttagagcccttcctggagggccctgggcactctgaacaaaaggcaattctgtaggctgtatagaggcatcctgtcagatacacacacacatgcacacacatacacacacagagacacagacacacacacatgcccacacacatgcatacacacatgcacacacatacacacacagagacacagacacacacacatgcccacacacatgcatacacacatgcatgcacacacacacacatacacacacacacacacacacacacacacacacacacacacacacaccccgcaggtagccttcatcatgctgtctagcgatagcccttttgagggtgggagatactgggtcatggtgggcactggagtagaaagagggaatgagcagtcagggtcaggggaaaaggacatctgcctccagggctgaacagagacttggagcagtcccagagcaagtgggatggggagctctgccactccagtttcaccaggactgcctgagaccagtgagggatccaccctgccacactgtcacttggagtctggggacgctaactggctggtccccccatcccagagctagacatccaggacctatgtaccgaagaggtggagggcgaggagctggaagagctgtggaccagcacttatatcttcatcagcctgttcctgctcagtgtgagctatggggccactgtcactgttctcaaggtgggatcctgcacctcggtgggtgggtcagggaggtctaggccaagctgcagcgccatcctcacatacacctttcccccaggtgaagtgggtcttctccacactgatgcacgatacaccccagaccttccaagactatgccaacatcctccagaccagggcatagatgcgatgccagcacccgtgcaggcctgcagccatgtgtgtctgagcctcctgaggtgcctgtttgccttggatggtaggtgggagcagagacccctaaaggcaccagagttggtgagatgtcaacatgtagaaggtgcggcttggggcagcaatgtgggctgtcccgcatggatactttgagacaggactttgaagagcctcaatttgacctatcaaatgctggtcacccaggtctttcagcatcagggtcactccatattgactgaataaccacaaaagcacaagaacccagagcctagagtccccactaggccccacctagagcacagagtcaaagctgggacactcagaatcaacccaaagtccagacccttgctcctcagaaggaatcctgccccactgcttccagacagacctctggcctaggcagatcgtcctactgccagataaggagcctcccacagggcagcagcagactcaagctctgaggccccatcaaccccagccccagcctggcagtcctactttgtctctggtctctttagtaaagttcttttccataactcctgagagtgctttgagaaggtatttaaggctaccattatggtgatgacaggtcccaagaacatggacaaggaccagatggtaagagcctggggattaaacatccacctctatgccatcctcctcaaaccacagagttctgccccagtctccatccggtccatcattcctgctgaccagactcacctcccaggggaattgaggtggaatcagggctgggcccccgggaacctggctgcaggtcactcttcaagaccacaatctgcccacccagtaagtgcagactgacaggccagtcccctgacccaagctgggacactagagggactaggtaacagcacgcaagtgtacaagaaccatccaaaatgggttgtgccatcctcaagacatgatctcacatgacaaaagacaggcttctctcatatataatgattgctcagggactaagaagaaagacctcttcatgggacggaaaaaccagcagtcactgtttttttcctgaagaaaatgcttcaatggtgagaacacttctagaaagaaggatgttagggtgagtgtggccctgctgggccctgggtaaagaaaggcatgagaactacttagaccattttgagggtcagttggccaaacactcttgtcatcacaagtgacagtctcacaaagaggtccacactggggtgtcaagctcagcaccaggggactttgggggaactaagatagggataaaccagccgggatcaggccatagtccacaggcatctgagccctctgctgctgagtccggcttctacgggccttggagtagggcccagatggcaaagacacagaaagctacccctcctgggtgcagaagacccaggactgggagaatgactgttctgatgagaaaagaggctctgtttaggatgtgtcccaagccattagtgtggccagcttactaatgtgcattcatgctgcaaaccattgctcacaatcaaatgtataccacgcacacagtcacgtagtttgcgcagacccactcatgtggcacatgcctgtgggcacatgggaccacacatacacgtgatgctttaaaacacagatctgcacggtcttgtacttagacacacattgtctcaggaagcccaggtgtggaccaccctgtcctcctgccacattctcctaagccatatcccctgccaagctgaggcctaggtgcctcttcctcaaccagctcctagaccaacatccctgaggcatagctcagtgtcttcttctaatcactatccctccaagccacgagaccccatagacactggacacgggcagcaagggttcagctcaaagaacacggtgtggcaggaactcctaccaaatcccaactagaaggaaggaaagtcccacagagagctagactcactctagacaacccagacagtgaccctggcttctacataccatgaatgaatgaccttctgagactaagaggtcgctttcttctctattcctacattatcagtccaccatggagggctacatggaaaaccccaaaagacataatcacattttggaacccataaatgtagcctcttgggaatagttcttcatcaatgtgaccaaggtaactatctcaagacgaggtcatcaaggactagctagtggactttaacctggtgacaagagtcataagagacagaagcaggacctagggggtaaacagggcctgcattctccaaaatcaaagtgtcaaaacagaaatatggcagcaaaacagaagtaccgtgcccaacactggtcaagaccaatgggggaggctcatgaggggttgcctaacaagagcaggcacaagtgcttagataaaaccacaacctacactcggccaccgtaaccctacatagaaaatgtacctatgggacgtcagctcaacgtcagtcccacctcgttgctgtgcgcagacagctgcagcctgaataacctgtccaagtgtgcatgtcacatccttgatgacacactgtaaccagtgatgccatgttagcacgatgtcctgtgagggtgtcttctgactcgggatggcaaaccctaagaccaaaaggaggtgcttggttcacgagagcggcctcgtggctggacacatggcgttaaatgagcctctgtggactaggaagcagctttaaccagaaagactataccagcaccctgcttcacgtttccacctttgagcctctactgactaagccactggcagccactcagcctgtggtattctctaacggcaacagaaatgactaagacaggcaaccacaatgtcccccactgctgatggctccagggcattcttggcctgatgacaggacctccagagcctccttgagacaggcagatctctggagggcaggaccaagctttctcctctctacctccccaacatctttgactagcttcacagataaaaggctagggggacatcagtttattccacactttctaagtctgatgcaggagcccttcctctgcgaagtatctatccaagaacccagaaaaggctaacttccccaactcaacacttagcaccactgacacacctgaccatacccactgatttacaacctttctcccagacagggccattcctgggcaaagactgtggtgtgagggcccagagtcctattgttgtataaatgaggcacagtggcagaggcaagctacaaagagtgacattgtggagagaggacactggggacagtcggatgtgtagaggatcatatgaagggtggagccctaccctgacaatctacaaagagtgacattgtggagagaggacactggggacagtcggatgtgtagaggatcatatgaagggtggagccctaccctgacaatcttcaagaggctccataggtcaaaggcccatcctgagaaagctgtgataggaaattgactcagggcagatgggatccaaatgagggtagcacctaactgtgacctacagacctccatgttggtcctcaagttggggcacccactttctcatggacgtagccatggaggtagccacagctcgtgacaagccattccagacacttgcctcaccccgttgtcaaccctgtgacctcaaagctcttctctgaggcccccctcagcttagggacccctctggagtagccctgttactttggctccttgacaacaagctctcaggtctcccttctacccctaattgtcctctccctctccatctctgccttggagtctctgagaaactagatgttcatttcattccctcctgcatctcctgcccaacctacccctgtggccatgcatgtggagtcctggccccatccaggcccgtgtggtcagacacacctgtctccaccacagccagaccacaggccagacatgacgtggaggtaagcggccacaatgtggaggtggaacaggaagtgggtgagggaccccatccaggggccagacacacagtcgtgcagccccctcaccgctcagtctgacccatccacaggcaaccacacacagagaaaaccagtttccagccaaggcttcacccagtcctaagctctctccggtagggcagacggcctttagccatgagaatggaccttcagggtgggaccacctggccatgggaggcctggctgttcccctatgaatgacactcaacaaccttgagcaggtgggtcccggtaccatctggactgctctgctccttggtgcactggggaatctcaaccaggccagacctgagaacataaggcagagaagcattagcaaggagaaggtgattcggagagcaagaaccagaggaatacaggacatgaacacaggcacgaggcggggtcatggtctgagctgcagagaagagagaaaaatggatgaaactcagcttcctggaaagcagcaacaagagactcccaggctagactgaggcaaggataaggaggcatcaacaaagaatgggggtgactcgggctgccatggctcagctgagctggatttagccaggctgagctgaactaagcttagctgaggtgaatgagactgagctgagctgagctgggacaaggtaggccaagttgggctgactgagctagtctagactggtctgggctagtctgatctggactggtctgagctgaactgagctaagttgagctgggataaactgggctgaggtgggataagatggcctgacttgggtaactaagccagtctagaattggataaactgaactagactggtccaaactggactagactgagctggactgagttagaatgaggtggactgggctaaactgggctgagctaggttaagctagggtggactagaatgctgatttaagatggcctggggtgggaacgctagctaagccagaccaagctgggctaggctgggttaagttgagttgagctacagtaaactagcctgggctgtgctgaccttactacaccaggctgggtttggttggcatgaatggagctgatttgagctgggctagaccaggttagtatgagctatgctgtcctggtctaagtagactgggtgaggctgagaaaattcgagatggaaactggactgagatggaaaaagataggcttagtgttggcttactgaaccagtctagaatgagctgaactggacttggaatggcctgaactgggcttagcttatctagcctgggcttggctaggctggcctaacctaggctgagttgatctgaactggtgtaggctgggataggcttgctgaaatggactaggtcaagctgggctggagtggggttagctaaaataggtggactaggctgagatgagttaggatgacctgagctatatttaggggatggatgggatgggatgggctatcccaagctaagctgggctagaatgggctagtgtaagctaaactggctgggttggaatgtgctgggctgtgctaagctagaataaactagagtggactggccaaaatcggctgggacggtctgtactgaaccaggctgggctgggctaactgagctagaccggtctgaggtgagctaatctgggatggggcggactgagctgggataggctagattaagctgggatgagctaggctaggctcactgagctaggctggaatagaccggtctaagataggctgcctgagctaaactagactgagatgaactgtaatgagctgggatgagctaagctaatctgggatgatctgggctaggctggaatggactgagccgagctggtctcagctgggctgggttgtgctgaatgggggtaaaccagactaggctacccagactaagctgggctgtgctgggccaagctgggctgagctagggtgggttgggctcgatggctgggctaatccaagctaggctgagctgagctggactgagctgggctggacggagctaggatgggattgactgagctgagctggactgaaatgggctgagctgagctaggctgagattcgctgagctgggctgagctggactgagctggactgagctggactgagctggactgagctgggctgagctgagctaggctgagattcgctgagctgggctgagctgggctgagctgggctgagctgggctgagctggactgaaatgggctgagcagacctggacaatgcaaggctgcactgaactgtccggctaggctatactgggatgagctgagctgggctggtctcagctaggcttggctgtgctgcatggaggtaaaccagactaggctacccaagctaaactgggctggaccaggctgggctggactgagctgtgctgagctggactgagctgggctgggctgggctgagctgagccaggcttggtttggctgagctgagctgagctgagctggactgagctagactgagctgggctgagctgagctaggctggactgagctggactgagctgggctgagctgagctaggctgggtttggctgagctgagctgagctggactgagctgggtgagctaaggtagactggaattggctgagctaagctgagctggactaaactggactaagctggactgagctgggctgagctgagctaggttaggattggctgagctgagctggactgagctgggctgagctggactgagctggactgaaatgggctgagaagccctggacaaagcaaggctgcactgaactgtctggctaggctatactgggatgagctgagctgggctgggctaagttgacttgggctaggataaactaaactgggatgagccggggtgagctgcatgaggtaggctggaatggctgagctagactaggccaggctgagctggaatgagccgagttgagctgagctgagctgagataaacttagtaaggctagaatgaattgagctgagctaggctgggccgacctaaagttgctctgaggtaggttagacatggttgtctgagctgggctgagttaggctagctataccgtctgggctgacctaatatgcccatattagttgtaatgacgtgacctaggttgaaacgggcttgctgatctgggctggactgggccaaactggagttagtctagcctgggctgacttagtgtagcctgggcagagttagactggaatgggctacactgagctgaactaggatgggatgggaagggataggctgaactgactgagctgggttcagttggccttgctgggctgagctgggctggatagtctagctgggctggccagaatgaggcagagctaggctggaattaggctaaacttggtttggctggttaagatgagctaacataaattaggctggctgaactacactggactgtaagctagcctgggtgagttcgcatggctggacgtcttcacagctctagtctgagttttactggtttgttctcctcagtgctgaggtaatagaaagactttggagtaaatgtgaaccaactcttgtttcatgggtccagactgtggcctcagtttgtcttatatgaacggagccacgccactcagtgtccaattctcatgccctcttctccttccctgattacctggtggaaactcacatgtacctgtagatagtgcctacatggacagaaccactgctcagatttagtcctctggccttttggtccactgcttgctgggtggatgggcaggtggctggagtggtgggtctgaagccaggacaaggcaagtataaagtaaaaacacaacaaaatggcccccaccccccagtgtaacctccaagccagctgttccccaaccattcctgccctgtgctggctgaggttggccgtccctgctcaggcccaccagttctggacctcctaacctgggactgagaacacggctctacccactgcccaagcaggagtggggctcagaaatctggggcgctagactgctcaggagcatagccatgtttacaaagacactcacagtgcgtacaagccctgctggaggcatctagccagatccttgaaaaagacaacctgcaggtcacgttcaaaatctatgcagccagtcggtcagctccaactgcgggtacatgatgcaacccctatgtgatactgggcctaggttctccggtataaagaagaaaaaggcatggtcctttctccagagattgtctcaagatgggcagtgtgaggactactatctcactcatgttttatgttccagagtccgcgaaagatcccaccatctacccactgagacccccaccatctccgtcaagcgacccagtgacaatcggctgcctaattcagaattacttcccatccggaactatgaatgtgacctggggcaagagtggaaaggatataagcgtcataaacttcccacctgccccagcctctgggccatacaccatgtgcagccagttgacattgccagctgcagagtgcccaaaaggaacatctgtgaaatactatgttcaatataacacaagccccgtcagagaattgagtgtggaatgccctggtaaagaaggttgggggggtctggggtgggctaagtcctaccttaacctggtatctggacccatatacccctctgaagcacacatcccactcagaaacctcccatgggggatggggggagggggtgtgaacaggcagagggagcagaggcctcagaacatccagaaaaggggacagcaaaggagaaaaggagactattctgatttgctaaaacttctatgttacaggtccaaaaccctccttagtctgccgccctcgcctgtcactgcaacggccagcccttgaggacctgctcctgggttcagaggccagcctcacatgtactctgagaggcctgaaagagcctacgggagccgtcttcacctggcagcccaccactgggaaggatgcagtgcagaaggaagctgtgcaggactcctgtggctgctacactgtgtccagcgtcctgcctggctgtgccgagcgctggaacaatggagagaccttcacatgcacagctacccaccctgaatttgagacccccttaaccggcgaaattgccaaagtcacaggtgggcccagatgcatacctgggacattgtatgatgttccctgcttgcgtacctgctttcttcctctaatacagatgctcagctgctcaggcccttgtgtcacagagggaaactggagctatccaaagaactgcccagaagggaagggcagagaggtctctgctctccttgtctgagccataactcttctttctaccttccagaaaacaccttcccaccccaggtccacctgctaccgccgccgtcggaggagctggccctgaatgagctcgtgtccctgacatgcctggtgcgaggattcaaccctaaagatgtgctggtgcgttggctacaagggaatgaggagctgccctctgaaagctacctagtgtttgagcccctgagggagccaggcgaaggagccatcacctacctggtgacaagcgtgctgcgtgtgtcagctgaaacctggaagcagggtgcccagtactcctgcatggtgggccacgaggccttgcccatgagcttcacccagaagaccatcgaccgtctgtcgggtaaacccaccaacgtcaacgtgtctgtgatcatgtcagagggagatggcatttgctactgagccaccttgcctgcccctactccttaaataaactctgtgctcatccaaagtatccctgcacttccatccagtgcctgtccatcatccttagggtctacaaaacactgggaggggtcagggcccagggaaggaggaacccccaccacctgagcttgtaaggcctcagagactctgaaggacctacatgcctagagtatatgtgtatgcatgtatacgtattagtgagtgcctttgcgtgtgtacctgtgtgtaacaagagaggagtgagtttgtgcgtgcctacgggtttatataggtatgtatatgggcataagtgcatacgcctttaagtgtgagcatatctgtgtccccgtgagcacatgtgtgtctgtgtatgcctatgagtgtgcacgtatctgtgtatgctcatgttggtggaaacatgtgtgcctatagtgtgtgtacctgccaggtggatgtgcaatgaaagggaggtgagaatgggggtgaagtccgagatgagcagattcagccaagacaggcaaacctcaggggagagtcccaagagcagtgggttgctgcagaggtactctgaatggtacttctgaatggtggtgtggctgtctgagtataagattacagcttttgtcccaaacaagaaagggatagatggagcaagagagtagcaagaccaaggctggtactgcctgggagtcacaataggaacggtagaggagtgaggagatgaatccaaggggcactgggaagaagatgccacccaccctcagtgggccagccctgaatggagacgtgcatagccactcagggtgaccactgactcatgagaaagagacataacatggcacagacagccctcagcagcaccctgctctgcatatatgcacatgggcatacaccctggtctgcatacaggtacatgggcatacacgcacatacatttgcacactcacacagacccgaaccctggaggaggacgaagttcacagcccacacgcagcttctggaaagcaatgggagtcccctcccaagcccaaccatgacaactcatggacaagtctataagctcctccaggtggcccctttctaacctaagtctcccttcccatcctgagcccaagtataacaaaccagaaacagggtatgtggcaagctgggaaaagacaggagcaggccatagagaccactctcacacaggccttggcctcctccatgggcacccctagaacacaaagttctacaaccaggtacacttggcacccagatgcccacaagagggcagtggggcccctgctcctgtctcacgggccttcagaacctctccaggggcctggtttctagcaacttccctctgctgtcagagcaaggcccatgcacaccctggataccctccagcttgaaagtccacttccccgaggatagcaaaagcgacaggccagctttggaaacctgacccagaaaagcacgatagccacccatggaacccaaggcctggtccaaaacagaattctagtaaggaggagccaataggtgaaagactgaacacacacagggagagaagacagaggagcacgatagtcgagagaggggggctggtgggtgaggcgatgagtgagtgactggaacaaggttgggtggatatgcagatgaatgatgggaatggtggatggactgatggatggctgcagtgacagaaatatgagtgactgagtatcggcacacagtccctacctccacttaaaatcaaagttctatgcgcggagactctgagggcagtggggttgtctctaccgggagactttagtgttggttaacccccccccaagttctttataatgcaacagaatcctctgaccacatgtccaccccttggtattccaacctcggcccagaaatcaccttggcctgtatctgtttgagagtgtccgatcttaccgaaccctagtacccaggccaagttcaacctaagaactggggcttttgtgaggtgttgctaaatgtctagagaggtctgagacaagtggccttgggctcaaactcttctcagagcctcaaagacagaaacaactctcttaccatgatagttctctaattaagatcccctgagggaaagagagagagtcaggtcttggggggcatctcaagaacttcaaggattccagccccttacctgggaccctgccttctcattatcccagaacaagtcccttctcagagataaggaacccctgccaccaccgtccccaaagcccaagggggcatagaaacagaggccttaagcctgagcccccatccccatgggtttggatctagaaggtcatctatgtcttacagaatgccaagagccaccttcctacgtgatactggaccagtcacaagacatcctggaggaagagaccccgggtgccagtctgtggcccaccgctgtgaccttcctcaccctcttcctactgagcttgttctacagcacagcactcaccgtcacaactgtacgaggcccatttggcagcaaagaggtcccccagtactgaccaggagccagccacaggtggctgtcatggagacggtggggtacagggtgggggcaggggccttgaggatttactcagcccctccacatgtggccttgcaacccttcacagacatcaaggaagtggaaggaagtagaaggaaattatggcagcacttcctgggtttaacccagtcttccagaagccaggctgagacctcagcaaaagcaaagacataacccaactccaggatcctcccctctggctgaccacttgtgtctttgcacggatgaagcttggagaaagtcctctatgtttcagagactgatgtgacagcttcccacccgactcccatactttgctgagcaataaactggtgcaaaagcacagtttcttactctcaaaaacaaaagttaacaaaggattgggtgagggggtcagagatagtgtggtggtgccatgctaaactgttgcttacggtatagaatgtggcagcattgggcagggcagacacagggtgaccactgtctagtatccgagacaaccgtgtgtagctgtagccaagatgaacactgactgacttcaacaagtatttgtggcctcttcagacccaataccaggccattagcttgatctctggacctgacttctaaacatttggcctctgtgaacacccttgccaaacactggtcctggttgtgaaccttggtcctgaatactgagccttatcttggtaactgaaccataatcctgatccctgacctcagtcacgatcatgaaaccctggtcctggccactcgttccaataactggtccctagtcctgagccctgagtcctggtccaggtcactgaatcctggtcatgatcaatgggtttggtcctcattcctgagcctagtcttgatcactgatcactggttctgatcattaacaactaacctgatcactagtccccattcctaatcactgggccgcgatactgatcactgaaccctgtttctaaacaatgtgtagtgaaatgtatggtaaaacctttgcatctggctttgagtgaaatgtttcggcagacctttgctatgttttgggttagtcaggaaaggctgagaaatggttttgaggctgtttgaaccttgaagaaatgttgtctccctggacaatctgcacttggtactacattaaggtttgcagttgcacacaccttggtcctaaacactcctggcagacttagaactcttacgtttgattatggctagccatagttgaaaagggctgagagttgtatgggtggtctgctctctctcgcagcaagggcaagatgactttggtagttgaaaactttcccagccccaactaactctgtataatgtttgaataaagtaacggcagtaggctagttgtggttaatttttattccaagaagaatgaacccctctgctccttcagaaaaggaaggcttagcattttggtgagcttctctctactgaggcacctatgaccaactcagtgttctttgattcctgtcaccacatccagtcttgatcactaagtgccagtcctcatcactaaaccctggtctccaccagtctgcttgggttctgataatcagactcacattctgataactgggccctgattctggtcactagctctttgccctggtcatggacatttgaccctagtccacggcactgagttctgggcatggaccctgggccctagtcctaggtactgggttctggttctaacaactaggtcctgtactgatcaatgggccctgacctagacattgggccctggtcctcaacatcaacttctaagcctgaactctagccccaaattctgcttatcaacactggtcctggaccttggtcctcatcacacatccattctctgagacccaaggaatcagtggtattttgcaagaagtccctttgatattccaagcctcattctcattaggaagatctcttcaggggattcctgcagaaggttccagaatccccaccacactgttcacatactgggctgcaactgggacagtgaccccttttgctcatggaaacaaagcaggcccaggccctgtgagctggagcctctggcctggggtctacagatgtggggtcagcattgtggagaaggtttgcagggcaggtgtgggggtagggcagggatggtcacattagcatcttgtttttctttcttctgaagtctctgttttctatcacctgctgaaacattcaaagtagctccaagctgaggccagctgagtcatcctgagcctatctcagcccaggtgcctcaaaacagagctactgttctgagaatcacaccaccctggaccaggccaggtgggtctggggctggatgaggggtcagagccaggggagccctgacagggactgagaaggccccaacccccatcactcaaggttctccacaaccatccacagtcatgccttagtgaggccatgttctgtcccaatgagaacaagtccaattaagattaagtctggtcttcccagggtcattcagtgtcaaggagtgtcaaccaaggccagccaaggccagcctgaggtcagccagcatcacccaaggacacacaactattctagtagacaactagaatagtcagctcaacagggccctggtgatgcaaaatggagagtgtattcctgccagacagggctccacagataggctccctcactgcatatgacctccctgaatgtttcccacactgcagttggttctagactacttcttgataagcatgcagaaagataacaggataagaaattttatgcagagaacagaagtatctacggaatagaatagaagatagatagtagaagtctgctacaggccccagtggagtctctttgtagagtcaagagatcaaacctaaactgagtctcaggattgagtccagtacagaagcaaccttcaggatgctaaagaccatacaggcaatggacagaatggagtccagacagaccaatgagtggacagtccaatctcacataatgaaccatgtcaagagcagatagtgagccaaagaaggctctgggacactcggagattctcggcctctggatctcctgatgtatataccaggtgatcaagtgacagtctagtggagccattgccatcacagtgtcaggtgtcctccccttcatgggttccggtgaggatgtggcacctccctttagttggacgtgtacaataaattctcaggcctggtatgatttttaatgatccatgtgtttctatagtcttaattatctttaataaaattatagggtgacaccaaatttagggataagttatttatcaggctgtgcctttggaaggtgacgttatttacatagccaccaaggtgcccagtcatcggcccatcttccaaacggagtcaagggccatttgaaacagtgaaatccctcagggcaagggacacaacatggaggaatttaaaacagagtacagcttgatcttaacacacacacacacacaaacgtaagagatggaaaaggggatcaagggacacagaagtacagagaaaacaagacagtaagggatgtagagatgagaggtaaccacagggaaaggtgagacacaaagacgagaggagaaagacacagggacagaaagacccatgcaagcaagagagacagacataaggaagaaaaggcgagaagagacagacaaaggtgcagcaatgtggcccacctggtactcacaagaaggccctggcacacactccgatgagagccatgcacctacaaacacgtagacacagctccacacagacacacacggcatctgcacaactgtctgaacctcaaacaggtctgcccactccctctcctccaggcctttgtccttaggaaggcacgctgagggtaactcagtcgggatacttctgattggggctcactgaacagcctgaggctgggtccacagttgctctcactgtctggccctgtaccccaggtcatgcttcagagggaattaactgaatgcagtaaacaccgtctgtggtcagcatgtactaagggatagaaccctatcaggatttgtccaactaaggtccaaatacagagtgaagaagacgatgggggagatcagatggcagatgggagcactctggatagagctcagggatatggtggctgaggaacattacagctgccaggcttggcctttcatctcagctctaggtcaaggggaactacccaggtctctgctttgttgctggtaactatacctaagtctaagaacctcagtaagacacagaaccagtaagacgacagcctccatcgataagaaagaaaggagaaaggcagaatggataagtctctggacagatgagagcctacacccaaaaacagttcgttcagccagttaatagggtgtagccctagcacacgagagaaaacagttccacaggtgtaagggagtaaatctgtgcgaaggggtactgcttgagctcctcatggcctggtccagaagcagaagctgggcaggggcaaaggacagggtaaggcagggagacaggggcatgaaggagcctttgggactgtgtggtgagaactaggctgtgcttttactgagcctgagtttgtggcagttgcctcatggggaaggcacccagaggtaaggcagaggaaaggagtaactagggctgagggcaccacagggtctgaggaattagaggcagctatgacccatttgtcatggtatttggacatgtacttcatggacacagatctgagaaccaggcctggctctcactaaccagcaggaggtgtcccacttgtggctgtaggtctttcagcacaccatgccatgggcctctcacactggacgatctgtctgaaaggctgatgttgggaggtgggagcccaggcctggggtctgggacactgggtgacagaggtgtccagaatgtagagtgctcagagtgtgggtggggacaagctgtagagtgtccccatgaggggacaggctgagatagggactgaagtccatctacaggcttaccacactccatgctctggatgagagcactgagctctgccaccctacaacagcaggcagagcggcctccatgctaggaaagccaggcagcagggacagagttcctggatggggcaggtggaattgtctctgctcggcatcaaactaagtggaccttcagcagtaaggtcttactgtctagtcatggtggacagccaggaacatagtcaatgaacagcctgctttgtttggattcctctggagacttcctgatcaataacttgtaggcctccatgtttcatgtgacaacttacatctctctatgtataacatgggctttctgtgtagtcctgggtatcctagaacaccctgtgtagaccaggctggcttcaaacttgggacatcctcctgtctctgccttctaataaatgctgggattaaaggctgtgccaccacacacaatctaacccatttcttctgggaataacactgttcacccagccatacactgagttaaaattccttaataaatgttagttcatttacaaaatagtggatttccataaggcttcttcatggatcctaatccaacttttaccttctcttttccccaatcctccaatccccctattcccacttaaatctgaaatccccctccctccattttcaagctgcctgtgttctatgtcccctcatattgtttttttcttgtgtggaggtttgcagatttgaatgcaggaacccttcactggggctaagcctcctgccacccagcacttcccatccccacacctcctcacgcttgatttagcccatgtcccctcatgtgtatgggtgtttctcttcagtctgaggcattactccccgtgtcctctggagagctgcctactgtcacagatacctttcttctgtttctgctagggaaagcttttatttccccttgaattttaatcattgtctgggtgtaataccctgggttgagagctgtgttctttcagaacttggactacgtctatccaggcatctggctttaaagtttctactgtggggctgcagagatggctcagtggttaaccacacatttcttcttgcagaggacttgggcttgattcctagtacctccgtggcagctaagaaccatctgtgactccaactgcacaggattcgatgcccttttctggaggtcatctggagtagtcagctcaacagggccccgggatgcagcatggagagtccatgctgacaggcagggctccacagagagagaaagacagaaacacaggccactgaaagagacagtaatggactgaggggacagagagaaacacacggacagacagacagagataacaaaacaccgacactcatagacacagagaagagaggggacagggaagttttgagagcaatgggtaggaggtgagagagacacagaggcaatacatacagagagtgactccagaagacagagtctgagaggagacactgcaagagacagagaccccaaaagggttgagagcactggatgctttcacagagaatccagattcgattcccagcaggctcatggcagctcatactgcaatcccagttccagagtgccctgaaggatccttcatgcatgtggagcacagaagcgctctctctctctctctctctctctctctctctctctctctctctctctctcagatgaaagccatgaaccagaagacagagacatgagtgaacactcctcagagacatagccacagcactcacacccagttccacacagacacatacagcacctgcctgcctgatccaaaccccaaacccattgacccactccctctcctccaggtctttgttctcagagtagcacactgagggtagctcagcctggatacttcccaaggggcctggacacacagcatgcatctctggtccacagcccccatcccttgttggccctgtaatccatgtgatgtctcaggagaagatgttgtctgagagcagggcctggtacagtgtccctggtacagtgtccctggtacagtgtccctggtacagtctctctagtaaagtctctctggtacagtttccctggtacagtcttcctggtacagtgtccctggtacagtctctctggtaaagtctctctggcacaggatgcctagtatagtctttctggtacaatctgcctggtacagtctgcctagtacagtcttcctggcacagtctatccctggtgcaggcttcaggtcaggcccaagtgtgaagagtgcagaagacagtgggcagagctgagagagcgctagtcagttttgttcagagaacagtgatggccgctccaggctactggacatcccaggtgtgcttcttacacttctcaaagctgtgggaacacaaccgaccctctactcacttcagtgtaattgcctatagcagggcatgcctctgggcatcagggagtcacacagaggcaggtaagactctagacctggggactgagaggggaaggcatgtacaagagggcctcatccttaggacacagggattcgaggcctctggatagccagtgagcaacatatgcagagtgatgaggccccaggagtctaatggacgccaggaggtcacagagctagaggcctggagggctagagtctgtgggaagggggactgcttaggttcttcccacccatgtccaggagcagaggctgggcagggccacaggacagggtaaggcagggagacaggggcatgaaggagcctttgggactgtgtggtgagaactaggctgtgcttttactgagcctgagtttgtggcagctgcctcatggggaaggcacccagaggtaaggcagaggaaaggagtaactagggctgagggcaccacagggtctgaggaattagaggcagctatgacccatttgtcatggtatttggacatgtacttcatggacacagatctgagaactaggcctggctctcactaaccagcaggaggtgtcccacttgtggctgtaggtctttcagcacaccatgccatgggcctctcacactggacgatctgtctgaaaggctgatgttgggaggtgggagcccaggcctggggtctgggacactgggtgacagaggtgtccagaatgtagagtgctcagagtgcgggtgggaacaagctgtagagtgtccccatgaggggacaggctgaggtagggactgaagtccacccaaggctcaccacactccatgctctggatgagagcactgagctctgccaccctacaacagcaggcagagcggcctccatgctaggaaagccaggcagcagggacagagttcctggatgggacaggtggaattgtctctgctctgcatcaaactaagtggaccttcagcagtaaggtcttactgtctagtcatggtggacagccaggaacatagtcaatgaacagcctgctttgtttggattcctctggagacttcctgatcaataacttgtaggcctccatgtttcatgtgacaacttacatctctctatgtataacatgggctttctgtgtagtcctgggtatcctagaacaccctgtgtagaccaggctggcttcaaacttgggacatcctcctgtctctgccttctaataaatgctgggattaaaggctgtgccaccacacacaatctaacccatttcttctggaaacaacactgttcacccagccatacactgagttaaaattccttaataaatgttagttcatttacaaaatagtggatttccataaggcttcttcatggatcctaatccaacttttaccttctcttttccccaatcctccaatccccctattcccacttaaatctgaaatccccctccctccattttcaagctgcctgtgttctatgtcccctcatattgtttttttcttgtgtggaggtttgcagatttgaatgcaggaacccttcactggggctaagcctcctgccacccagcacttcccatccccacacctcctcacgcttgatttagcccatgtcccctcatgtgtatgggtgtttctcttcagtctgaggcattactccccgtgtcctctggagagctgcctactgtcacagatacctttcttctgtttctgctaggggaagcttttatttccccttgaattttaatcattgtctggctgtaataccctgggttgagagctgtggtctttcagaacttggactttgtctatccaggcatctggccttaaagtttctactgtggggctgcagagatggctcagtggttaaccacacatttcttcttgcagaggacttgggcttgattcttagtacctccgtggcagctaagaaccatctgtaactccagctgcacaggattcgatgcccttttctggaggtcatctggagtagtcagctcagcagggccccgggatgcagcatggagagtccatgctgacaggcagggctccacagagagagaaagacagaaacacaggccactgaaagagacagtaatggactgaggggacagagagaaacacacggacagacagacagacagacagacagacagacagacagacagacagagatagataacaaaacaccgacactcatagacacagagaacagaggggacagggaagttttgagagcaatgggtaggaggtgagagagacacagaggcaatacatacagagagtgactccagaagacagagtctgagaggagacactgcaagagacagagaccccaaaagggttgagagcactggatgctttcacagagaatccagattcaattcccagcaggctcatggcagctcatactgcaatcccagttccagggtgccctgaaggatccttcatgcatgtggagcacagaagctctctctctctctctctctctctctctctctctctctacactgtccccatgaagggacacgctgacgtacggactgaagtccacccaaagctcaccacactccatgctctggatgagagcactgagctctgccaccctacaacagcaggcacagcggcctccatgctaggaaagccaggcagcacggacagagttcctggatggggcaggtggaattgtctctgctcggcatcaaactaagtggaccttcagcagtaaggtcttactgtctagtcatggtggacagccaggaacatagtcaatgaacagcctgctttgtttggattcctctggagacttcctgatcaataacttgtaagcctccatgtttcatgtgacaacttacatctctctatgtataacacgggctttctgtgtagtcctgggtatcctagaacaccctgtgtagaccaggctggcttcaaacttgggacatcctcctgtctctgccttctaatccatgctgggattaaagcctgtgccaccacacacaatctaacccatttcttctggaaacnnnnnnnnnnnnnnnnnnnnnnnnnnnnnnnnnnnnnnnnnnnnnnnnnncagtggcacacacacatacacacacacacacacacacacacacacacacacacacacatacactctaatgaaggcagtggcgcacacacacactctcagatgaaagccatgaaccagaagacagagacatgtgtgaacactcctcagagacatagccacagcactcacacccagctccacacagacacatacagcacctgcctgcctgatccaaaccccaaacccattgacccactccctctcctccaggtctttgttctcagagtagcacactgagggtagctcagcctggacacttcccaaggggcctggacacacagcatgcatctctggtccacagcccccatcccttgttggccctgtaatccatgtgatgtctcaggagaagatgttgtctgagagcagggcctggtacagtgtccctggtacagtgtccctggtacagtgtccctgggacagtgtccctggtacagtctccctggtacagtctccctggtacagtctctctagtaaagtctctctggtacagtttccctggtacagtcttcctggtacagtgtccctggtacagtctctctggtaaagtctctctggcacaggatgcctagtatagtctttctggtacaatctgcctggtacagtctgcctagtacagtctccctggtaaagtctgtccctggttcaggcttcaggtcaggcccaagtgtgaagggtgcagaagacagtgggcagagctgagagagcgctagtcagttttgttcagagaacagtgatggccgctccaggctactggacatcccaggtgtgcttcttacacttctcaaagctgtgggaacacaaccgaccctctactcacttcagtgtaattgcgtatagcagggcatgcctctggacatcaggaagtcacacagaggcaggtaagactctagacctggggactgagaggggaaggcatgtacaagagggcctcatccttaggacacagggatttgaggcctctggagagccagtgagcaacatatgcagagtgatgaggccccaggagactgatgggcaccaggaggtcacagagctagaggccgggagggctagagtctgtgggaagggggactgcttaggttcttcccacccatgtccaggagcagaggctgagcagggccacaggacagggtaaggcagggagacaggggcatgaaggagcctttgggactgtgtgatgagaactaggctgtgcttttactgagcctgagtttgtggcagctgcctcatggggaaggcacccagaggtaaggcagaggaaaggagtaactagggctgagggcaccacaggatctgaggatttagaggcagctatgacccatttgtcattgtatttggacatgtacttcatggacacagatctgagaaccaggcctggctctcactaaccggcaggaggtgtcccacttgtggctgtaggtctttcagcacaccatgccatgggcctctcacactggacgatctgtctgaaaggctgatgttgggaggtgggagcccaggcctggggtctgggacactgggtgacagaggtgtccagaatgtagagtgctcagggtgcgggtggggacaagctgtacagtgtccccatgaggggacaggctgaggtagggactgaagtccacccaaggctcaccacactccatgctctggatgagagcactgagctctgccaccctacaacagcaggcacagcggcctccatgctaggaaagccaggcagcagggacagagttcctggatggggcaggtggaattgtctctgctcggcatcaaactaagtggaccttcagcagtaaggtcttactgtctagtcatggtggacagccaggaacatagtcaatgaacagcctgctttgtttggattcctctggagacttcctgatcaataacttgtaggcctccatgtttcatgtgacaacttacatctctctatgtataacacgggctttctgtgtagtcctgggtatcctagaacaccctgtgtagaccaggctggcttcaaacttgggacatcctcctgtctctgccttctaatccatgctgggattaaagcctgtgccaccacacacaatctaacccatttcttctggaaacaacactgttcacccagccatacactgagttaaaattccttaataaatgttagttcatttacaaaatagtggatttccataaggcttcttcatggatcctaatccaacttttaccttctcttttccccaatcctccaatccccctattcccacttaaatctgaaatccccctccctccattttcaagctgcctgtgttctatgtcccctcatattgtttttttcttgtgtggaggtttgcagatttgaatgcaggaacccttcactggggctaagcctcctgccacccagcacttcccatccccacacctcctcacgcttgatttagcccatgtcccctcatgtgtatgggtgtttctcttcagtctgaggcattactccccatgtcctctggagagctgcctactgtcacagatacctttcttctgtttctgctaggggaagcttttatttccccttgaattttaatcattgtctgggtgtaataccctgggttgagagatgtggtctttcagaacttggactttgtctatccaggcatctggccttaaagtttctactgtggggctgcagagatggctcagtggttaaccacacacgttgttcttgcagaggacttgggcttgattcttagtacctccgtggcagctaagaaccatctgtaactccagctgcacaggattcgatgcccttttctggaggtcatctggagtagtcagctcagcagggccccgggatgcagcatggagagtccatgctgacaggcagggctccacagagagagaaagacagaaacacaggccactgaaagagacagtaatggactgaggggacagagagaaacacacggacagacagacagacagacagacagacagacagacagacagacagacagacagacagacagacagacagagataacaaaacaccgacactcatagacacagagaacagaggggacagggaagttttgagagcaatgggtaggaggtgagagagacacagaggcaatacatacagagagtgactccagaagacagagtctgagaggagacactgcaagagacagagaccccaaaagggttgagagcactggatgctttcacagagaatccagattcaattcccagcaggctcatggcagctcatactgcaatcccagttccagggtgccctgaaggatccttcatgcatgtggagcacagaagctcgctctctctctctctctctctctctctctctctctctctctctctctctctcagacacacacacacacacatacacacacacacatacactctcaaatgaaagccatgaaccagaagacagagacatgtgtgaacattcctcagagacatagccacaacactcacacccagttccccgcagacacacaaatcacctgcctccctgttccaaatcccaaacccattaactcactccctctccttcaggcctttgatttcagagtagcacaccgagggtagctcagcctagacacttcccatgggacctggttacatagcgtgcacagggccacctcttgttggccctataacccatgtgatgattcaggaaaagatgttgtctgagagcagggcctggtacagtccccctggtacagtccccctggtacagtctctctggtacagtctccttggtacaggcttcctgatacagtctctctggtacagtctctctggtacaatctgcctcgtacagtctccctgatacagtctgcctggtacagtctctctggtacagtctgcctggtacagtctccctggtacagtctccctgatacagtctgcctggtacagtctctctggtacagcctctctggtacagtcggcctggtacagtctccctggtacagtctccttggtacagtctccctgatacagtctgcctggtacagtctgcctggtacagtctctctagtacagtctgcctggtacagtctgcctgatacagtctgcctgatacagtctgcctggtacagtctccttggtacagtctgcctggtacagtctgcctgatacagtctgcctggtacagtctctctggtacagtctccttggtacagtctccctgatacagtctccttggtgcagtctccctgatacagtctctctggtacagtctgcctggtacagtctccctggtacagtctccttggtacagtctccctgatacagtctgcctggtacagtctccctggtacagtctccctggtacagtctgcctggcacattctatccctggtgcaggcttcaggtcaggcccaagtgtgaagggtgcagaagacagtgggcagagctgagagagcgctagtcagttttgttcagagaacagtgatggctgctccaggctactggacatcccaggtgtgcttcttacacttctcaaagctgtgggaacacaaccaaccctctacccaattcattgtaattgtctatagcagggcatgcctctgggcatcagggagtcacacagaggcaggtaagactctagtcctggggactgtagaaggtatgtaagtacaacagggcctcatccttggaacactggtgtctcaggcttcaatacagccagtgagaaacacatgcagagtgatgtggccccaggagactgatgggcaccaggaggtcacagagctagaggcctggagggctagggtctgtgggaagggggactgcattcactcttcctatgcttgcccaggaacaactgtctatgcagggccacaggacagggtaaggcagggagacaggggcatgaaggagcctttgggactgtatgatgagagtctaggctgtgctctgactgagcctgagtttgtgacagctgtctcatgaggaagacacccagaggccagacagaggaaaagagtaatcagggctgagcggaccacagggtctggggacgtggaggtggctggcctggctcccacaggccctcagatggagctgcacatcatcccatagcatatcactctggagggcttatcaaaatggttgtgctgtgggactgggtttcaggactgaggcctgagatactgggtagcagaacatgttcagtatacagggtgctcagagtacgggggggggggggacaagctctgcagtgttcctccatgttgggacaagcagaaagaggtcttgaagctgtttgtccatccataggcctaacccatactggccctgctcatggccctagcttgggccacatatctagtgcccactgaatcatcaccatgaagactgttggaaaaccagagcctctgatgtcttcctgccttgcttgctctccctgactctcatagctcacacaggctctgccctggtccaccactgtcctcaactgtaaaccatgccaggcacagagagcaaggaatgtggtggtctcagactgtcacacacaacaatcttgtgcctttcacatccacacgcacaagcatgctcatacccctctgtcaggggtcagtggggtcttccttgggctcactcccatttctagctgctccttggtattggtgactgcggctgctgtgtcggtggctgccagagatgcttgatcggcatgacctcagatataggaatggcctggggtcaacagagtgcacacacttagggcactggccagagttctatgtagaccaaggcctctcttcctagtgtgttatttcacaaaaccttatgcaacaacatcttctattccttttattcctctttgtctgctaatggggaattttctagaaagagtgtcccctctctgtcttcctgctgtgtagacagatcttgtaggtgtgatcacagagtggtgtttcccttcttggccattttcaggccaggaactcagggccagagacagaaagtcaggaaggtaggaaagacagggagacataataaaggtgagatggagacagagaaagacaaagggagaaaagcacaggattgcagggagagacaaggagacgcccgacggaaacagacatcagggaaaagacatgattgttcctttagtaaattgctttccggagaaaagagacagcagagagacatggataggcacacaaagatacaaggagagagacaggaaacagagaaagagagaaacagagatggagaaacaacgagggagagagaagagtagagagaaagacacggagaaaaaaaatcaagaaacagaaaagacaaaagataggaagacagagaaataggccagaaatacagacagacagagagatgcctgaagatgttctctctcacctagagaaagaaagcacaggcagagataatacagagagagagagagagagagagagagagagagagagagagagagagagagagagagagaggagagaaagaggagagacacggtgttagaggagaaagcattatgttttgatagagacagagatacagcaactgaggaacagactgagcagaaagaatcccactcagagagagacagaggctaagctgggagaggcaggggtggccagagagggagacagaggagagcctgtgggacaggtcagacaccatcttggaagacccagtgacaagccagggaggtgacaggttagtgcagtttctaccccacagtccacaggctggagccacaggcctgtgtccatgtggccacaggctagctcccagcctgccaagcctgtctgtggagggattgcggagtggggctgggctgaggcaggccaggatttttccagtggagcagccagtgactgggctgagggtcactgcccaccatccccgtgattctgggtagacccaggacctggagcacacacagccttcctgtctctcccacttccctggggtgtttggaccttgcctatctcctgtcattccctcctagggtcagattccagcagtgtcgataaatgggaaaacactgaattcaatgtcaccgttaggggtcatggaacccccagccccatccccaaagctggtcaacctggccagggtggggtgaacctgcagctgcaggtgggggaatcattgatgctatttttggctcagagaatgagaaacatgtttttctgcatggaacaaacatccatttgcatgtgccccgagggccaaccctgcacagagtgagtcactcggcaggtgtgtgtgtgtgtgtgtgtgtgtgtgtgagagagagagagagagagagagagagagagagagagacagagacagagacagagacagacagagagacagagagacagagagagagacagagagagacacacacagagacagagagacagagagagacagagacagagagagacacacacacagagacagagagacagagagagagatgttgtgagcaagccctgtttcaggtactgatatctgtgcccccgtgccccagcccatgtggaaaaactacccttaggggcccattaactcatcacagtccaggccatcatggtgagccctagctgacctaagcaggttccaccctaaacatgaaggaaaataataaaggccatctgttacccagaatcctagggatggtgggcagtgaccctcagcccactcctggccgctccactggaagaatcctggcctgcctcagcccagccccactccgcaatccctccacagacaggcttggcaggctgggagctagcctgtggccacatggacacaggcctgtggctccagcctgtggactgtggggtagaaactgcactaacctgtcacctccctggcttgtcactgggtcttccaagatggtgtctgacctgtcccacaggctctcctctgtctccctctctggccacccctgcctctcccagcttagcctctgtctctctctgagtgggattctctctgctcagtctgtcagccatagttggagagagtccatctatgtttgcctctgtctctgccaattccatcagaggtctctctactaacacttgcctctgcatgtgtctcttggtccttctcctgtcttcccatctctctatctcctcatctctctgtctttctgttactccctgtctctgtctctctgtcttttctctcactgtctttatctctctgcctgtttcatggacttttctctgtctctctgtctctgtctctctgtctctctctctgtctctctctgtctctgtctctctctgcccctatctcttggtctctatctctatcttcaactccctatctttgttcctcatactcacatttacctctttcccaagcccccagtctccaggtctgcctgtttctgtctctcccttgccatgtttccctgttttattctctctcctcctgaatgctctggcttgaaactggccaagaagggaaacaccactctgtgatcacacctacaggatctgtctacacagcaggaagacagagaggcgaccctctttcaccctacagtgtctggacttggttgattccaggttactcctatactcaagtccgggactatggtggtcaagcatctctggcagccactgggacagcagctatagccaccaacatcgagccctgttagctaccaacattagctcctcaaagaggttgggtctataggcctctggtgtgaggagatgttgacagtgagaattagttcccaaggaggacaccactgtttcctgttagatggagaactacagtgggtacgaacatgcttgaacacatgagtgtcaaatgcacaagactgttgggtgtgtcacccttcccctctctgttcatggcatgactgcacactgaacacaatggtggattgggacagagtctgtgtgagttgagaatcatgaagagtgtagacacttcaaggatagtgtagacccttctagttcgtggtgatggctcacttggcactgagtttctgaccccacagggaccatggacaagggcagtatgggctgtgcctatggatacaaaagagacttcgaagcctgtattagcctgtcccctcatggaggaacacagcacagcttgtctctacccacactctgagtactctacgtcctggacacctctgtcacccagtgtcctaggtcccatccttggctcccacatcacatctgcctttcagacagatcttccagtgtgacagacccatttcatggtgctgaacaacataaacccatttcctgagggttggtgagagccggcctggttctcagatctgtgtccatgaagtacatgaccaaataccatgacaaatgggtcatagctgcctctaattcctcagaccctatgggccctcagccctggttactcctttcctcggcctggcctctgggtgccttccccatgaggcagctgccacaaacccaggctcagtcagaacatagcctagttcctaccatacagtcccaaaggttgcttcatgcccctgtctccctgccttagcctgtctgtgctcctgcacagacaagagttcctgggcaagcataggaagagtgaatgcagtccctcttccaacagaccctagccctccaggcctctagctctgtgacctcctggtgtccattagactcctggggcctcatcactctgcatgtgttgctcttgtacatgccttcccctctcagtccccaggtctagagtcttacctgcctctgtgtgacttcctgatgtccagaggcatgccctgctatagacaattacactgaagtgagtagagggtcggttgtgttcccacagctttgagaagtgtaggaagcacacctgggatgtccagtaacctggagcggccatcactgttctctgaacaaaactgactagcattctctcatctctgcccactatcttctgcacccttcacacttgggcctgacctgaagcctgcaccagggacagactttaccaggcagactgtaccaggaagactgtaccagggagattgtaccaggcagagtgtgccaggcagactgtacaaggcacactatatcagagagactttaccatgcagactgcaccagggagactgtaccagggagactgtaccagggagactgcaccagggagactgtaccaggccctgatctcagacaacatcttttactgagacatcacatggattacagggccagcaagaggtgggggctgtggaccagaggctcatactgtgttaccaggtcccatgggaagtgtccaggctgagctaccctcagtgtgctactctgagaacaaaggcctggaggagagggagtgggtcaatgggtttggggtttggatcaggcaggcaggtgctgcgtgtgtctgtgtggaggctgggtgtgagtgctttggctatgtctctgaggagcgttcactcatgtctctgtctctggttcatggctttcatctgagagagagagagagagagaaagagagagagagagagagagagagagagagagagagagagagagcgcttctgtgctccacatgcatgaaggatccttcagggcaccctggaactgggatttcagtatgaactgccatgaacctgctgggaattgaatctggattctctgtgaaagcatccagtgctctcaacccttttggggtctctgtctcttgcagtgtctcctctcagactctgtcttctggagtcactctctgtatgtattgcctctgtgtctctctcacctcctacccattgctctcaaaacttccctgtcccctctgttctctgtgtctatgagtgtcggtgttttgttatctctgtctgtctgtctgtctgtctgtccgtgtgtttctctctgtcccctcagtccattactgtctctttcagtggcctgtgtttctgtctttctctctctgtggagccctgcctgtcagcatggactctccatgctgcatcccggggccctgctgagctgactactccagatgacctccagaaaagggcatcgaatcctgtgcagctggagttacagatggttcttagctgccacggaggtactaggaatcaagcccaagtcctctgcaagaacaacgtgtgtggttaaccactgagtcatctctgcagccccacagtagaaactttaaggtcagatgcctggatagacaaagtccaagttctgaaagaccacatctctcaacccagggtattacacccagacaatgattaaaattcaaggggaaataaaagcttcccctagcagaaacagaagaaaggtatctgtgacagtaggcagctcttcagaggacacggggagtaatgcctcagactgaagagaaacacccattcacatgaggggacaggggctaaatcaagcgtgaggaggtgtggggatggaaagtaatgggtggcaggaggcttagccccagtgaagggttcctgcattcaaatctgcaaacctccacacaagaaaaaaataatatgaggggacgtagaacacaggcagcttgaaaatggaggatgcttttagcattaaagatttacagtgtagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcattcctctttttttggcggccgatggcggttatattccttgcgtctcccgtatccagaaataataatcattcaaaacggtgttctcctcagccagtgtatgccttttggattttgcttccagcagcaccgagtggagaggagaggagaggagaggagaggagaggagaggagagatgttcagttatccaaaactaaggatccatgaagaagccttatggaaatccactattttgtaaatgaactaacatttattaaggaattttaactcagtgtatggctgggtgaacagtgttgttcccagaagaaatgggttagattgtgtgtggtggcacaggctttactcccagcatttattagaaggcagagacaggaggatgtcccaagtttgaagccagcctggtctacacagggtgttctaggatacccaggactacacagaaagcccgtgttatacatagagagatgtaagttgtcacatgaaacatggaggcctacaagttattgatcaggaagtctccagaggaatccaaacaaagcaggctgttcattgactatgttcctggctgtccaccatgactagacagtaagaccttactgctgaaggtccacttagtttgatgccgagcagagacaattccacctgccccatccaggaactctgtccctgctgcctggctttcctagcatggaggccgctgtgcctgctgttgtagggtggcagagctcagtgctctcatccagagcatggagtgtggtgggcctgtggatggacttcagtccctatctcagcctgtcccctcatggggacactgtacagcttgtccccacccgcaccctgagcactctacattctggacacctctgtcacccagtgtcccagaccccaggcctgggctcccacctcccaacatcagcctttcagacagatcgtccagtgtgagaggcccatggcatggtgtgctgaaagacctacagccacaagtgggacacctcctgccggttagtgagagccaggcctggttctcagatctgtgtccatgaagtacatgtccaaataccatgacaaatgggtcatagctgcctctaaatcctcagatcctgtggtgccctcagccctggttactcctttcctctgccttacctctgggtgccttccccatgaggcagctgccacaaactcaggctcagtaaaagcacagcctagttctcatcacacagtcccaaaggctccttcatgcccctgtctccctgccttaccctgtcctgtggccctgcccagcctctgctcctggacatgggtgggaagaacctaagcagtcccccttcccacagactctagccctcccggcctctagctctgtgacctcctggtgcccatcagtctcctggggccacatcactctgcatatgttgctcactggctatccagaggcctcgaatccctgtgtcctaaggatgaggccctcttgtacatgccttcccctctcagtccccaggtctatagtcttacctgcctctgtgtgactccctgatgcccagaggcatgccctgctataggcaattacactgaagtgagtagagggtcggttgtgttcccacagctttgagaagtgtaagaagcacacctgggatgtccagtagcctggagcggccatcactgttctctgaacaaaactgactagcgctctctcagctctgcccactgtcttctgcactcttcatacttgggcctgacctgaagcctgcaccagggatagactgtgccaggcagactgtaccagagagactgtaccaggcagactgtatcagggagactgtaccaggcagactgtatcagggagactgtaccaggcagactgtatcagggagactgtaccaggcagactgtaccacacagactatactaggcatcttgtaccagagagactttaccaggcagactgcaccagggacactctaccagggacactgtaccagggacactgtaccagggacactgtaccaggccctgctctcagacaacatcttctcctgagacatcacatggattacagggccaacaagggatgggggctgtggaccagagatgcttgctgtgtctccaggccccttgggaagtgtccaggctgagctaccctcagtgtgctactctgagaacaaagacctggaggagagggagtgggttcatgggtttggggtttggatcaggcaggcaggtgctgtgtgtgtctgtgtggagctgggtgtgagtgctgtggctatgtctctgaggagtgttcacacatgtctctttcttctggtgcatggctttcatctgagagagagagaaagagagagagagagagagagagagagagagagagagagagtgtgttgctgccttcatttgagtgcttggtgggctccatgctgtacctctgccttccctgtgtgtctgtccttttgcctctcccttcctttggcctgtctctcttgtctgcatctgtctctcttgtctctccctctctgtgtctcttttctctcctgtctctgtgtctcttctttcctgtggtctctcctcatccccatgtctgcatcagtgtctatcagtctttaactctgtgtcctcttgttcccatttctgtccctctggatatttctgtctttctgtgtgtctgtcctcatctctcccagcgtccatgtctttgtgtccctttgtccccacacagtatcttctcaaatactctgtgtgcctggtcccctgtctctcattccttttctcactgctcccatcagtgtttctctgtgtctctgcttctgtgtctctgtgtgtctgtctcatgctatctctttctctctcattatctctgtctccctcagacttctctgtctttcttggtctctgtctccctctgtgtctctgtctttctgcatgtctaatgtctctgtgtctcccttagctcatctctgtctctctcaatattcccacaatcccctttattctttgtgtctctgtctctgtggtgtctctttctcagtctctctgtatttcgctctgtctctcagaatctctgtgtccctcatattatttttcgaagtgtctccctatctctttcagtaacactatttctgtttttctcagtctctctctctctctctctctctctctctctnnnnnnnnctctctctctcagaaagtctatggcacctcttctatgtgtgtcccactctggacctggatcaatcttccttcttggacctcagtttcatcagttgtgagacgataccttgccagaagtccagaggactgtctgtcctccatagtctagaccacctgtgatctgagagatattgggacaacggatgtgcagtgagggacctgcctttctgtggagccctgtctggctggaatacactctccattctgcatcaccagagccttgttgagctggctattctagttgtctactagaatagttgtgtgaccttgggtgatgctggctgacctcaggctggccttggctggccttggttgacactgaatgaccctgggaagaccagacttaatcttaattggacttgttctcattgggacagaacatggcctcactaaggcatgactgtggatggttgtggagaaccttgagtgatgggggttggggccttctcagtccctgtcagggctcccctggctctgacccctcatccagccccagacccacctggcctggtccagggtggtgtgattctcagaacagtagctctgttttggggcacctgggctgagataggctcaggatgactcagctggcctcagagtggagttattttgaatgtttcagcaggtgatagaaaacagagacttcagaagaaagaaaaacaagatgctaatgtgaccatccctgccctacccccacacctgccccgcaaaccttccccacaatgctgaccccacatctgtagaccccaggccagaggctccagctcacagggcctgggcctgctttgtttccattcagtgcctctgggaaaggcagatgagtaaaggggtcactctcccagttgcagcccagtgtgtgaacagtgtggtggggattctggaatcttctgcaggaatcccctgaagagatcttcctaatgagaatgaggcttggaatatcaaaggtacttcttgtaaaataccactgattccttgggcctcagagaatggatgtgtgatgaggaccaaggtccaggaccagtgttgataagcagaatttggggctagagttcaggcttagaagttgatgttgaggacctgggcccattgatcagtacagaacctagttgttagaatcagaacccagtgtctatgaccagagctcagtgatagggaccaagtcccaaggccaaatgatcaagaccaggacccagttgccaggaccaagatccaggtttcacaaccaaacctagttacgcagaccagaaaccattcgttggaatctggatctgaatcagagcccaatcacactactctaaaccagagttcagtgttgaggaccagggtacgtgatgagcccaagattcagagatcaagaggtggattcagtaattaagaccaggattcagagatcaggatcagggctcagttagcaggatcagggctcagtcatgtggtcatgggctcacggtccaatgtccatgcccaaaacacaactaaggacccagtggtcagaaccaaggcctgatgatcagagacaatacacactgctcagagctgaatttcagtggcaaggatgaagacataatgataaagactagggatcagtgagcagaaccagcgatgaggacccagacgcatctctgaagactagagtcagtgaccatgaccagttcaacgatcatgagtaggacttaattctgatcatacgagttcagtgatcacgaacaaggctcagtgatcatgacaagggctcagggaacaagagtgaggctcagcgatgaaaactggacctcagttatgagcccagtgatgagtaaccaggtctcggtcattagggccaggattcagtgataagaaccaagggtctctgcagggctcagtgcatcctctccccctgagactggacaaagccgcccagccacagggatggattctccagacaggcaacagcttcagggacagcccccccgtgatgcgccagagtaggggatacccaggggacttccacactctcaaagaagaaggggagaatggaacatgaagaagggactgtgaggggggaccgggaagtgggggacacagtgactgggatataaagtgaataaataaattaatggaaaatatcacatgggtgtagggaattttgaaagaataaataaaatgttaaaaatgaaaagaaaaaaagaccaagggtcaatgatcagggtgataataaataaataaataaataaataaataaataaataaataaataaataagaaaggaaagagagaaagaaaggaaggaagaaagaaagaaagaaagaaagaaagaaagaaagaaagaaagaacaaacgaactgaatgtcagaatttagggtaagatctcagtgatgaggatcagggatcagtggtttgaacgcagacacactgcccagggccattgttcaatgacgagagtcagggatcagctatcagaaccagggccagtaacgaaagccagggcccagtgaccccaaccaaaaaccagtgactaaaaccaaataaaatagaaactaggcagccacgatggtgcacacctttaatcccagaactcaggagtcaggggcagggggagttcaagacaaccctggtctacacagtgagttccaagacagccagggctacccagagaaaccctgtctagataacaaagactagaaaccatgagctcagtgatcagtggcagttcttgatgactaagaccatggtcaagaggactgatcagcaggactcagtggttagactcaggacatggtgatgatagcctctgttccagggatcagaaccaaggccaagggccaaggccatgactgagtcatcagaacagggcctctccatgagcactagtcaggcgcagccaggcctagcatgtcaatcaggcaaaattgggtatgtgtgtggtggtatgactgactatacatcgtcttagtatctgtctgaccccaccaccatcttccctgcctccgtccactcacagatctctgacgcgtcaccgcagggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcctgcaggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaagaaaccgaaatcaaaaaaaagaataaaaaaaaaatgatgaattgaattgaaaagcgtggtgcactctcagtacaatctgctctgatgccgcatagttaagccagccccgacacccgccaacacccgctgacgcgaaccccttgcggcc

SEQ ID NO: 3 - DNA, 149681 bp, Artificial Sequence
  RP11-115D9
  misc_feature (2)..(2): n is a, c, g, or t
  misc_feature (11)..(11): n is a, c, g, or t
  misc_feature (13)..(13): n is a, c, g, or t
  misc_feature (17)..(17): n is a, c, g, or t
  misc_feature (19)..(19): n is a, c, g, or t
  misc_feature (23)..(23): n is a, c, g, or t
  misc_feature (31)..(31): n is a, c, g, or t
  misc_feature (35)..(35): n is a, c, g, or t
  misc_feature (38)..(38): n is a, c, g, or t
  misc_feature (41)..(41): n is a, c, g, or t
  misc_feature (45)..(45): n is a, c, g, or t
  misc_feature (47)..(47): n is a, c, g, or t
  misc_feature (49)..(49): n is a, c, g, or t
  misc_feature (51)..(51): n is a, c, g, or t
  misc_feature (56)..(56): n is a, c, g, or t
  misc_feature (58)..(58): n is a, c, g, or t
  misc_feature (63)..(63): n is a, c, g, or t
  misc_feature (65)..(65): n is a, c, g, or t
  misc_feature (67)..(67): n is a, c, g, or t
  misc_feature (69)..(69): n is a, c, g, or t
  misc_feature (71)..(71): n is a, c, g, or t
  misc_feature (73)..(73): n is a, c, g, or t
  misc_feature (76)..(76): n is a, c, g, or t
  misc_feature (78)..(78): n is a, c, g, or t
  misc_feature (82)..(82): n is a, c, g, or t
  misc_feature (87)..(87): n is a, c, g, or t
  misc_feature (89)..(89): n is a, c, g, or t
  misc_feature (93)..(93): n is a, c, g, or t
  misc_feature (95)..(97): n is a, c, g, or t
  misc_feature (99)..(99): n is a, c, g, or t
  misc_feature (101)..(101): n is a, c, g, or t
  misc_feature (106)..(106): n is a, c, g, or t
  misc_feature (108)..(108): n is a, c, g, or t
  misc_feature (121)..(121): n is a, c, g, or t
  misc_feature (124)..(124): n is a, c, g, or t
  misc_feature (132)..(132): n is a, c, g, or t
  misc_feature (138)..(138): n is a, c, g, or t
  misc_feature (145)..(145): n is a, c, g, or t
  misc_feature (151)..(151): n is a, c, g, or t
  misc_feature (157)..(157): n is a, c, g, or t
  misc_feature (162)..(162): n is a, c, g, or t
  misc_feature (168)..(168): n is a, c, g, or t
  misc_feature (171)..(171): n is a, c, g, or t
  misc_feature (179)..(179): n is a, c, g, or t
  misc_feature (181)..(181): n is a, c, g, or t
  misc_feature (185)..(185): n is a, c, g, or t
  misc_feature (189)..(189): n is a, c, g, or t
  misc_feature (196)..(196): n is a, c, g, or t
  misc_feature (203)..(203): n is a, c, g, or t
  misc_feature (209)..(209): n is a, c, g, or t
  misc_feature (215)..(215): n is a, c, g, or t
  misc_feature (219)..(219): n is a, c, g, or t
  misc_feature (222)..(222): n is a, c, g, or t
  misc_feature (226)..(226): n is a, c, g, or t
  misc_feature (233)..(233): n is a, c, g, or t
cnaccaacgancntttnancccnttcatctntttntgnccntggnancntntatcntntatcntncntntnanccntntatnaatcntntatnannncntnttacntnttcactaatcatnacntaaccatntacatntaccatntacatntacatntattntaacgntcntaccatcntntacncatntatcatntatcatntacatntaatgncatntantacntacgtgngatccgcggaattcagagaaggaggtgggagaaagcatctgacatgcttcaggcagtgatggccacaagatacattagagatgttcatagaagaggtggcaagtgggtttgagatgaaaagggaatgtgaattcagaggtgtcccccagcctgttcccctgagaagatttcagacccttagcaacccctgggcccccaggtagagctgttgctagggaagatttgtacatgataggggacaggaagagggatcacctacctctgaaggcatcttggttggtagtggccagagtgacatctgttcaggcccattattatccctgacccaggcagggatcatgtccaggagggcagtaggagccagcaggagctcagagccatgccccagttctgctggtgccaggctaggatgttcttcatactctggccagccctgcaggtgacagtgaccctctaacctgagagacaaggaagaggatgaagatggcatccacataacatgctcactgtcatccaagtgggggaacaagcatgcagattcccaaatattaataccaagcttttatttcatccaacttgatgaaattctgatcagaaggagaaacagtctaacaaattcatcatcaaggaaagttcatgtttaatacaaactatctgaggctgaaacctgacttccccttcctcaccaggcagtcaggacagcaggagcaaaaggagaaaagctgggtcccaaagtccacaaggtgactcctggggctgatcctgctcagagaacgtggcaacagtggataagtctgccgagaatgccacaccatcatactctgagctggagggcttcaaccacagacatttattgctaatttattagacatttattgcgaatatattagaaccatggaaggttcaagatcaaagtccagaaggatttgctttctggtgagaaccctgtttgtttccagatgtcctctctggatacatcctcatgtgtgttcagcaatgtgccaggcatgtgtaagagaagcaagtgcatgctttactcagtacacgcttggaggctggtgaggggttcagtaacagctcaatgatatttctttttattaggacacaaatcctattaaatcagaaccccgatgttttcacctcatttcaccctaattacctcttcataacctctatgtctaaatgcagtaatattggaggttggagattcaaaatatgaatttgtgaaacaccattcagttcatagcaggtgcactttgaggatatggccaaggcagtaggaagggcaaggcaaggcttccagtctcagagcacagagggcattttcccaccactcagcacactggcagctcctcccaggtgatccaggtcacacatgagaccccattcctgccttgggggctgcctgctgataatgaaacaacatcacccttaatttcactatttctaagatcaggcttctattttgtgtttattatggggtttgtccaatggccaggtttgtgacataccacccaatggcaggtttgtgacataacatcttatagaattttagatgctggtttccagtgagacttgatggagttttttcatgggttttcatggagttgatcttattacatccatcaataggctgcattctgtagggaatacaaaacgattcctctcctcaataaaccagtcacctagttgaagataaagagttgagaaaagatggtcacaaaacaatcaggtgttaaattctgtgatccatgtgagatgccaacaatgtggttctgggaaagagagagtgaggttgtgaggggccctgcagagcacaatgtccagggctagggtcgggagtagagggcccctggtctggatctgtctactcagcttcattcctcccattgttgaaacagtggctgcaccagccagcaagcatctgagaccacctgattctctggactaacagctgctgaggtttgtgctctgagctataacactgtgagggtctaactgtaaccatttagatcagcactaatgaaaataattttttaatatggtgaaaatgtctgcaaatttctaacagaaaaattgatgaaaagatggtttttcttaggcccccacagcagtctctgcctgggacctgactttgtctttgagccagtggaatctatgctgagattgtaagctgggcagggaaatcacagcagggcaggctgtgctctgggtgctgaggaggacaggaggacactccttcagggttagtgatgctgggagttcgaggggagagactgcatggagctgcctgtgaatcgccctagcaatgccctctggacactgctcatctcacaagtgtactcggatgccagtggatggcccaaacatgggctcaggttggacaaggacaaagatttagggatgaatatatggggctcatttgatactctgaagtttcagcacaagcataacgaattatatggggagagaaagaagtcacaaggttgtgatttttcatttggtattaaaatatatcccctctgctcatttttccctgcagaatgtaactactgatacatatttaagcaaagtcactgtttttaattgttttagtaactgacagcctgtgtgcacagttcctaagtaactgggtagccagaccatcattcctatggtaaagccaggaagtgactgtggatgtgaacaaatgtgagtttaatgtacatgtctccaaagccacgggccactgatctagggagaacctgcagtcagtttgctttcccatgcccagatgagaggacaccttgatctgtgttcttctgatgaactctaaaaactctaaaaactgatgaactctaaaaactaatattctgaaggtctagttcatacttcttttctttgctagagggactctctcactcacatgtattgtactctctgcatagaacagtatgtgatacatacaacttgttttctgctaaatacccatcaatcatgtcattcatgagtcttccatagatgttacctgccctatgaatctgggctcttccaaaagaatgggccagaggtggagctgtgctttcacattctcttgtgcttccctcgtggacaacctttgctagttgtcacccttcccacccagcaaaagtaactgtctttctgacatctacacaatcatttaggttttcctgtcttaaacttcatataaatagcattatgtgtatttttatctttttagtcttggtattattccttactacttttgaggccttcatttcttccagtggactcaaggtcctgtctgatgtcatttcctgtgattctgaaggattttctctcaaatgttttataagacatagctgctatgaatgaatgtattttgtttaccaaaatttttttttttgcctttttgttagatttgaaggatattttcactggatagatttcctggctgccttcttttttttccttttcagcatttaaatatgtcattttactgcttctagcctctattggtcccgatgaaaacttagccaatggctacgttgttgtgtctctgtatatagtgtctgcttttattctgatgcaatgaagattttttctttgtctttcaacattttaatatagtgtgttcacttattaatttctattgactatctaaaagggttttattgaattatttcatctaagaatattttttattacttttgaaaagtttttgtcattgtatctccaaatattttttcagccactttctctgtctctccttctttgtgactctcattatacatttgttggtatccttcactctgagctataaatctctgacatttcttcctttttttctaaacattttctttaggctcaaacatttccattcctctattttcaagttaactgattgttctgtcatctcaatttgctattagacctagctaataaatatttaaattgtattatggtacttttcatttctagagttcccatttggtcattttttatactttccatttcttttcttgaggtcctacttgctgaatcttctttttaaaaatattttcgtttttatgtcaatgatcatagttttaaaaataattatttgaacatctgcatattaactgctttgtagtctttgctaaagccaataatgaggacaagttagaatcagctttcattggctattttctgttgtcattattgtagttgctttactttgttccttcaatataaatcatactcctctgtttttttttcaggattttttaaaactgaaagctgcacacttttgataatatattatagtacctctctttagattgtggggtttttattttaattttaatttttttagaaacagggtctcactctgtcacccaggctggagtgtggtggtgtgatcatagctcgctgcagcgtcaacctcttgggctccagtgatcctccagcttcatcctcctgagtagctgggactataggtgcatgccaccactctctgctatttaaaaaaaaaaatttgtagagataagggtgtcactattttggccagcctggtcttgaactcctggcttcatgtaatccttctgcatcaggctctaaagtagtgggattacaggcttgagctaccatgtcaggcctggaactggtttcatttttctgagcattttaaaatttttttcttagttacttgtcagaacttacttctggtacctgacttatgatagttggagttatcattttttgactttcagatggtgtgaaagtgatatgcattcaagtagaaatagtacttctagtatttatacaactattctatcttctctttcaatagagtattcaataaattgcatgagatattcaacactttgttgtaagataaggtttgtgttagataatgttgccctactgtaaactaatgtaagtgtactgagcacatttaggatagaataggctgagctagtggattacatatattaaatgtattttcaatgcatgatattgaaaaatctatatctcatatggtgtttgaccactgatatctctgctttttattcttaatatttagtttgaatttatagaaactgcacatgtatctgcacagcttagtggtcaccaatgatttgagaagaagttttgctcaaatatctggaggttataaatctatcttctgtcaatccatctgtgtgtagtttaaaaagctcctgcaaaatgcagctagttcttacctccctctggttttactttgcaccgggcacttctgggtctcatcactcatatctatagcttctaagtcaccaggaatgtgtgtagagattgtttcagcaatatggctctatcttacccaggaatctgctatttactgttagcaggtgtactacttgccccaaacagggcatcatctttgactaacaaagctgtgggctttttctgttcattccctatggagttctgcatgtttagctggaaacactgaagaattttacttcattccttggctttactcaagttcacccgctttggcagcaagctgctagctttatttgctatcctcatattggtaaaactccagttctgtatttcatgctgactgagctgggggtagaagggtgctgtcacaggcaaaaggctacagactttttctgtccttactcaaagcactagtacttttttttctataaagaatatacatctttaattattttatgcttcaccaattttcagagtgctgaaatagttttgatattttagctttatatgtgtgtttgttatttatttttgcacagaagatttattaaactctttgtgatgccataaacagagatgccttctaaaatgcatttaaatgaacataatagccatgctgaaatggaatgaggttatttactaacataagtaattttggacttgagaacttgaactcttcaccctcagtttaaagagaaaccaaggacttaaaaaatagagaatcctggtccctggatttcacattcatgaagaaatgcacagtcaatttttaagatgccttctttgtattctagaactgagcaaattagtgattacactctacataatgggagctatgattgtctttaatagagataagaattagaaataggaaaaggtagctgggtgcggtggctcatgcctataatcccagcactttgggaggctgagacgggtggatcacgaggtcaggagatcgagaccatcctggctaacatggtgaaaccccgtctctactaaaaaaatacaaaaaaattagtcaggcgtggtggcgggtgcctgtagtcccagccacttgggaggctgaggcaggagaatggcgtgaacctgggaggcagaggttgcagtgagccgagatcatcataccactgcactccagcctgggtgatagagcaagattccatctgaaaaaaaaaaaaaaaagaaagaaagaaataggaaagtgcaaaataggaggaaacttgtggaattgtttaaaaactacctttttcttattttttagttacttgtgtgtgtgttttaagtttatgtggaaatacttttagacctaaaatttgaaaaatatggtaaaaatgattcccatatgcgcctctttcagcttgctctaatgtcagcatcataaataaccacagtataagtatcacaaccatgaaatgaacatagatataatgttatttgttaactcatttaaaataccatatggatttcactgatttttcctgttgatgactttttttatgttacaagataaaattcaggtttctgtattttatttggttatcctgtcctcaatatctttaaatctgtgatagtttttcacttttgtttctctttcatggccttcaaacatttgaagtttactgtccaggtatgttgaagaatgtcctcctagttgggtttgtatatggtgtttactactgattcaattcacaccattaatttttggcaagaataatacagacaggatgtatcctcagtgcttcacatcagatgttacataatgtcaacatgtcttataggtggtaataaacgaatatgatcaatgaaatcccatttggaaggaagttttggacaaaaataatgaaaacaactgcttctatcactctttctactaggtcattgcagacgtcattaggaataatctatttcttccttatcgaatatgtactttattttaacaaactttaatctttttacagtctactgcatcacagagaaaattgaagaaataatttagttaacttttaaatggcaaatgtttccataataaccatttgccactgaaatgttgatagcctgaagaaagaaaaagaatgggatttattcagccatggtagtatcttcacatgaacagcttttaccgagtcaactatttggataaataaatagaattttctactacttagaatgttgcaaaattcaaatggagcagtgtagcatgcactgagctacctctactgggaaagttaagaaccactgaggctatataaggattcatacagtgagtcactatttctggaaacctgggattctggtgcctcagttgaacagagtccaagaatcaaagtccaaattgttcaatgatttttttttagaactgcaaaatgtccaaatagagcagagacgctaaaactgagtggccaccacattagctgtctgtaaaggaagcagctggtaaaatctagtaaacactgatggtcttgttgaggtttttgtttcatgttgaatcactgtgggaggtaagttataatcctgctgacagtaataaactgcaaaatcttcaggctgcaggctgctgatggtgagagtgaagtctgtcccagacccactgccactgaacctggctgggatgctagtggccctggtggatgcaccatagatgaggagcctgggcgcctggccaggtttctgctgataccaggttaagtagctgctgctaacactctgactggccctgcaggagagggtgactctttcccctggagacaaagacagggtgggtggagactgtgtcattacaatttctctggtggtatccaagattggaaataaaacagaaatgcactcatgtaatctagatcaaaccagctgtctttgagtagagccaaaattgttgatctacattgaattttaattatatttcttgctgagcagaggtggcaggagttttcactgatgtgcaaaaccacctcatgttcccctcacctgggagccagagtagcaggaggaagagaagctgagctggggcttccatggttccgtctgggtcctaactgagcagttccttcccagggctctgacccaggcattgatatgggctctggaaggtagggcagctgggagggacatgcaaagcagctgggtgggagctgagcttccagctgcagagaccacctgcttcttcctctctgcactgagcgtcctgtgcctccctggttgtcaggccagaaaagtctgttggctcagtctgagtgtagaactcctcccttgtgctcacataatttcactcctgtgcctttcttctcttcaatcacctaaatacacccgtatgatatttggcacaagtctgttaagaacaatataaaaggctgtgttttcatttctctcttcctgtcctcagtatgcccagtcatctccctaagtgcattattggatctatggaaatgaagagtctgttagaacttaatcttccagatagacattttttttttttttttctgagacggagtctcgctctgtcttccaggctagagggcagtggtgcgatctccactcactgcaagctctgcctcccgggttcatgccattctcctgcctcagcctcccaagtgcctgggattacaagcgcctgccaccacgcccagctaattttttgtatttttagtagagacggggtttcaccatgttagccaggatggtctcgatctcctgacctggtgatccacccgccttggcctcccaaagtgctgggattacaggcatgagccaccgcgcccggcccagatacacctttcatttgcttattagtaatgttttctgagggtcctgaagctttccattaacccagacacataccctctttgagttaaaaacttctgtttacagtcacatgtcctggcagccctgacatagatgctccatggcttgccgattgcttgaaattaatcaagtaacttaacttccctgtgtctcggtttccatatctgtgtaactgtgacaatagtggtacctgccttacagtgctgtagacagtttaaagaaaataagataaaacatttacaatagtattcaggacattatgtatgtggcaattaattttgttttcattgtttaaatattcagcactacagtcatcatcattataaatatacttagcatggaaaatagtcttaaatctaatccaagaatgttttatccacagtcaaattaaattctaaggcattttcttcagtaactgtacacaactcttaaaatcctaatgatttgatcttaatctgtgctaaagtactcagaccttccatcattcccatccatccctgtctaacgcattacttctcatcatccattatttaaatgttaccctataaacggtccccatgtcctgttgctgtccttctttcttatgtaatctttattctaccttgttatcttttatgttattcttgccccaggactgacaataaggaaaagctaccatcatttcttgtagacttgctccagtataattttttcaggcttgttgtcttggaaatgaggattgtgtcttgcaaagaaacatattcattgggtcaatgtgttatgaaataaaagattttatctacttatgatccaataattaatttagactgacttgaacagatttttaatgacaaaaaggagaagacgatataagagaaaaatttaatacaatagaaaacacaagctaatataacgcttgcttcatggatttttacatgtatattagacatatgctgggtatatgtgcgcaacgacaatctaaaaactgaatgataactagcttaaggaatgcctgcattacactgagtcttgcccacttttccagttatgaaaagaaagctacagcactatttgtatgagtatcaaaccttctagatgctgtgatagaggtagagaagatttactgagaccaaagccttggaagtagtagatgcttgttctatgatattatgtggctgtggttgccgttgttaggaaatacagtgggagtgaaagcaaggagaagatttacaagctctgctcttcctcatactcacaaccccctctagagatggacagatgttggtccaggaatctctgacacctcttagaagccttttgctctttccagaatgtttcctgacaagtattgttttgagtcacagattaggtgaaactaggtgtagaagaaaggactagagcaagggaagaagttttccatcccagacagttgttgtaggaacagggaaattgaatttttcatagatttatgtgacacttgtatcatgttggggagagaggcatcaaaccaggctcattactgaaagaattattacgttatttaagagagaaagaactgtgaatttcttgtcaaatagatgtttaaaattcaaaactactattttttttttggagatagaatctcactctgtcacccaggctggagtgcagtggcacaatcttggctcgctgcaacctccctctctccatttaaagcaattctcctgcctcagactcccaagtagctgggattacaggtgtgtgccaacatacccagctaattttcatatttttagtagagacgggattttgccatgttggcccggctggtctcaaactcctgacctcaggtgatctgcctgcctcggcctcccaaagtgctggaattgtaggattgagccactgtgcctggccctactgatgtattaatattattcatcttcttgaatacaccaagtggtaaagtgcaaatccacactttaaacttgagatttctcctcctatgtgaattatactagtgaggaacaaaaaaattctctgttggtggggagatgatgtttgacagcggtcagtttgtgaagcagaggcttatgtcacaggactttttacagtattacatataaacatggtgaatggcctcaaacacagaagaatcagcttttttcatgagccatactaccaccaagaaagaactgaattgaaacctgtgactacttgatgaagggtgtataaagaagagggaaagatttgggaggccaaggcgggtggaccacgaggtcaggagatcaaaaccatcctggctaacatggtgaaaccccatctctattaaaaatacaaaaaaattagctgggcgtggtggagtcccagctactcgggaggctgaggcaggagaatggcatgaactggggagtcggaggttgcagtgagccaagattgcaccactgcactccagcctgggtgacagaacaagaatctgtctcaaaaaaaaagaagagggaaagaaaaatgacacaaaacacaatgtcataaatggaaaggaagaagtcattacacagcctacaggagtaaaaaaataaagagaggatattatgagtaattttatgtcaactaacttgacaaaagtggtgcagggcaggttcttggctacactcaggaaggaatgcagcgtaagctggtggtagaagaaaacagctttactgaggtggcagtgttacagctttgtgtctgttcttgtgaaacagagctaccacataggcattgtgccaagagcagtagcgtaggggcagttttgcagtcatatttatccccacttttaatgacatgctaataaaggagtgggttattcaggaatagctagaaaatgggcagtaactttcaggttttgccatggcaatggtaaactgatatggcactggtgggcatgtgttatggacaggtgcttccagtgtctcttccttgtgtcagccagtcttcaatctggtcctgggttgagtcccacctacctcctatctcattgctccctcagagattagatactcctccttaatcttaaggggactgcagaagagcagagtcccttttctgtaagtgcttcctgctgactttatgggggcaggccttccctagcctttgaggagtaaaaatctttggtacctgaactaaggggcccaatggcacgatgcattcatttgtggggtcagaagacagaatgggttggaagacttatgacagaccgtatcatctttacatgaaatttagaagacataaactttactaggatgttaaacaagaaaattataattggaagagagggaaaaattaatgctcctaggtccacctacggaaccatgttattaatccatgtgtttgcaaaacaacaaccttaagttttctgttttataaatggaggttgtggtgtcccccttttgtggctgtaggaccttgtaagaaacaggtttaatcctgggcagctgtacccaactagtggcttcctgaagcctaacagtaattaagagtaataaagaatatctgataatggctccttattctggttattattgattcttgggggatcattttgttgttgttgttgttgttgttgttgttttttgagatggagtctcgctctgttgcccaggctagagtgcagtggcacaatcttggctgggctcactggaacctctgcctccagttttcaagctattttcatgcctcagcctcctgagtggctgggattacaggcatgtaccaccatgcccagctaattttgtaatattagtaaagatatggttttgctatgttggcaaggctgatttcgaactcctggcctaagtgatccgcccatctcagcctcccaaagtgttgagatgaaaacgtcacaggagctgatgaaaaaggaaaaggagacagcaatgatcccaggcctttttaaagggagaacaagctgaaagcagcaaaatacaacagttaaatctctaagacactaatctcagaagttttaaaagaaactcattatcgtatcacaggcaaaattttttgttttacttgttttttttttttttttttttttttcttttttttgagatagagtctcgctttgtcacccaggctggagtgcaatagcgtgatcttggttcactgcaacctccacctcccaggtttcagccattctcctgcctcagcctcctgagttgctagggttacaggtacatgccactgtgcctggctaatttttgtatttttagtagagacaaggttttactatgtttgccaggctggtcttgaactcctgacctcaaatgatcctcccaccttgggattacaggcatgtaatcccaaagtgctgggattacaggcatgggccaccatgctcagccttaaagctgtatttttattaagtaaagtgtagaagaaaaagtgtaaataaagtgacagaaggaaaacacaaggctgttatggaaaatgataaccttagggcagaaaacaagaaaaggcaaaccaagatttccatagggtgaggctccaatccacaatcctcggatgaatgtcaatgctaaaaaccctggagcctccagggagtggccaacagtactaaatgctgaaaacccagagtacacgagtatcagcctatgaatgtcccacaccaaatgccaggaaaccctggagtatccaggggctgaccagtgcagaaaatcctggagcctcagtggggtggccaacaatgagccccaaaggcctggttggggccatagaacaatgtgactctggcttcttagagtcaacagaacaggagaattcttacatccaagtgtcctgccttaaacaattgcacaaacataattagtagggacccaaagaaaaaactgcaaagcaaacacatatatcaggacagaaaataagataaaatggctgatggataaataaaatgtcattagaggagaaatgactaagagaaagatcaatgaggatgtagtcaggtgtgctatgggggacttcaaatggactatttagccaaaggccttatttcctggaccatctgacatagggcaggtgggtagatgggacacttacaggtgtgcaggagccaaaatggtgccaagcagtctctaacatgaggcctgcgtgaagatctctccaggctccccagcttgggtgggttgaactcccacgggtgaactggtgcatggagcggctggcctgcatgaagcagtggctctgtggccacttacctaactgctcagctccaccgcctgtcaggaaagatgatggctcttaaaacagcctttggccagtgttaacagctctgcaatgttagcaactatgtagctttaatcgctgtagcgccgatctcgccctctctcactgatcgctgacttgccacttctccaatagctgtctcgcccattgctgatcgctatgtccatcttctcacaaaatgccatctcttgctgtctcttgctgtcttgcttctccactgtttctgctgtctcaccaccacatcaaacactgcctctcaccatgtcccatttatcctccctccttattaaacatccatctgcatgtccaggcctggcatccccaggctgatgtctctgtcctgggccaggtactggagagtattgttcctccaacttcaccaataagccatggttctctcaaatcaaattatctcactgcaccaattttgccaaggtttgcagtgtactggtcaccaacttacccaaatctactgggacacaattcccatgcacaacgagtaacatgaagtggattactacctacagagagtcagtcagagagagcacaaagctgccggggcctgattgacactagactgtgcctaccccacaaggactgcagctgagggaccctggaatgcagcctaccctgggttttatgtcttagaatcacatgacacactgggctggagtgttgaaggaattcctgtttctagtagggacagaaacagaacccaggctgttctggccaatcatgccctatctcagaatgttacagttccagaacattctacagttattcctgaaaactacaatcaagaaaaggaaggagactgggttgattcatgactaaatggaaactgttctgcaaataccacagtgaaatcaaaactcagtatttttgagactgggttatttcacttagtgtaatgtcctctagttccatccatgttgtagcatgtgtcagaatttccctttttaaaactaaataatatggaatagtatgtatataccacatttggattaccagttccctcctttgtgaacatttgagttgcttctacatttagctactgtgaataatttgcttctgtatgtggatatacaaatatctcctcaatttaatgtcttccattacttgggtatatgtccaaaagtggaattgctgaattatatagtatttctatttttaatcctttgaggaattgccatcttgtttcccacagcaggtgggccatttacatcaccacgacagtgtccacaggagttccagttccctaaattctcaccaagactggtcatcctctgttggaaaaaaacattctaacaggcatcaggtgggttttgtttttatttttctaaggattaataatattgagcatcgtttcctatgctagttatctaaatatctctaaagtatcttctttagggaaatgtctattcatatacttttctcatttttaaccagttattttatttttactgttcacatgtagaacttatttttgtatagtagatattattaaccccttatcagatatgattttcaaatattttcttctattccacatgttgcattttcactgtgtaggttttatctcttgatgcccattttaaatttttatgtagtccaatttaattttttcttcttttgcctgtattttggtgttaaaggtgttagtatttaaatgtctgtaaatattcacttactacgctgagaatgtcacacttcaccttctctctctgatggtggagctaagagtgttacactctcccattttgtcctaggggacagtgaagctaggtgagaacccagtggcttttctgagcttatttgtcttgcatttttggtgacatggattgttgttcacatcagcttcctctggcaagtccacctggaaagcattatatttagcaagaaaaaaggaggctctgaatgatgtcactgtaagctgtttatattccctgttacaaatgtcaaatccgtgaagcataaagggatttactagaggatattaaattccttagaaattgttgaaaagccttaagcaacaggctccaggcaaagcctctggaacaattccaagaatggcactgctggcgcaggttggggaggagctcctgctgcctgagactccacattcaagctgtctcctgcaggaaagagagcagctcttctcactactgccccccgaaggacagctgctccgctatcaactactagagacctgacccctttctctgcagacctgcctgtgttgattacatcttcatttcagtctcatgtagattcatctgttttcatggattcaggggctatttctgcccaagtccaccctgtggctttctatcataaatacacatctttctacactcgaatttctagtcattactagtatcaacagcaacatgctagaacctcacataaagatttcctttacaaagaacatcatgctccccacgtagcattgtgctccccagaatgtggggaaagtccaatctgttcagcccaacaccatgtaggaaaaaaggctcttctctcatgagccgttaatctgtctacttattattaatttgtgggctaaactataaagactggtaaaaatagcacttcgaattcttttaacaaaagggtgtaaagaaaagattaaattatttaacatgcatatatgcatgactcatttcgttattgtcaccagcttctttcatatttattttattctctagtttctggcaatactttctctatggtagagtctggaaaggctactcctcatgtccttggcttcctaagtcccagatgtggtgaagaatgcccatcagctgtgttactacggagtgcttttggattgagatgagggaggggaaatggctgaactcactcaaatgtgatcattttcttggtctaggtcacagccaggcaacacagtcctctgggcacaatatcatcacttgccatgtttctatcaaaatgaaagtatctttcttgactgtggaaaacataggggtgggggcggggagggtcaagtaatagcaaaaggagtacttggagttgcctgagctgccactctggtttccccaaatgttttcaatccatttcattcatgataataaacacctttctgcctaaccagtcataatgacttttctcagatccaactgattcagtgataaacctatagagaaaaaataactacacttctccatgtttaagctgaccaggatgctgtccctggtgtttacacctccatatcccactatgcgtttcatcttctctttgcctcactggtgatccaagtacagggaatgcttcacatgactgtgatccctagaacttcgtcctgatgacggttgaaatcttctctgagttttaccagtggaaatggcaataaatagaaacattccagaaggtcccctaggttccatattttctgtacttcctctctaaaatatgtaaaatcaattatgtttgctcttgcttttatggactctatctatggccccagcacacacgctaatgccctgtcttgacaatttatccagtattttaataaatgtaaatggtcacatgcttatcatatcatttcttccaatttcatggaataatttcacatcaactctttggattaagagccgtcaaccaaaaaaccacagccctgaataaatagaaatagagtatttcaagctgttcatttggcataacaatgatgagtctacagctcattttcaagatataaatattctgtttatgggagtgacagcaccattcatacagttactgtttcagagcctccaccatatctgacaggacagcaattcaatagcacaagggtttgtgtgccagctttgcttgactaataatgggtttttctctgtctatagggaaagcacatgacaagagcatgagctacacttcacttcactttttttgaggttaataagttgcttgatccaaagctatattacagaagaacttcctgactctgatgaaagctcttggaaaatcctcaaataatattttatgcagaaatataaccaaaaaggaaggcaaattcatatataggaaaataaccagtgccctcctcacgttacatgaggtctactagtatcacccgacaccagctgttagtctgagccctgatgtgtggcgcaatgttaggggttcaagagacgtcattcttcttgacaaattaggtgttcagaagagccagtagccctgtatgtctcagttagttgaaactcatattattgagtccccacagggacctccataaccttggttcaggagacaccttggaaacctgggaaaggtgattgactgaagtccatctgttgaatcatcctcattattaaaagcctcctactcattaacggcatttcgattaatattcgcttggaaagcatgtttttattttggctcatttttgaaacgtctagtcatagttcttcctgaaccactttgtctgcaatcatcctgttgcatttcttttaagggctgatgatctgtcaaaagcaacagccaatattattacattgctgttctctttgcaatgttatcatcagatgtaacccttgcagattaaccactgttacgatttttacatttccagggatttcttgacaatggcaatgatgtgacgccatccagcatctatttgtgagaactctatttgacaaatcatcactgtgggtgtgaacataatggagactttcataggatgcaatggttaatattcaacattagtcaaaatttactctagtcctacccttggagctctactgggttggaaaaatattttagataaggacaatcatttcatagagttttaaaaataaaggctaaaataaattttctgtagcaagagtatgaactatatgtagccagcatacccttttttagtggcatataacaaaaattatttaaatgtatttaatttaaataattgtataaatatgcatatataataaacatacttaaatataaatactatacatgtatatttgtagccaacattttatcagataaatatatgtaacttttatgtatcttatatacatatatgcacattttccataaataaggtaaattttaattttttattgaatactagttttaattttgtctttaattttctcttaataacttcataatttaatactaaatgttcacatttataccaccaacttaagaaaaaatcgtgtgtgtaggtagaggtgtaaatactgtatcaggaagcttttatgcattactgattggtaactggttaaatccacaactcagtggctgataacagtaaacatttgttttcgtgttcatggatgctcatgttcacaatcatctggctgatcaagaaagggctcagctgagtggtttctctgcagggcactgagctcatcttcagcctacagatatgaattgtctgaggacgaggctgaacagcagtgactacacatgacacaatattcttatggcaggtcacaggagtgaacaacatcccaaaacaaactgcacagttgaatttaagtccaataacttctaacatagcttcacatattttaaatatattcctttatttcaatgagtacaaattttgaagaaaatgtttactccatttaattatagaggtatttgatcattccatggacaaataattatgctttcaacttttacaattctgaaaatacttgcaaatgtaaatttgcattaataagaaaataaagctggatgtgttttcaacatgtagctttaagtatatatatattttaatggcctcagtgggggaaaatcattttaacttatgtaaatatccctttttgcctctcttgtgtcctataaagttgcccaacaagaggtcctcccataagatttggaaatcagaaaaggatgactcaatattctccattggtacctaaggcagacacaggaacagaggtgagggctggagaaacacctggaaggatgctgcaggaagctgagaacatcaacactcccacccctaagcttccagacaggactgaggaccacatggttagatagcccatacttcaagggcagatgcattctgttttctgagtgagcgccattcaatcctgcttctaatatcaactttcctgactactatatccttggctttgaaaggttgtagtctgaacgttaatcataggcatcggttcattcttgttatacccaaaagagccaagacacccagtggggaaaggcactcagggtgtaaaatattgtttctagaatgcaattgaaataggccctgttatcccatggaactaaggtttatggttttttgaataaacagaaattgactcccccagtcttaaaactcaagatagttacatttgtcttatctgagttcttttttcagtaaaccaaccatcaggcctcgtagatactatcaaggagctgaaacatacatatcactgaatccggacactgagacatcagaaccttcacccattatgattgcataactgacctcttgcttcctgttgaccaaattatcttccttacccctcccaaattcctgttttcccacattttgtccctgttatataaagtcttaattttagttggtcagggagatacattcgcaaatggtgtcccatctcctcggctgcagtacctgattaaagcctgtttcttggcaatacttgttttagagattggctttctgcgtggtgagcagcagggtgtacaatgaatccttggcattttagtaagaaaattctctgcaaccttcactgctttggcttcttgtaacctgaattcacatttaactgcaacttctgagacaacttgatataattgatataattagtgaatcctaattcactttgtccaccactgcttaccagtctgagcttgccagctcccaacccttactagtgccagtgaactttctgaaaatgcaaaaggtaatattttccctttttcataaaacactaaccttctcttcgtacttccaatatattgaagaccactgagttttcctgtgtgtccaatttggcaaacatttctttgcaaataaaacatgaaatttagagattccgctctacattttatttagacttcagtagtttagactctaattttctgtattaagacaattcctgcttagaatatctatagtggtttcttctctgttatttgaattccaaccaaagccctaaactagactccttaggtgtcaagatctctgcctttattaaatcaggagaggcattgttatgtctgtgcagctggggcttacaaagaaaaaggaattgggttgcagaggtgatttcaggtccccctctaccaacaccatcagagtgtggttgcatctgaggaacactctcaggcgatggaggcatcaggaggagcagctggggcagcccagcctcacacatttgcttccctgggggtttttgtttgggtgtgtaacactgtgggagggtaactataatactgttgacagtaataagttgcaaaatcttcagactgcaggcagctgatggtgagagtgaaatctgtcccagatccactgccgctgaaccttgatgggaccccactttgcaaagtggatgcagcatagatcaggagcttaggggctttccctggtttttgctgataccaggctaaataactgctaataccctgactcgcccgacaagtgatggtgactctgtctcctgtagatgcagagaatgaggatggagactgggtcatccggatggcacatctggcacctgagattggaaacataaaaacaaatgtccatacaattaatcatgttgtaagagaacttccctgaagggccaggctgtaccaagcacactgggctgagtaaattcctagtgttctccttccttacctgggagccagagcagcaggagccccaggagctgagcggggaccctcatgtctatgctgtgtcctgacagggtctgactcctgcatgaagtgtgtccagcctattaataagtcttcagggcaggaggttgagcaggggatggggctgactgggcacagctgcagggctggctcatctcagtaactcagcaccagctcagtatccccaggtgtcccaggaaagaccagggtagcacaaatttgtctgtggtgaatgtgtttctactggagagtagtttgttatgagaaacattttttatgtatttttttgaaaatttgaaatattcctcaggagtcgacggagtaatgtatttcattggcacatggggattatttggaatatcttgtttgtaggaaatacatagtaaaatgttaaacagtatgattctcaggacttcaaaagactctcatatgattcgggttagggaaggaggtactttgtcctatacttcaacatttctgtgagttttaacattgttcctttctaaaaatattaaaaataaaatttattgacatgatgctatacatatttgtaagtattaggtaatggtgttatgccattgttcttaccactataagatcaagcaatttactacagatacagagagatgataccgagtttcctcaatgcatgcagcactcacacatccaccattatcaagagctacaggtctctttaatacccagagactaaattcacttcaccttattcttgttttgggcaccttcattgtctaccttcttttctgtcattgagtattactttccaaagttcttctctcttattgagggtgaccactgcatggagcatgtccctgtcatgcaccaacaatgccactttcttcttttacgttttatcagggacatcatcctgacccagacaccatcctccctgttaacatctttaggaaagagacaatcccttatcaagcaattgccaacttacatggagaaatcagctggatccagatgaaactggacatggatttgcagtcattatatctcacatctctactgtgccaaaaatgtcccagcctggcttagtagcaggggacgtggatccaactacatcagcatcagtgggctgcagcctaggactccacaaaattttactgatgcctgactaggggagacaaatcacagtgctgtagcccatgcacaaaccttcctgctgctttgtaagccacctgaattttaagggaacttgcttatattgggagaagggaagaaagctccatttgtcctctaaatgtttgctgaaaatgaactgacaaaagaaagactaataagagaaaaggcaagcaaaattcacttaaagtgcagtgggatatcatagcggtgtgattactcagataactcaatgagatccagttgttcatacttcctttctagcgaagaggtaattgggaagtgtaggcaacctggagagaatagatgaggatagaagtgcatcctcaaaagaacaggtaatagcctgtctggataaagcatcaacttctaatctcttctatttttgattcctattttgtgttaatcttccctgatataaaatttcccaggaagaattttcttgacaatcagtttccttctggagaagctgcttttaagcagataaaggagtgagataaaggagtggagtgagcataccccaacagctaaaactcacaagttagaggatttataagtcagactctaagtctcagattttgtaccgccctcttgcttcataaaaatgctttgttattttttaaattttactttaaagaaggacaattttggagaatatattaatttttggtggaatgaataatgtccccaccccaaaagatatccaggtccttgtctctggaacccaagttttataggagttattaagaaattattttaggcagatagagaggaaaaggcatccttggtaagattttgtttcttttaaagcaactccagacatgtttcttgtctaataggaaagctccggctcttagagccaggctggcaagatttgatatgcaaatgaaggccattagaaactgggtccaccctaacatggctattcctaccttcttcttccttgcccctacatgtgcctggcaacatggctgcccccacatatccccatgtgtgtagaacattatgatgccctacatgtgcatattgaaaggctagggtgggagggccagtttttgctcaggctatgtgaataacatgcctggtcaaaccaatcccttgagccctttgcaaatcagacaccacctccttcattctcctcatataagcagccacttttccaccacagatggagttttctctttgttggaatcccctgtccctctgtctttgtacagggtagctgtttagctgttttattcttccttccttcttacatattaaacttttctctccttaaaaccactccacatctttctgtggcattttatccaaagcagtgtgaaacagcaagaaccctggtgttcctccagtcattggagccatatcataaggattctaccttatgatagatagcaaaaaatgaccttgatagatgtaagttaaggactttgagaataagcttcctggttatccagatgaaatcaatacaatcacaaaggtccttaaaatagaggaggaggattgcagtcagagaggagctgggacaatggggacggatgttgtttgaggaaggaaggggccatggaaccagaaatatgggagcacattgaagataagaagcagagaatccagttctctcctctggagcctccagaaggattacagccccactgacaccttagcattagctcagtgagacttctgacctccagaactacagggtaatacatttatgttgtgtgaagccaataagactgtggcaatttaaacagcagcgttggaaactaatgcaaggggaagagatgtctttcagctcactgagagcatgcttgtcctctgttcttggaaatatttccaccttgttatctggtgtcagacaagagacagagaaaattttttctgagagaagagctcgtacaaaaattctttttagctagaaattctctttggaaaatcccatgattatctcttatacgatctgggtatcacagagtttaggggtcagaactcacagcacatgataggaggaagagggttttgttagtttgttttcatattaggagggaaaattagattttcaggacacaatctgagagggacagactgggacagggatattgtaagagaaagaggagatgtggaaggtgtcagagcaatgaaacatgtgtccctgcttccaaatctaaaataaagtcattgattttagaaggtgaagcaaagctcttcaccttccatcttcttatgaaggatcaaattctacccagagttcctgtccctcctttactcccctgacattgtattgtggagctaatcacatgtgccttaatccctgctcctgtcccgggctgggagaggctcactgtcctcaccatgcccagcaggctagagctcatgccctagacaccaaaggagaagaggatggtttctgtacaggaggtaagagctttaccacatgttacatttcactataattctaagtaaagttgtgtggagagaagagaacatatgggcaactctgtctggtagagttggaagagggcagtttctgagagtgacaatgaattcacatttctaaattttcagatggcaaatgctagctttagcaattgtggaaatgtggactttgagtttaagaacaagacagactttcagatactgcaataaatgaggagacatttggaatagggtccttagcccagggctaaggtcaggctggcagtgcctgagagatgccaggcactggccctgggctgtggaggaagcagctgctctcctgagccacagggctgagaatctgggaggaaccacaggccctggccacagggctgcctggcagggcttcagggaaggaaactgctcacaaattcaggggagctgcattaagcatatatcccccagcctggcaagagtaaaagtctcagagacccagaccttagggctggtgctgggatcctgggctggctgctgtcagctctgccctccctggtgctgaatgactgggaccctgctggagccaaaaacggacagtcagcaaatgtccttaaagtctttactcagccagactctattctgcttggtcagaaaagaaacacacgctacacaaataagcataaaattatatgtatctgtaatatgaatttctattgtgaactttacatattgaatacatatttaagaaataagttgtatttatatatttgtatatactatgtatttatgaataaatatgtgatgcatgtttatatataaagagatataactttggttgctagtataaggtatagttttaaacttaaataaatttaacatgaacattgaaaatgagcactgggtgcaccacctcatggccctcctcactccaggacctgagggtcataaagctcagtaccctcttccatgttccccctgggctgagagaagtgaactgcccgttgctgaggatcatgagtgacctgaggggggtctacggaatcacagaacagcagatgcccaggaaatggatagtgggtctgggccctgaatggagggacgttttgtttccagagctcagcatagacaagtcctcctctggtcatttctgtcaaacaaagcagcatatatggctcagaggctgcattgtcacaggatgaagcccctccatggctcattccagcttcccctctgactggggtgatgtgggatctctgcccagctttcatggctcaccagctgctgggactctgttgacaatggcctatgtctgccccatgcacaagcttctcaatagttgccattttactttctggtctccaataaccacaacttgccaaccatgacccttccacaaagattcatagagtggggtcagaactatgggttcagcaacgtgccggggcatgcaggtaagagacacaaggcgtggccagcccgtgtctgaagtgaggatgaatttgcatcatgaattcagagtaggagatgggagaaaacatcctgacatgctccaggcagtgatgcccacaagatacactagaggtgcccatagaggaggtgggaaggggatttcaggcagaggggatgcgaatttagagatgtcccccagcctgttcccctgagaagatttcagacacttagtagcccctgggcactttgagagaccgaggagaaaggaccatgtaaggccaagaatttgatgccagcctgggcaacacagggagaccccatgtctacaaaacacacacacacacacacacacacacacacaatttgttaaaatgtgtgaaaaatagcatcacaaagtgattatgtatgaacatttgctcagaaaattagaaaacaaagcaatgtcttctgagctaacaatactataataaagatgtcaattttttagctatagtaatacagagaacatgatattgtctatcttaaccatttctaagagtgtagtgcaatgccattaaatatattcacattgctctgctattattactgatactaaatccagaaccattttcatctgaataaaattaatatctatatcctttaaacaatactcccccccatttcctctatccctaccgccagcaacctccattccagttctgtctctatgtcattgacatatttgaagcaggttcactctgcactggttaccaacatacttgagtgtggggaacacaacacccccacacagcaagttacatgaaatgggtttattatttacagataagcagcaagggaacaccacaaaagtcttggacttattatgggtcagtccctcaaggcacaggaaagccatgtggagctgatggagttgactatgtgtaccccacatgcaccacagctcaggaatccaggaaagcagccactcagggttttatatcctgagctaagaagacacacagggctaaagtgctaacggacatcctattctatgggaaactggtatagagcacaggtaggttgttctgctcagttcctctccatctcaggatgttacgattccagcaaattctacaattattcttgagaactcataaaataagcaagaaagtggagagaactaagtcagtccagggtcattggagaactgttttgcaattaccccaccacctagacatcccccttagcaaagctagcatatttcatatgcccaccaacttcccttgaactggaggcagaagtttatcttttcagattgatgaagcaccttgactaacacaacttcaatgcagattatgaagccatagtgagagtacatttcactgggccacgaaaagctagtaccactggtgtagggtccagccctgtggggcttagtgggggttctccccatgtgcagagatgagagattgtaataaagaaagacacaagacaaagagataaagagaaagcagcttggcctgggggaccactaccatcaagacgtggagactggtagtggctctggacggctgggcacactaatatttattacatacaagacaaggggggcagggtaaggagggtggatcttccaagtgattgataaggtgaagcaagtcacgtgatcataggacagggggcccttcccttttaggtagccgaagcagagagagagaagacagcatacgtcagcattttcttctacgcacttataagaaagatcaaagactttaagactttcagtatttcttctaccgctacctactacgaacgtcaaagaggaacccggagtatgggaggaacatgaatgtggacaaagagtgtgaccattgaggcacagcaccacagggaatggtttaggcttccggatgactgtgggcaggcctggataatatccagccttccacaagaagctgggggagcagagtgttccctgactcctccaaggaaaggagactccctttcgcggtctgctaagtaaagggtgtcttcctagacactggcattactgcttgaccaaggagccctcaagtggcctttatgcaggtgtgacagagggctcacctcttgccttctaggtcacttctagcaatgtcccttcagtacctgacactatactcttaggttattcctaggttatattagtaatgcgacaaagagtaatattaaaagctaatgattaataatgtttataatagtgattgataattgtccatgatcatctctatatctaatttgtgttatgactattcttattctaactattttctttattctactgaaacagttttgcctgcagtcttttcctcggcacctacgtaatctttcacacacacactggcaggagggtaagactccccaaagcagtgactaagatgttaagaagtgaaagggggatctttcagatgccctattctctgcagccagtgggcctgctttaggatcacctctacttgtatttctagaatacccgaggtgtttatccaggcacagcaggtagtattgggtgttggtaattgcgtggaaagtctccgttgggttcctcaagaatgtgcccattgtcatgcggattgggcggttgtttcttggtcagagtgaagtctcatggggtatccaaaaacatgacataaattcctttcaaaggtcaccatggtagccccagcatctaactgagtgacatacatttagctgtccaggaagcaagctatggccatagtccttttccctacacaggggatcctttaatagttctgccactcagttgctattttcctgaccagatggctgggttgttggcaatggcccatgatttagtggaaatggagcaaaatatagtgttgggggcagcctgcatggctactatcattgcatgaagtttggcccactgggcagaatgtccatgttcagtgtcagtcaaaagatgccatcccctggctggatggtggcctcacccagtggacccactggcatgtattttgtacaatcatcagggccccatgccatactgacataggcatgtctctgaatcgttggctcattgtggccaaaggaaaaacaaaattgtcccctatgggtcatttgttcccttctaggaagcttgctatttgtttatgggcattcatccatttgcacatggatcctgtgggaactgggttagggcgaattctgactgtaccagttccatttaataatttggatctgttgggcctgtccagttttattgattgtgtttgtaggcaccaaagtgagaatgggtagttaaggtagcagcgtcatccctgatgctctagctatgagataatcagcccctatcagtttcctacagcaagaagttgccattcaaaagaggcacaactggtggcttctgttgccacaggctccagtcagcatatatagaaatagtggacacctggatttccattgagcaagcagcctctgaaggtcttaaagaagtgcctcagtcatgccttgttgaacagattccaagggtgattttgactaacatgaccaaaagaacacccaggtaaggtttctactgtccccagtaccccaaaatacctactagcttctgggtctccatcttattagtggacgccaccaggaccagcaatgattaaatatacctgggatacctcctaggtttctttttcaggtggccttggcattcagccttcaacaatccatcattggtctgccaaactgggttgttccattgtgacaccaggctttgtgacattttaatctttttgtagcaactattaaatttactaggtagtgttccgatcttcactgaatatgcagtcctgctttgtgaacaacactctgggacacgggaagcttaggtggcaggcaggagtggatatgccccactgtcgtgtcttgaatacttagctatgagtgcggatagcccctcaggcagcagtgatgttttgtggcacagcagcaaaatgtcagtacctctattgcactctgcagtgagaaccatggtcaccagcacccaacatagcccaaagggtgtggtccacatgcagatcagcacacaagcacatactcaccatggggtcctcatttgtcttgacaccttctgatgtcttcagtttatttttttccagggaggacctggtaatattgtcaggtggattgcagcatacaaaaatcccagaatagtctgaattcttttttttttttttcaccttttatcttgagaggaatatagggctggtagcctctggtggagaccttggccctgttcctacctgtgccattcagacagacatttgggtctgcaatgtggcttaaccaaacaaacacaccgaccaggctgcataagacttccctcgtgtttttccatgtctcttttatagagagtgagcctccttttctgtgatggccattgttgttcattttggttccttatcagatgcttcagggaccattgagattatctttcttgtgtcatcttgggtgactcagggtccatctgattacccatgtcttgagctctcttgcctcaggaatgagcaatcatgcaactgtctaacaactagaaaattgtgtaccccattcctatttccacattcttttttctatgtctcaattcagtcagccagctgatccatattaatgggaggaggacaaatgtcctgtttatcctccctcctcattaaacatccatctgcatgtccagcccttgcatctccaggctgatatctctgtcctgggccaggtactggagagtattgttcctccaacttcaccataagccatagttctctcaaatcaaaccttctcactgcaccaattttgccaagaaggtttgctgtgcactggttgccaacttacccaaatctagtgagacagaacacccatgcacaaccagttacatgaagtggattactacttacagagagtcagcatgagagagcacaaagctgtcagggcctgattgactctagaccatacatacccaacaaggactgcagctgagggaccctggaatgcagtccaccctgggttttatgtcttagaatcacatgacacactgggctagagtgttgagggaattcctctttgtagtagggacagaaacagagcccaggatattttggccaatcttgttctagctcagaatgctacatttccagaacattctacagttattcctgaaaactactagcaagaaagggaaggagactgggttgattcatgactaaatggaaacttttctgcaaataccaaagtgaaatcataactcggtatttttgagactgggttatttcacttagtgtagtgtcctctagttttatccatgttgtagcgtgtgtcagaatttccctcagtaatgtgcttttgtatgtatataccacatatggattaccaattccttcctttgtgaacatttgagttgcttctaccttttggctactatgaacaattcggttctgaatgtgggtatacaaatacgtcctcaagttaatatcttcaattacttgggtatgtgtccaaaagtgtaattgctgagttatatagtatttctatttttatttctttgaggaattgccatcttgtttcccacagcaggtgggccatttacatcaccaagacagtgtccacaggagttccagttccctaaattctcaccaagactggtcattttctgttggaaaaaaatcctaatatgtgcaaagtggggtttgtttttatttttctaaggattaataacattgagcatcttttcttattctagttatctaattatctctaaagaatcttctttagggaaatgtctattcatgtacttttctcacttttaatcagttattttatttttactgttgacatgtagaaattatttttgtatagtagatattattaaccccttatcagatatgatttaaaaatatttttttctgttccacatgttgcattttcactgtgttgattatgtcttttgatgcccattttaaatttttatgaagtccaatttatcttcttttctacctttgcctgtattttggtgttaaaggtgttagtatttaaatgtctatacatactgacttactatactgagaaggtcacactccaccatctctctgatggtggagctaagagttttacactctcccattttgtaccaggggacagtgcagctatgtgagaacccagtgactttcccgagcttatttgtcttgcatttttggtgacatggattgttgttcacattggcttcctctggcaggtccacctgaaaagcattatatttagcaagaaaaacaggaggcagtgaatgatgtcactgtggattgtgtatattccctgttgcaaatgtcaaattcgtgaagcataaagggatttactagggatattaaattccttgcaaattgttgaaaagtcttaaggaacatgctcctggcaaagcctctagaacaattccaagaatggcactgctggtgcaggctggggaggagctcctgctgccttagactccacattcaagctgtctcctgcagaaaagagagcagctcttctcactactgcccccagaaggacagccgctctgctatcaactactagaaaactgacccctttctctgcatacctgcctgtgttgattacatcttcatgtcagtctcacatagattcatctgttttcaaggctgcagggtttatttctgcccaagtccatcctgtggctttctatcataagtacacatctttctacacttgaatttccaggcattactagtatcaaccacaacaggctacaatctaacataaatattttctttacaaagaacatcatgctaccaatgtagcactgtgctccccaaaatgtgaggaatctccaatctgttcagcccaacaccatccaggaaaaaatgatcttctctcatgagccattaatctgtgtacatattatttaatatgtggtctatattataaaggtggctaaaaatagcactttgatttttttaaagaaagggtgtattgaaaagactaaattatttaacatacatatatgaatggctcatttcgttattgtcaccagcttcttccgtatttattttattctctagtttctggcaataatttctctatggtagagtctggaaaggctattcctcatgtccttggcttcctaagtcccataggtggtgaagaatgcccatcagatgtgttactacagagtgcttttggattgagatgagggaggggaagtgcctgatctcactcaaatgtactcaatttcctggtctgggtcacagccaggcagcacagtcttgtgggcacagtatcttcacttgccatgtttctatcaaaatgagagtatcttccttcactgtggaaaacacggggtgggcagggtgagggaatagcaaagggagtacttggagatccctaagctgccactggtttctccaaatgttttcaatccatttaattcatgataataaacacctttctacctaaccagtcataatcgcttttctcagatccaactgattcagtgataaatctaaagagaaaaaataaatacacttttccacgtttaagctgaccatgaatgtttccacctccatatcccactatgcgtttcatcttccctttgcctcactggcgatccaagtgcaagtaatgcttcacatgactgtgatccctagaacttctacctgatgactgttgacgtcttctctgagttttaccagtggaaatggcaataaatagaaacattccagaaggtcccctagggtgcatattttctgtacttcctctctaagatatgtaaaatcaattccatttgctcttgctttatatgaactagacctatggccccagcaaacaaactaacaccctgtgttgacaacttatccagtattgtctttaagtctaaatggtcacatgcttatatcatttcttccaatttcttgggataattgtcatgtcaactctttggattaagaatcatcaaccaggccaggcgtggtggctcatgcctgtaatcccagcactttgggaggcagaggcaggcagatcacgaggtcaagagatcaagaccattcctggcccacatgttgaaaccccgtttgtagtaaaaatacaaaaattagctgggctacaggtggtgtaccccctgtagtcccagctactcgggaggctgaggcaggagaatagcttaaacctgggaggcagaggttacagtgaagccgagatggcgccattgcactccagcctggcagcagagtgagagaccgtcttaaaaaaaaaaaagaaccatcaaccagaaaaccacagccctgagaaaacagaaatagagtatttcaagctgttcagttggcgttaacaatggtaagtctacagctcattttcaagatatatatattctgtttaagggagtaaaagcacccatcacggttaatgtttcagagcctccaccacttctgatcgtatagtaattcaacagcacaagggtttgtgtgacagctttgcttgactaataataggtttttccctgtctatagggaaagttgcacctgtgcacaagacaagatcataagctacacttcgctcttcttttttgaggtaaataacttgcttgatccaaagccattttatggaagaatttcctgattctgatgaaagcacttggaaaatcctcaaataatattttatgcagaaacataaccgataagaatggcaaattcatatataggaaaataaccagtgctttccttatgttacatgaggtccactagtatcacctaataccagctgttagtctgagccctgatgtatcatacaatgttaggggttcttcttgacaaattagatgttcagaaaagccggtagccctgtaggtctcagttagttgaaagtcatattattgagccccccagagacctccataacattggttcatgatactccctgggaaagctgggaaaggtgactgactgaagtccatgtgttgaatcatcctcattattaaaagccccctgctcattaatggcattttgattaatactcacttggaaagcatttttttggattgtggctcatttttgaaacatctcatcatagctcttccagaatggctttgtctgcaatcatcctgttgtgtttcttttaagacctgatgatctgttaaaaccaaaggccaatattataaaaatcctcttctctttgcaatgggatcatcagatgtaaccttacagtttacccacggttaggatttttacatttccagggcttccttgacaatggcactgatgtgactccatccagcatctattgttgtgaggactctatctggcatatcatcattgtgggcatgaacataatggagattttcacaggatgcaatggttaatattcaacgttagtcaaaatttcttctagtcctacccttggagctctactgggttggaaaaatattttcatgtaaggacaaccatttggtagagttttaaaaataaaggctaccaataaattttctgtagcaagagtatgaactatttgtggtccagaatacaattttttatggaatgtaacaaaaattatttaaatgtattcaatgtagataataattttacaaataggcttatattgcatatataatagaagaaacacaattaaacataaatactatatatatgtagccattttaacaaataagtatatatttatttatacatatcttacatacatttatgcatatttttccacaaataaggtaaattttaattttttattgaaatattagttttaattttgtcattaattttcttttaataactttataatttgattactaaatattcacatttataccaccaatttaagaaaaaatacatgtgtgtatatataggtagaggtgtaaataatgtatcagggagcttttatgcataatgattggtaactggctaaatacacaactcagtgactgataacagtaaatatttgttttcatgttcatggatgctcatgttcacaatcatctggctgatcaaggaagggctcaggtaagtggtttctctgcatggcactgagcttgtcttcagcctatacatattaattgtcttaggacaaggctgaacagcagtgactacccatgactcaagattcttctggcaggtcacaagagtgaacaacatcccaaaccaaactgcacagctgagtttaagtccaataatttctaacatagcttcacacattttaaatatattcctttatttcagtgagtacaaatttttaagaaaatgttcactccatttaattatagaggtgtttgatcattccatggacaaataactatgatttcaacttacagtattgaaaatatttgcaaatgtaaatttgcattaataagaaactgaagctggatgtgttttcaacacgtggctttaaatataatatacttaaatggcctcatgggagaaaattcattttaacttacataaatatccctttttgcctctcttttgtcctatagagttgcccaataagaggtccttccatgagatttggaaatcagaaaaggatgactcaatattctccattggtacctaagacagacacagggacagggatgaggacaggagaaacacctgaaaagatgctgtaggaagctgagagcatcagcacccccacccctaagcttccagacaggactgaggaccacatggttagatagcccatactttaggggcagatggattctgttttctgagggagcaccagagaatcctgcttctaatgtcagctttcatgactactatatccttggccttgaaaggttgcagtgtgaacgttaatgtaggaattgggtcattcttgacatacccaacagagccaagaaaccaggagggaaagacactcagggtgtaaaatattgtctgaagaatgcaattgaaataggccctattatcccatggaagtaatgtttatggttttttgaataaacatagaaattgacttccccagtcttaaaactcaagttagttacatttgtcttatctgagttcctttttcaggaaacccaccaagaggcctccagatactatcagagagctgaaacttacatatcactgaatcaggacagtgagacgtcagacccttcacacattgtgattgcctcactgaccttctgcttcctgttgacaaaattaacttcattacccctccctaattcctgtttgcccacatttcttccctgctatataaccccctaattttagtttgtcagggagatacatttgagaatggggtcccatttccacagctgcagcacctgattaaagcctgtttcttggcaatacttgttgtcttagtgattggttttatatgtggtgagcagcaggatctacaccaaatccctggcatttcagtaacaagattctctgcaagcttcactgctttggcctcttgtaaccggaaatcaaattcaaccccaacttctgaataatttaacataattctaggattcagtttgtccatcagtgcttaccattctgagcttgccagctcccaaaattttctggagccaataaactttctcaaagagcaataggtaacattttccttttttcatgaaactctaagcttctctttgttctttcaacatattgaagaccattgagtttttctgtatgccccatttagcaaatatttcttagcaaataaaacatgaaatttgagattcatctctatatttttatttagacttccatagtttatactctatttctctgtatcaagacaattcctgcttagaatatctatagtggcttcttctctgttacttgaattccaactgaagccataaactagactcctcaggtgtcatgatccctgccttttttaaatcaggagaggaactgttatgtctgtgcacctggtgctgagaaagaaaaagaaattgggatgcagaggtgacttcacatccccctctaccaacaccatcagagtgtgcctgcatctgaggaacactctcagctgatggaggaatcaggaggagcagctggggcagcccggcctcacatgtctgcttccctgggggtttatgttcaggtttgtaacactgtgggagggtaactattaagctgttgacagtaataagttgcaaaatcttcaggctgcaggctgctgattgtgagagtgaattctgtcccagatccactgccgctgaaccttgatgggaccccactttgcaaagtggatgcagcatagatcaggagcttaggggctttccctggtttttgctgataccaggctaaataactgctaatgccctgactggcccggcaagtgatggtgactctgtctcctacagatgcagacaggaaggatggagactgggtcaactggatgtcacatctggcacctgagattggaaatataaacacaaatgtccatagaattaatcatgttgtaagagaacttccctcaagagccaggctgtacggaacacactgggctgagtaaattcctagtgttctccttccttacctgggagccagagcagcaggagccccaggagctgagcggggaccctcatgtccatgctgtgtcctgactgggactgactcctgcacaggtgtgaccagcctattaagaagtctttagggcagggggtggtgctctgggaacaagcaaatcggcagggggtggggcaggctggatacagctgcgtggctggcttatctcagtaactcagcacaggggcagtgtccccagtgtcccaggtcagaccagggcacctagatttgcctgcagagaatgtttcttcctaaaggatattttgttaccaagtacatttttgagcatttattggcaaatctcgaagtggttgtgagaactagatggaataatatatttcaatgccgtattgggcataagtaggagaatatccttgtttgtagagaattcttaataaagtcttagagagtggggctatcaggtcttcaacacactgtgaaattgttccagttgggagcgatactttgtgacatacatactacatttttgtaagcatgaaattgatctttttttaagtaaaaaagaacacttagtcatgagcaagtaaaatgttctcaaaagcattttgtaatggccctaaaccaatgttattaccagtctaagctgaagaggtttactgcagattgacaaagaagatgatattgggattccttaaagcatatgacatccacagttcctgcattgtccagagctataagtctctttaatgctcgagttttaatgggattcattttattctctgcttggggacccccatattctacccccttttctgtcattgtgaattatttcccatggtccatcagcataaaagtctgactagcaatgctaaatctgattactttaaaacaattttttttcttcttctactacaggagccttgattagcataaacttgaatctttgtgttagtttgcttaggataatggcctccagcaccatccacagtgttgcaaaagacatgatctcatttttcatagctgtatattaagtattccatgttgcatatgtaccacattttctttatccaatctacaactgatgggcatttaggttgcttccacgtctttgctattaggaatagtgcagtgatgaacatacacatgcatgtgtctttatggtaaaatgatttatattccttagagtatatatccaataaagagattgctgggtcaaatgatatttctgttttaagttctttgcaaaattgccaaactgctttttataatggctgaactgatttatattcccaccagcagtgtataagcattctcttttctccataaactcactagcatctgtcatttttaagtttttaataatggccattttaactggtgtaagatggtatctcactgtggttttgatttgcatttttttaataattagtgattttgagcactttttcatacgctttttggccgttaatatgcttttttgaaaagtgtttggtcatatactttgtccactttttaaaatagtttttttttgcttgttaatttgcttaagttagttggaggttttttaaggaaaaaaccagaataagagaaaaagaggaaaatataataccacagaaaacacagactgtggtaagtattgcctcatggatatatatgtgtgtgtgtgtgtgtgtgtgtgtgtgcatatatatatatatatttatgatacatgctgtgtttatgtgtataatgatgatccagaaactaaagggtgactggtttaaggactgcctatgttgcactgaggcttccttcttttcaaattatgaactaaagggtacagcagtacttgcatgactctcaaaaattctagcagcatgagatagaggtagaggagatttactgagatagatgcattggaagctgtagaagctcgtcctgtgctgttgtggatgttgtgattgtagtagttgttgttagtacagtgggagtaaaagcagcttgaagatttacaagctcttctcttcctcatacttacaactccctctagagatgcatcagtgattgtacaggcatctctgacacctctggagaaatcttgttagctcaatccagaatcttacctgataaatgttttgagtctcaaattatgtgaaactagggtgtagaaaaaggactagagcaagggaaaataatgttcatgcctgcacagtggttgtagacaggtaaatggggggctttataagtgtgatgatgtgccaaacctctgtcaccacggggagagaagcatcaaaccaggatcacttctggaagaatcattaggttattttagatggaaggaactgtgaattccttgccaaatagatttttaaaattcaaagctactcattacgtgttaatattatttaacttctttaaatataccatgtggtagagggcacatccactatttcaattcagggtttgtatgcctatgtgaattacaccattaaaaacacagcaaattccatattggttggggaagaatgtttgaacagtaatcaatttcgtgaagaagaggtttatgtcacagcactttccacagtattacatacaaaaacagtgaatgatctcatatccacaagaaccagcatttctcatgtgccacatatgccctcccagaaagaattgaagcctgtgacaagttgatgaaaggggtagaaaaaagaataaaaccccaaaacacagcactataaatggaaaggggaaaatcattgcagagcctatgattataaaaatacaaaaggtggatattctgagtatttttatggcaactagcttgacagaagtaacaataactttgtattataaatttacccagaacgaaatttccaattttatatctgcctgactggtgtcttgataccttatcaaaattacacaaattttcaagagattcaaaaagaataaatactcccaaacttatcatatgagatcaccatatactccagtccaaaaacaaacaaggacgtaacaaacggagaaattaaatgctggtatctcttgtgaacataaacacaaatattctgaaaaatagggaaagaaggaaaatataatcatttttatacctatatgtttgtgaacacacatggttaagtgtattacagtttttatgctaagaacacttgatatgtaattacaagttctaaaaaattgatatgaaacggaagatgtgacagttccattttcctaacttttaaaagaatatttcatcttatttaaatattatttttatttttgtatgactttttgttttgcttagacttttagttgaaatgaataatgaatgtgtattaaaagcctaccattttgatttaatctatgaagggtatttaaattctcattctatagaagaaaaatccaaactccttagaaaagagagatcttgccaagagctacacagttcttgtttcggagctgagattttctctcagatattctggctcatacaattttcagtacactacagatagaagatgcaaagacaacattacccaattggtcttgcacttactttgttcactgttaactaagtttactgaaaaaaaattacaataaaatacactgtcaaagaactgtcacaaataaatacatctgcagaaccacctccaaaatccagacatagaacatttctataactcccaaaagttttgacctactcttttggaatccacttgctttccaccacacagatcagggaattcttgatctgcttattgtcagtgcagattccaatttctttttaagggtttcatataaatgaaatatagcatgtgctcttttgcatctggtgaattttgtgcagcataactgcttctcagattcattgagatgtcatgtgttccagttatgtgctcctttttatttttgagtgttatttaactgtttggtaattttataatggatcctttcacctgttgattgccatgtaagttgtttccactttgggctattacggataaagctgctatgaatgttcttgaacaagactttgtatgaacatatctctttatttcttttgggctaattcctaggcgtgtagttgctgggtcttacagtaagtgtttaatactctgttcaactttttccaaagtggctgaaacattttacatgtccaccaataacttattatagctccacaccctccaactgctgttttgattttttttttaagatttcacctaattgtcactcaacagtaaccagaatagctagtgattattaagctatgtttttctgactattttcttgtcaattttggtggttgatgtgtttcaggatattgagaatagaatcaatgccatccaagctccttttcaaataattttatcaagccataatatttaagatggtaacaaggtatatacaaggtgtgttgggagtagtaataagtgttttcaacatttattattatcgtactccataaggcaatatgtcttcaatgaaatagtgtttaactagacttaggatagaaaggttctcatctcaaccctagtattcaatattaggaaaagtttaaggaaaaaaaaaaacatccaggaaaataagtcagagagtgttttgctagtcaagaaaaactgcaacactgatgctcttttaatgccagaccttcacaataatttccactcagatcatttggtggcctccttgccttgttctccttatgggacttcattctgagggcatgtgacatcacagagggagcagtgcacttgggtacagaaatatggcttaggggattgtctggccttagaggtggctgcaatggaatatacattttcaaggaagttccctgttaaagctgataaattgttagttaaggcaaggtgcaggggcttatgcccgttatcctagatgtttgcaaagtcaaggatggaggacagctgaaagccaggagtccaagaccagcctcgaaaaaataaggagatccccctgtctgtagaaaaaaaagaatgtttggtaagatgtggtgtgaacaatgacatctataagagattatttattaacatttgctcagaaaactagaaaatagaatgatgtcttataatccatcaatatcataataaaaatgctaagtttttcaactatggtaaatatagagaacataacattgcccatcttagccatttttaagtgtacagggcaatggcattaagtaagtcacattgttgtgctatcatcaataatagcaatctccagaactctttccatcttctaaaactgaaactctatttcaattaaatgacaaccctctccccatttcccctgcttcaagttcctggcaacctccattcaagttctgtctctatgacagtgactactctgaagcaggttcactgtgccctggttaccaacttatcagagtccagggagacagaacaatcatacacaacaagttacaagaatctggtgtagtatttataggtggccaacaagggactgcagaagcctaggatgtattgtgggtctgtcccctgaggcacaggcatgtgggtctgatggaatcttgactgtgtgtaccccagttggaccacaactcagcaaccccagaaagaagatgctctgggtttttaatcctggtgtcacaggacacatggagctaaagtactggaggactaaagtactggaggacagtactaggagaagctggaacaggggcaggctcttctgaccagtctctccctatttcagaatgttacatttccagcacattctacagttgttcttgagaagtgtaagaaagagagtggggagaactaactgagtcgagaaccattagaggactgtactggagtcacccccaacccaaacacccccgttagaaagccattccattttatatgcctactaataaccctgaactggtggcagaggtgtgtcttgtttgactgatgaagcccctcgacgaacacaatgtcaaagcaacatcatagagccagagccagaatagatttcactgggccaatgaaaactactaccagaggcaggatgatcaggcccacctgaagcagttatgtagcccaggatccaatgatccacagaagaagttgctaaaggggtgaaagaagaatccttcaggtgggaccattttcttcaattacgagcctgtttccagatctcctctcttgaatttctaggatacctgaggtgtttgtccaggtacaacagaaagtgttggaaattgtatacaatcctcccagttgggattttaaaaaagtctagagcaacactgttatctaaaacatccatcccgatggagttaagggatgtctgctgggctaccaaggcagtggctatggaggaggagccatatctgccatggtcagggacacatttcttatcatttctcttttttacatgagcactgactcctatacatagtaccaaaaatatcacaaaagacataaacccatagtctgttataccttctggcaggtccctagtaagtctgaggtacagctttgggctgcaggctcaatggttcacctaattccaaggagtaatatccagagacaagcccagcatgcccaacatgcagaatctcaccatcccacagttatccagagatggcatcacacatcctgcattttgttcactcccagaccattcacagagaaatatgtagcccttgggtgcatacagccccctttctcccattttattgtttaatcacccagtcatggttatgcaggtattggtgtgttcattagccaagtctcactgatggcagagttgaaggagcaaagttttgctcagacaatattgttcatagacagagggtagcattagtcctctccttgtttttgtctttgccattggggcatttcttatctatgcaatcaaagaaatatggtacatcaaaatatcagtccaccaatgttttttttagttgtggtcatgacatttgccacagagtcaatttagttaaatggggggcctccagttttctcccatgtggtaggtatcacatcctcagttggtaggccagtgcccgggtcctgttgatgtacaccatgatatcagtaatgttggtgtcatttgccttcagtagaatgaaaggaaacctctagttagtgacagaacgaggtcaagaatggcagattcagtattttgaaagattacactcggtgacttgcaagaagctaacaaagatgttatgcttctaggcctttgctgcctcattcttgccaaaatgcagtgtgacaggttagtgcatcatctctcacccatcccagggtctcaggtgtctcctacccatctacaagggttaggctgtgttggtgtaagaatgcggcctggctgtccttgctctgtgaaaaatccattgcctttgtcacttgacccagacatttcagtcctgattgtccactgcaggaagggagattatgccctgtaaaaacttgacatatttcataatatcaccaatactaaaggaaggataagatggccctggcaccagaagagggcccctagctccctgatatttcttagtcttgtcatccatcctgtgggatcttgtagaaaagaggcatttagaggaaacataatccccatattagagttagggggcctgtctggggtaagatgatggcctgaattgaaaatcaccccagggcatgcattctaaaggaaaaaaagaaaaagaatggttaggaacactgaaatagctttcacaggtccagactaataaagggtctgcctggtctaccttcgtttccactcagcattatgttccttaacattcattatttcccttgttctggagtgcgatatttaatgcccatattgctctagtaagatggggtaccaccccattagcagactttctagatgtcctttctagatgttgctgtgtgagtccattgttctagcattcactagattcattggcctgtggatgcagggtgcatggaaagttcatcgtgttccatgagagtgtgcctattgtcatgttgcttgggcagtgaaagatgctccttggtcagtgtgaagtgtcattgggtatccaaaaatatgatgtaagttcctttcaagggtgaccttggtagtcccggcatccaattgagcatcgtatctctttttcctgcaggtggaaagctgtggccatagtcctttcctccacaccagggattctttaaaagtccagtctctcagttgccattttcctgaacagatgttgaggctgttggcaatggcccatgatttagtgggaatgtggcatggtacgatgttggaacagcctgcatggccattaccactgaatgtagtttgacccactgggttgaaatcccatgctaagtttcagttaaaaaagtggccatccattggctgaatggtggccacacctggtggacctgtcagtttgcgttttcctcagccatcagtgactcctgccatatggaaatctctgaatcttgggctcgacatgggtaaatgaaaatccaaattatcacctacaagtcatttggtcccttcaacaacctctccatttgttcatggagccacagatcctgtggggtcctgactaagcctgatcaagaatgtgccatttccatttgataacctgactctgttgagattgttactgccttgaaagccaggcaggcgcttctcaactctgtgattcttcccaggaaatacgtgagaacttccatctgggttcatatctcaaacacaacccaccagtctctcacttgctgccctctgctcaaaatcttcacattgtaatttttcatggggtaaaaagttagcttatatattatcttgtattcattcaaattctgtttaaataacatacatatgttcctttattctttcgaactttgtccttatttttgaaacccagctttggagttcagaaagctacttttgtacttcaatatgctgtgagtgagactgtgcaaacactttagcaactaggtctttatttttgcatacatttgccacaacatatctagtaattaaaaaatctagactgtgaagagttttatttggcttctccctgaaaaaagtaggataaaatacagtgcttgctgctgttctggtcaagggtcggccttacaaaaagtggaggggggaggtggaggaggggagggaaactgatttaatatcaccagatcttatcaatgtacatgtactctggtaactgctaaaccaaatcaaaagaatgtgttagttttgtgttgccagtaatcagtctcaattaggtgcctgttatgcagaatgaatttagttgatgaatgaacatagggaaggaagagaggattagaatgagctctcattgagccttctcttctcttgtgtctcattgctcagagggcacgtggacctcctccatactgcagactctgtcatgcaaaggctgctgcagctgacgggaccttaaaatgtggtgcctgaggtgtagccaagaaatttatggtcatgagccctcagctgcaccaagtcctctgagttctccaacatcttggtctttaggcatctaagagaatccacagtgcctgctctccacagaaacagcacatctgggcagctaggccacagcaagtgggggggtttgtgttcaagactataccattgtgggaggataatgtgtactttgctggcagcaataaaccccaacatcctcagcatccatcctcctgatttcagcatgaaatctgtccccaacccactgccactgaacctgtctgggactccagggtcgtgattggaaaccaaatagattgggagccaaggaggctggcctgtcttctgtaggtaccagttgaaatagatgtatccattactgtgaagggggctgtgactagacctgcaggagatggaggctggctctccaggggtgatgggcagggagagtggaggttgggtcatcacagcatctccattggatcatgaaataatgagagagaagtgcaaggttatgtgcaaacattgtgagtcattttaatcattttctgtctgttatttatgttttgctcaattatttttgtgtgtgtgattttgattaatcctcccaaaacatacagatttaaaaagaaccaatatttacatatccttgctccttctggaatcttcctcactctcacagatctagacatcacatgccccatcctggaggacaagacacatctaacacgaggacaggacacacatgggaggtggcggggtccacagagttcaccctcccaccccatcatcctccctcatttcccttctgcccttaccagggacccagagcattagcagccccaggagctgagcagggagcctcactgtgagaaggtgaactgaggagtcctgatcagtcaaggcaaggttagagtgagctttcgtctcagactcacaaggaaagtcctccctaggggacagtatgcaaatcccctggtgggtgcagtggggtggaaagagccaaggagaaggtgggggcgtctcttgtgagcaaaatgacataaatatattttatgtttttaaggaaatcaatagaggtaaaatctgtgttgcctgagtggcagaagggacgtatttagattttcctgctgtttcctctactagacttctagttctttaggactttctcgggcatgttttatgtttctttttaataagcttgatctttcataaatatttgatgattcttatttctttgtttaggtttatttaaaagagtctaggtttgtttattttattttattttattttattttattttattttattttattttatctaaggtaaaacacacagtgcaaagggtgcaactcttaagggtgcaaatgaatgtcaagatccagatcatttcatatcatgatccacatagaaacgcagaaggtttccaattctctcgctgctttcattatgcaccttcccagtcaaaaactgctgctcaaaacacaatcaatgtaaatgatattctgacatataattgttttagtcctggacttaatctttatatcaggtaaagtaaacattttttgtagcttctttctaacttttttcattttttgaggccttggttccttcttgtcaatttgagttgctgtctgctgtcattctctgttattctgaagaattttctcttgaatctcttacaaggcatatatgctattaatgaattaatctttgtgtatgaaggaatatttctaccttgcttttatatttaaacgattgtttttctggatatagaatttgtggctgagaatttgtggctcagtatttaaaaatatcattccactgtcttctcacctccatttgtaatggtgaaaatttagccaatgattttaatattgcttcttagtataaagtaagtcggtattttagtgatgcatttcaaattctctgggtctttgtctttcaacactggtactataatgtgtatagttatgaattgtactgtgcttatcctaaaagggtttcactgagtttctttcatgtatagattaaggtgtctcatcactgtaaaaaatgtttttcattatttctccatttttttctttttcaatttttattttaaaatcagagcatacatgtacagatatgttacaaagttattttgcatgatgctgggatttggggtatgactgaacttattaaacaggtagtgagcactgtaccccataggtattttttcagcctctgcccttcctccctttgtctcccctctagtagttcccagtgtctattgtgcccatcaaccgtggattggataaaaaaaaaaactgtgtatagatacaccatggaatcctatgcagccataaataagaagaaaatcatggtcctgcagaaacttggatgcagctggaggtcatttacctaagtgaactaatgcagaaacaaaaaaccaaataccatgtgttctcacttataagcgggagctaaacatggggtacacatgggcgtaaagatgagaacacagtttttagcctcttcctgtcttctcctttgtgattcctaatacaaatttgttggtattgttcacagggacctataatgtctgaggttttattcattcttctttataatttttcccttctttatatgaggtcatttctattgacttctttttcagatcactgactctcgcgtcatgttaaattgctgttgagtctatctaatacatttttcaattgagttgtacctttcatttttcggattcccagtaggtctgttttcatagttttgtgtctgtttgagagcctctatttgttgaatcattgtctttacaaattcctttttaagtcttttattataggttaaaataattatttgaacatatatttgataagggtggagcacacagacaccatggagatggaccataaggcagggagctcagaattggattagttgaatttggagtctctgactagatggtgctcttgtgagatttaattattttccatgtttcatgtttctcacaatacaaatagcttttattttttaagatggtaactatgaacagaaattcagcttataaattcctgggaattcctaataggaaaattgatgaaaaaatggtttttcttaggcccccacacctgcctctgcctgggacctgactttgtctctgagccggcggaatctatgatgaggttttgagttgggcagtgaaatcatggcagggcaggctgtgctctgggtgctgtggagaacaaggggacactcctgcagggttagtgatgctgggagttcaaggggagactcagcatggagctgcctgttgagtcaccccagcaatcctgtctggacagtgatcatctcacaagtgtacttggatgccagtggatggcccaaatgtgggttcaggttggacaaggacaaagctttagggatgaacatatggggctcatttgatagtctgaagtttcagcacaagcgtaatgaatcatatgggaaaagaaaggagtcacaaggttgtgacttttcatttgatattaaaatatattccctctgctcatttttccctacagaatgtaactactgttacatatttaaccaaagtcattgtttttaattttcattttagtaactgacagcctgtgtgcagagttcctaaataactggaaagccaggccgtcattcctatggctgaagccaggaagtgactgtggatatgaagaaatgtgagtttcatgtacatgtctctaaagccacgggccactgatctggtgggaacctgcagtcatttcactttctcatacccagatgagaggacaccttgatctgtgttcatctgatgatctgatgaactctaaaaactggaccatattctgaaggtctagttcacacttcttttctgtgctagagggactctactcacatgtattgtacactctgcataggacagtctgtgatacatacaagtttttttctgctaaatactcatcaatcttgtcatttatgcatcttctatagttgttacctgacctatggctatggggtcttccaaaagaatgggccagaggtggagctgtgaaactgtagctgaataagaagtgtaagtgtcaagatagggtaaagaagtgttgataataataatatttcaaattagtctgggctcttggctgtgattactggtaagtgggaaagagtctaggtttgttttttttaagttttattttaattgataaagtagccagggtaaagtgcacaaatcttcaatgtgcaactgaataaagtttatgtgtaattcattgtccaggtggaatgatagaatatttcacatactcttgtgcttccctcatggacaatctttgtcagttttcgcccctcccacccagccatagtaactgttattctgacatctaacacaatcacttaggttttcctgtcttgaacttcacataaatagcattaagtgtatttttctctttttagccttggtattgctccttacaatgtttgaggccttcatttcttccagtggactcaaggtcctgtctgatgtcatttcctgggattctgaaggattttctctcaaatgtcttataagacatagctgctatgaatgaatgtacttttttatcaaagaaaatttttttttgctttttctttagatgtgaaggtattttcactggatatagaattcctagtgacttttttctcctttcagcatctaagtatgtcatttcactgcttctaatctctattggtcctaatgaaaacttagccaataacaatatgttgtttctgtgtattggttgggagatgatgtttgacagtgatcagtttgtgaagcagaggcttgtgtcacaatactttccacagtactacatttaaaaatggcgaatggcctttcattcttgatgcagtgaagattttctgtctttcaacattttaatataatgtgttcagttattaatttctattatctaaaagggttttattgaattttttcatctaagaatattttttattacttttgaaaagtttttgtcattatttctccaaggatttttttttcagccactttctctgtctctcctcctttgtgactctcattatacttttgttggtatccttcactctgagctataaatctctgacgtcttcctccttttttttaaacattttatttagactcaataagttctattcctttattttcaagttaactgattattctgccatctcaaattgctattagacctagctaatacgtatttaaattggattattttacttttcatttctagagttccaatttggtcattttttatattttccatatcttttcttgaggccctacttgccaaatcttcttaatattttcttttttatgtcaatgatcatagttttaaaaataattatttgaaaatctttgtagtctttactaaatccgataattacggcaagttagaatcagctttcgttgactattttctgttgtcattattgtagttgctttatttttgttcctttaatattggtcattcttctagtttttttcccaggagctgttaaactgacaattttacatttttgataatacagtacctctctttagattatgggttttttaattttaattttaattttttagaaatagggtcttactctttcacccaggctggagtatggtggtgtgatcatagcttgctgcagcctcaacctcttggggtccagtggttctccagcttcatccacctgagtagctgggactataggggcatgccattactctctgctatttttttttttttaaatagtaagatattttgcccacccagcctggtctcgaactcctggcatccagtgatccttctgcctcagcctcccaaagtactgggattacaggcttgagccaccacgtcaggcctggaatttgttttgtttttctgatcattttttaattttcttcttagttacttgggtgaacttactgatagtacctgacttatgatgcttggagttataactttttgactttcagatggtatgaatgtgatatgcattcaagtagaaatagaaattctagtatttatacaactattctattttctctttcaatatagtattcaataaatgacatgaggcattcaacactttattggaagataagctttgtgtaagataatgtcgcccaagtgtaagctaatgtaagtgttttcagcacatttaggataggataggctgagctataatgttaagtggattagatgtattaaatgcatgttcattgcatgatattgaaaaatctatctcacgtggtgtttgaccactgatatcactgcttccttttattcttaatattaatatttagtttgaatttataggaactgcacatgtatctgcatagtgaagtggtcaccaatgatttgagacgttttgcttaaatatctagaggttataaatctatcttctgtcaacccatctgtgtgtagtttaaaaagcaaactgcatgcaaaatgcagctagttcttgaatccttctggttttactttgcaccggaaactccttgttctcatcactcatatctatatcttctaggtcactaggaatgtgtgcagagattatttcagcaatatgggtctatctcatccaggaatctgctatttactatcagcagatgtactacttgcctcaaacaggtcatcatcttggacttgtaaagctgtgagatttttctgttcatttcctatggagttctgcatgtttagctggaaacactgaataattttttttccactccttggctttactcaagtccacccactttggcagcaagctgctagttttttttgctacgctcatattggtaaaacttcagttctgtaattcatgctgattgagctgggggtagaaggctgctgtcacaggcaaaaggctacagacattttctgtccttactcaaagcactggtactttttttttctataaagaatatgcatccttaattattttatacttcaccaattttcagagtgctgaaatagttttgatacttcagctttatatttaaatgtgtgtttgttgtttatttttgcaccgaagatttattaaactctttgtgatgccataaacagagatgccttctaaaatgcatttagttgaacataatagccacggtgaaatggtacgatgcaatggactaacataagtaattttggacttgacaacttgaactccaaaatggccaaatagagctgagatgctaacactgagtggccaccccactagctgtctgtaaaggaagcagctggtataataatctagtaaacactgatggtcttgttggggtttttgtttcatgtggaatcactgtgggaggccagttgctacgctgctgacagtaataaactgcaaaatcttcaggctctaggctgctgatggtgagagtgaagtctgtcccagacccactgccactgaacctggctgggatgccagtggccctgttggatgcatcatagatgaggagcctgggagcctggccaggtttctgttggtaccaggctaagtagctgctaacactctgactggccctgcaggagagggtggctctttcccctggagacaaagacagggtggctggagactgtgtcaacacaatttctccggtggtatctgaaattggaaataaaacagaaatgcactcatgtaatcaagatcaaaccaactgtctttgagtagagccaaaattgttgatatactttgaattttaattatatttcttgctgagcagaggtggcaagagttttcactaatgtgcaaaaccacctcatgttcccctcacctgggagccagagtagcaggaggaagagaagctgagctggggcttccatggttccctctgggtcctaactgagcagttcctccccagggctctgacacaggcattgatatgggctctggaaggtagggcagctgggagggacatgcaaagcagctgggtgggagctgagcttccagctgcagagaccacctgcttcttcctctctgcactgagcatcctgcgccaccctggttgtcaggccagaaaagtctgttggctcagtctgagtgtagaacttctcccttgtgctcagagaatttcattcctatgtctttcttctcctcaatcacctaaattcacccagatgatgtttggcacaagcctgttaagaacaatataaaaggctgtgttttcatttctctcttcctatcctcaatatgcccagtcatctccctaagtgcattattggatcgatggaaatgaggagtctgttagaacttaatcttccagatacacctttcatttgcttgttagtaatgttttctgagggtcctgaaactttccattaacccagacacataccctctttgagttaaaaagttaaaacttctgtttacagtcacatgtcctggcagccctgacatagatgctccatggcttgccgattgcttgaaattgaccaactaacttaacttccctgtgtctcagtttccatatctgtgtaactgtgacaatactggtgcctaccttacagtgctgtagacagtttaaagaaaataagataaaacatttacagtagtactcaggacattatgtatgcggcaattatttttgtttttattgattaaatatttagcactacagtcatcatcattatcataaatatacttacttggcacagaaaagagtcttcaatctaatccaagaatgttttatcaacagtcaaattaaattctagggctttttcttcactaactgtacacaactcttaaaatcctaatgatttggtcttaatctgtgctaaaatgctcagaccttcaatcattcccgcccatctctgtctaacgcattaattctcatcatccattatcaaaatgttatcctatgaaagtttcccatgtcctgctgctttccttctttcttacataatctttagtctaccttgttatcttttgtcttatttttgccccaggactgacaataaggaaaagctaccatcattacttgtggacttgctccagtataattttgtcaggcttgttatcttggaagtgaggactatgtcttgcaaagaaacatattcattgggtcaatgtgttatcaaataaaagattttatctacttatcatccaataattaatttagactgacttgaacagattttttttaaggacgaaaaggagaagatgatataagaggaaaatacaatacaatatcaaatgctagctattatgactcttgcttcatggatttttacatatatattagacacatggtgggtatatgtgtgcaatgatgatccaaaaactgaatgctgactggcataaggaatgcctgcattacactgagtcttgtctacttttccaattatgaacagaaagctgcagtagtatttgtatgagtatcaaaacttctagctgcctgagatagaggtagagcagatttactgaaataaaagccttggaagtaggagaggttcgtcctgtgatgatatggctgttgctctggttgctgttgttaggaaatacagtgggagtgaaagcaagtagaagattgacaagctctgctcttcctcatactcacaaccccctctagagatggacagatgctggtacaggaatctctgacacctctaaggaagtctctttgctttttccagaatctttcctgacaagtattgtatgagtcacagatgaggtggaagtgggtgtagaagaaaggactagagcgagggaagaagttttcagtcccaggtagttgttgttgccacggggaaactgaatttttcaaagatttgtgccacacttctatcgtgttggggagagaggcatcaaaccaggctcactcctgagagaatcattacattattttagagagaaggaactgtaaatttcttgtcaaatagatgtttaaaattcaaagctatcgagaccatcccggctaacaaggtgaaacaccgtctctactaaaaatacaaaaaattagctgggcgtgctggcgggcacctgtagtcccagctacttgggaggctgaggcaggagaatggcatgaacccgggaggcagagcttgcagtgagcgagatcgcgccactgcactccagcctgggcgacagagcgagactctgtctcaaaaataaataaataaataaataaataaataaataaatataaaaacattcaaagctactgattttgttgttgttgttgttgagatggagtcttgctctgtcacccaggctggagtgcagttgcatgatcttggctcactccgtttcccaggttcaagcgattctcctccctcagcctcccaagcagctgggattacaggtgtgtgccatcacacctggctaaattttgtatttttagtagggacggagttttgccgtgttggtcaggctggtctcgaattcctgacctctggtgatctgcgcgcctcggtctcccaaagttctgggattgcaaacatgagccactgccccggccctactgatgtattactattattcatcttcttgaatacagcaagtggtaaggtgcaaatccacaatttaaacttgagatttctactcctatgtgaattataccagtgaggaacagaaaaattctgtattgtttgggagatgatgtttgacagtgatcagtttgtgaagcagaggattatgtcacaatacgttccacggtattacatataaaaataacgaatggccttaaacccagaagagtctgcatttctcatgagccatactaccaccaagaaagaattgaattgaaactcgtgactacttgatgaagggtgtataggaagagggaaagaaaaaggacacaaaacataatattgtaaatggaaatgagaaagtcattacacagcctattagagtaaaaaaaataaagagaggctaaatgagtaactttttggcaactaacttgacaaaagtggtgcaatcttcacctcctgggttcaagcaattcttgtgactcagcctcccaagtagctgggattagaggcgtgtaccaccacttatggcccttttttttttgcatttttagtagagacatggtttcaccatgttggccaggctggtcttgaactcctgacctcaaacgatctgcccacctcagcctccgaaagtgctgggattacaggtgtgagccactgtgcccggccttaaagcagtattttcatttagtaaagtgtagaagaaaaaacataaataaagtgacaacaagaaaacaaaatgccattatgaaaaatggtaactttagggcagaaaacaagaaaaggcaaaccaagattctcataaggtaagcctccaatccacaatcctaggaggaatgtcaatgctgaaaaccctggagcatccagggagtggccaaaaatactaaatgctgaaaacccagagtacccgagtatcagcctatgagtgtccccacaccaaatgccaggaaaccctggaatatccaggggctgaccagtgcagaaaatcctggagcctcagttgggtggccaacagtgagccccaaaggcctgattgggaccacagaacaatgtgactctggcttcttacggccaacagaacaggagaattcttacatccaagtgtcctgccttaaacaattgcacaaacacaattagcagggagccaaagccaaaactgcaaagcaaacacatatatcagggcagaaaataagataaaatggctgatggataaataaaatggcattagaggagaaatgactaagagaaggaccaaggaggatgtagtcaggtgtgctatggaggacttcaaatggactatcgagtcaaaggccttattccctggatcatccaatataggtcaggtgggcagaggggacacttacaggtgtgcaggagccaaaatggtgccaagcagtctctaacgtggggcctgcgtgaaaatctctccaggctccccagcttgggtgggttgggctcctacggggaactggagcacggagcggctggcctgcatgaagcagtggctctgtggccacttgcccatccccagggctccaccgcctgtcaggaaagatgatggctcttaaaacagcctttggctagtgttaacagctctgcaatgttagcaactctgtagctttgatcgctgtagcactgatcaccgtctcaccctctctcactgatctctgtcttcccaattctccaatagctgtcctgctcattgctgaccgctatgtccatcttctcacaaaatcccatctcttgctgtctcttgttgtcttgctttctctgctgtttctgctgtctcactgccacatcagacgctgcctctcaccatctctagagttgagtggctggcttaatcctgatgcaaggcaagttcttggatttgctcgggaaagaacgttagagtaagccggtgattgaataaaacagctttattgatggggcagcagtgttacagctctgtgactaagcctgtggagcaggcataattcataggcagagggccaagagtagcagccaggtgcagttttacagtcacatttatacccacttttaatcatgtgataattaaggggtgggttatcgagaaatagctcgaaaatgggtcgtgttgccccaacttcccggtgttgccatggcagggcagcaatttccaggtgttgccatggcaaggcgctgcgacttctggatgttgctatggcaatggtaaactgtcatggtactggtgggtatgtcttacggagaggtgttttcagaatcctattcctgttttggccagcctcacatctggtccagagtgaagtgctgcctacctcttacctcaaaagtaacaagaaatctgtaataacaagttacccagaaaaaactccaaattttatttggtggttagtgacatggtacttatcaaaattacacaaactttcaagggaataaaaaaaatactcagaattattataggaggtcataatgtcctccagtccaaaaattaatgaggacataacaaaaaaaggatattaaaggctggtatctcttatgaacatagacacaaaaatcataagaaaaaataaaaatggaatccatctgtgtatctacacatttagtgaacacacgttgtaaaaagtgttacagtttttacgataagaactcttgataggtaattttaatttctgaaaaatttatatgaactataaggtatgttggatctctttccctaacttaaaaaatatttcctcgcatttaaatattttccaatttttaataactttttattacttagacttttagttgatataaataagaaatgtgtattaaaagcctaccattttgatttaacctatgaaacacatttaaattcttggaaaaatccaaaaatacctagaaaagtgagctcttgctagaagatacacagttctttagtgtcaggctgagattatctaccagaaataacttttggctcatgtagctttcagtacactgcaagaataaaagatgtgaagacaacattacttaattggatttgcaattactcactattcactattaaccaattttattgaaaaaaaatgattccaatcaaatactctgattttaaatgtactgttgaacaagtacactcgtgtaaatgcctccaaaatcaatacacacaacatttctataactccaaaaagttttgtcctgctcttcaggaatcaacttgctttccacctcacagaacagaccatccttggtcagcttattgttagtatagatttcactttctttttaagaattttacataaatggaatatagcacgtgttcttttgtggctggtgactttcatgcagcataattgtttcctaggctcattcatgtcgccctgtgtcctcatgatgtgttactcttcacttttgggtactatttaactgtgtagtaatttcacaatgtatcccaccacctgctgatagatatgtgggttgtttccactttgggctattatggataaagctaccaagaatggtattatacatggctttgcatgaatatttctttatttcttttaggcaaatacccaggagtgcagttactgggtcttacagcaagtgtttaatactccaccaaactgttttccaaagtagttgtaccattttacatctcagcccagaattgatgagtgttctcaatgtttcagctacttgtttttaagaatttttcttaatcttcactcaacagtgaccagaatggctaatcatcattaagtcatgttttccttacaattctcttgacttttatgggtgcttgacttgtattaggatattgaaaacaggatcaatattgtctaaaccccctttcaaacacttttcctaagtcatgatatttaggatgataagaggagatctaaagggactgctggtagtagtaacaggcattattcaatatttattatcatactccataaggcaatacattttgagtgaaatagcattcaattagactcaggataaaaagcttctaatctcagctttagcattaaatattaggaaacctttgagaaaacaatccaggaagacaaatcagagtgttttgctagtggagaagtgctgcaacacctaaaccctattaatgccagatctttgcagtgatttccactcataaagttgggttgactccttgccttgttctcctatgtgtctgtgtgacttcatgctgaggggatgtgacatcacagagggagaagtgcacttgtgtacagaaacatggcttaggagattggctttggaggtggctgcaatgaaatatacgttttgaagaagttccctatgaaatgtcttataaactgtttcttctggccaggtgctcgggctcacacctgtaatctcagcactttcagtgaccaaggagaaaggatcaggatcatgtaaggccaagaatttgatgcaagcctgggcaacatagggagaccccatgtctacaacacacacacacacacacacacacacacaatttgtgaacaatgtcatcacaaagtgattatttatgaacatttgctcagaaaagtagaaaataaaacaatgtcttctgagctaacaatactataataaagacgttagttatttaactatagtaaatacagagaatataagattgtctatcttaaccatacttgagagtgcagagaagtggcattaagtatattcacatgttctgccattattactgacataatcagtaaaaatcttttcatcttataaaaattaatatgtataccccttaaacaatactccacccattttctctatccctacctccagcaacctccattgcagttctgtctttatgtcaatgacatgtttgaagcaacttcgctgtgcactggttaccaacgtacttgagcgtgggggaagagaacaccccccacagcaagttacatgaagtgggtttattattacagataagcagcaagggaacacaaaattcttggactcattatgggtcagtcccccaaggcacaggaaagctatgtggagctgatggagttgactatgtgtaccccacatacaccacagtgcaggaactcaggaaagcagccactctgggttttgtatcctggggtaaaaagacacacagggctgaagtgctaatggacattctattctatgggaaactggtatagaggacaggtaggttgttctgctcagttcctgtctatctcaggatgttacaattccagcacgttctgcaattgtacttgagaactcttaaaataagcaagaaagtggagagaactaagtcagtccagggtcattgcagaacggtcttgcagttatctcatcccccttagcaaagctagcatacttcatatgcccaccaacttcccctgaactggaggcagaggtttatcttttcagattgatgaagcaccttgacttacacaatctcaatgcagattatgaagccatagtgagagtacatttcactgggccatgaaaagctagtaccactggtaggaggataaaactccccaagcagtgactaagatgttaagaggtgaaagggggatcttttgatgtcctattgtctgcagccagtgagcctgctttatgatcacccctacttgtatttctaggatatctgaggtgtttatccaggtacagcagccagtgttgggtgttggtaattgcatggaaagtccatttgtttccatgagagtgtgcccattgttatgttgattgggcagtgaggctgtttcttggtcagagtgaagtctcatggaatatccaaaaacatgacataaattcctctcaagggtggccatggtagccccagcatctaatagagtgacatatatttagctgtccaggaagcaagctattgccatagtccttttctccactcatgagatcctttaatagttcagtcactcagttgctattttcctgaccagacagctgggctgttggcaatggcccatgatttagtggaaatggagcaaaatatagtgttgggggcagcctgcatggctactatcatttcatgtagtttgtcccattgggcagaatgaccatgttcagtgtcagtcaaaagatgccatcccctggctggatggtggctgcacccagtggatccactggcatgtgttttgtacaatcatcagggccccatgccatactgacacaggcatgtctctgaatctttggctctatgtggccaaaggagaagctaaattgtcccctatgggccatttgttcccttctagcaagcttgccatttattcatggggcacatgggtcctgtgggatcctggttagggctgattctgactgtatcatttccacttaatgatttggatctgttgggcctgtccagttttattgattgtgtttgtaggtaccaaagtgagaatggttagttaaggtcgcagcgtcctgcctggtgctctagctctgagatactcagcccctatcagtttcctacagcaagcaaggagctgccattcaaaagaggcacaactgttggctgcttcaggaaattttgtgtccaaaatctgagtctggtgcacccagtgacagtagaatcacctgacatcagatgttagtctgagccctgatgtgtgatacaatgtgaagggttcaggaggggtcattcttcttggcaaattaggtgttcagaagagccagtagcactctaaatctcggttgggggaaactcaaattattgagtccccacagagacctccataacattggttcatgagactcccagggaaagctgggaaagatgactgactgaagtccatgtgttgaatcattctcattattaaaagcccctgctcattaatggcatttcgattagcatccacttggaaagcatttttttttttggattatggctcattttaaaaacatctagtcatagctcttccacaatgactttgtctgtaatcatcctgttgcatttcttttaaggcctgatgatctgtcaaaaccaacagccaatattattaaaatgttattctctttgcaatgtgatcatcagacataggccttgcagtttacccactgttttgatttttacatttccagggcttccttgacaatggcactgatgtgactccatccagcatccattgttgtgagaactctatttggcatatcatcattgtgggcatgaacataatggagactttcataggatgcaatgattaatattcaacattagtcaaaatttcttctagtcctacccttggagctctactgggttggaaaatattttcggacaaggacaatcatttggtagagttttaaaaataaaggctacaaataaattttccatagcaagagtatgaactatgtgtggtccagaatacaattttttatggaatgtaacaaaaattatttaaatgtattcaatttagataataattttacaaataggcatatattgcatatataatagaattaacacacttaagtatgagtactatatatatagccaacattttatcaaataatatattgacttgtatgtatcttacatacatgtatgcacattttcccataaatatggtaaattttaattttttattgaaatattagttttaattttgtcattaattttctaagtttataatttgattactaaatatttacatttatgccactaatttaagaaaaaatacatgtgtgtatatataggtagaggtgtaaatactgtatcaggaagcttttatgcattaatgattggtaactggctaaatacacaactcagtgacagaaaatagtaaacatttgttttcatgttcatagatgctcacgttcacagtaatctggctgatcaaggaagggttcaggtgagtggtttctctgcatggcactgagctcgtcttcagcctacacatatcaactgtctgaggacaaggctgaacagcagtgactacccatgactcaagattcttctggcaggtcacaagagtgaacagcatcccaaaccaaactgcacagttgagtttaagtccaataatttctaacatagcttcacacatttcaaatatattgctttatttcagtgagtacaaatttttaagaaaatgtttactccatttaattatagaggtgtttgatcattccatggacaaataattatgttttcaacctttacaatattgaaaatatttgcaaatgtaaatttgcattaataagaaaataaagctggatgcgttttcaacatgtggctttaaatataatttatttaaatggcctcatgggggaaaatcattttaacttacataaattctcattttgtctctcttgtttcttatagagttgcccaataagaagtcctcccatgagatttggaagtccgaaaaggatgactcaatattctccattggtacctaagacagacacagggacagacatgaggactagagaaacacctgaaaagatgctgtaggaagctgagagcatcagcacccccacccctaagcttccagacaggactgaggaccatatggttagaaagcccatacttcagaggaagatgcattctgttgcctgagggaggatcagagattcctgcttctaatatcagctttcatgactactatatccttggctttgaaaggttgtagtgggaaacttaatcttaggaatttggtcattcttgtcatacccaacagagcaaagaaaccagtggggaaaggcactcagggtgcaaaatattgtttctagaatgcaattgaaataggccctattatcccatggaactaatgtttatgtttttttgtataaacatagaaattgactcccccagtcttaaaactcaagatagttacatctgtcttatctgagtttttttttgtttgtttgttttttcagtaaaccaatgaacaggcctcccagatactatcaaggagctgaaacttacatatcactgaatcgggacagtgagacatcagaaccttcacccattatgattgcctcactgacctcctgcttcctgttgaccaaattatcttccttacccctccctaattcctgttttcccacatttcttccctgctatataaactcctaatttcagttggtcagggagatacatttgagaatggtatcacatctcctaggctgcagcacctgattaaagcctgttccttggcaatgcttgttgtcttagtgattggctttctgtggggtaagctgcagagtcttcactgaatccctggcatttcagtaacaaaattctctgcaaccttcactgctttggcttattgtaacctgaaatcaaatttgtccacaacttctgagataacttgatataattctaggattcattttgtccaccactgcttaccagtctgagcttgccagctcccaacccttcctagtgccaatgaactttctcaaagagccacaggtaacattttccctttttcataaaatgctaattttctcttcgttcttccaatatcttgaagaccactgagttttcctgtatgccccacctggcaaatatttctttgcaaataaaacttaaatttagagattcatctctacattttattttgactttagtagtttactttaattctctgtattaagacaattcctgcttagaatatctatagtggcttcttctgtgttatatgaattcaagctgaagccataaactagactcctcaagtgtcatgatctctgtatttatcaaatcaggagatgcattgctatgtctgtgcagttggggctgagaaagagaaaagaattagggtgcagaggcgatttcacgtacccctctaccaacaccatcagagtgtggctgcatctgagcaacactctcagccaatggaggcatcaggaggagcagctggggcagcccagcttcacacatctgcttccctgggggtttatgttcgggttggtaacactgtgggagggaaactgttagcctgttgacaatagtaagttgcaaaatcttcaggctgcaggctgctgatggtgagagtgaaatctgtcccagatccactgccgctgaaccttgatgggaccccactttgcaaactggatgcagcatagatcaggagcttaggggctttccctggtttctgctgataccaggctaaccagctgctaataccctgactcgcccgacaagtgatggtgactctgtctcctacagatgcagacacggaagatggagactgggtcatctggatgtcgcatctggaacctgagattggaaacataaaaacaaatgtccacacaattaatcatgctgtaagagaagttccctgaatagtaaagcagtactcagcacactgaccgagtataatcctagtgttctcctttcttacctgggaaccagagcagcaggagccccaggagctgagcggggaccctcatgtccatgctgtgtcctgactgggtctgactcctgcacagggtgtgatcagcctgttaataagtcttcaggtcaggagactgtgctctgggaacatgcaaatgagcaggggatggggcaggctgggcgcagctgcagggctggctcatctcagtaactcagcaccagctcagtgtccccaggtgtcccaggtaagaccagggtagcacaaatttgtctgcagagaatgtgtttctactgggaactattttgttgtgagtaacattttttggtttctttttgacgatttgaaatattcctcaggagttgatggactaatgtatttcattggtgtatggggattatttaggagaatattgttgtttgtaggaaacacatagtaaaatgttagacggtacaattctcaagtcttcaaaagactcttatatgattccggctagggaagggggtatttgtcgtatacatgcaacatttctgtgagtttaacattgttcctatgtaaaaaaattaaaaataaaatttattgacatgatggtacatacatttgtaagtatcaggtaatggtgttatgccattgttcttaccagtatgagatcaaactatgtactatagatacacaaagatgataccgtgttttctcgatgcatgcagcagtcacagatccacaattatcaagagcgacaggtctctatagtactcagacactaaatgggttgcaccttattcttgttttgggcaccttcatagtctaccttcttttctgccattcagtattatttcccaaagttcatctctcttactgagggtgaccactgcatggagcatgtccctgccatgcaccatcaatgacactttcctcttttactttttatcagtgattggggaaatcatcctgacccaggcaacagcctccctgttaactgctttaggaaagagacactgaatctcttatcaagcagttgcctatgtacatggagaaatcacttggatccagatgaaactggacagggatttgcactcgttatatctcatatctctaatgtgcccaaaaatgtcccagcctgactcagtagcagggaaagtggatccaactacatcagcatcagtgggctgccacctaggactccacaaaattttactgatgcctgactaggggagccaaatcacagtgctgcaggctgtgcacaaaccttcctgctgttttttaagctgcctgaattttaagggaacttgcttatattgggagaaaggaagaaagctccatttgtcctctaaatatttgctgaaaatgaatggacaaaagaaagattaataagagaaaagacaaacaaaattcatttgaagtgcagcagaatatcatagcagggtgattacccagataactcaatgggatacagttgtttatatttcttttctaaggaagagggaattgagaagtgtaggcaacctggaaagaatagatgagaacagaagtgcatcctcaaaagaacaggtcatagcctgtctggataaagcatcaacttcagtctcttgtattttagattcctcttttgtgttaatattccctgatgtaaaaattctcaggaagaatttttttgacaattggtttccttctggagaatctgctattatgcagataagggacatttaggaaaagtctttttgtgcatttggtgctttctaaatgtctttggttttacataatcatcataccagtgcagcgtagtttgagatgttattttctggattcctttacttgcaacccacctgccaagatcctgttccagagagatgcagctacagattgaatgagcagttgacccttgaacaacatggaggtttgggcactgaccatgggtgcagatgaaaacctgtgtagaacttttgcatttctaactccaggcatcatcttgaaagtggagaaagcagaccttaacctgcccatgtcttgatctttaatttcccattctccagaactgtaagaaaataaatttctgttccttatgaattacatagtgacaatgaatctgttatagcagcttgaaatagaacaagagagacagcgcacaatcagtgaggacacgatgaggtgtatacataccccagcttcctcatctctcaggtggaatagcccagaggaacttagtccatgtttccacatgtggttgatctttggttatcctgagtcaggtaggttgttgatgtgtctttttccattcatcttctgttctcttcctcactttcctcctttcctcccagtgtaaatttgctgcctaaacagggatcctcattgagggtggacccaaactaagatagttaaaaaaaaaaattgttaatcttttgtaagaggggtatttctcatctgaattctgataatttctttttctttgacatgtaggaatattcaggaggcacttaatttttttttttttttttaccaatctgttttacattcaatttgtgaactgattttgtttttctgtgtgttaaaaccaaaaattaagttgtaagccaccaacctgctgaatggactcctcttttgtaaagagcacttcaaagaaatttgaaaaactaggttaggccatgactggcaggtgggtttagatgtgcctcattatactttggagttcagacacaactgaccaacattgtcattacaacagagatctttgggctgacaaaacagacgctttgtagcattaagataccatattccaacatgacagataataggccctgaagaaaatctaaatattttaccttaaaaatatttcttcatcatattctgaagtggttctgcaaagctgccagttgtgggggaaatttgcattctatagagaatctcctccccttactaagtcttttttaaagtctgacattttttaaagctctgataagcaacattcaccttgtactttatctgctactgataggattcatctacatgacaagaaccttggcttccacatccccttttctacactcaagcatttctttatgatgaattcaactctttagacagaccttaactctttcaaccagtagccagtaaggaaagctttgaattcacctatgacctggaagcccctgcttcaagctatcccacctttccaggacaaactaatgtatatcttatatgtattgatttatgtctttccctgtatttctgtgtttccctaaagtgcttaaaaccaatgtgtaatccaaccgccttgggcacatgtttacaggaccttctaaggctgtgtcacaggccataagccttatctttggcagaataaccctgtaaattgattgagacctgtctcagatactgttttgtttatactgggtcacaaaatttaaaaatcctctaaaactatctacacatcaataaatctacattagagacagtggagtgagcataccccaacagataaaactcacaagttagaggaacctgagtctaagattttgtccacctcccttgattcataaaaatacttcgtgattttttaaattttactttagagaaggacaattttggggaatatgtttatggtcggtggaatgaataatgtcccaccccaaaggatgtccatgtcctcatctctggaacccaagtgttataggagtttttaagaaattattttaggcagataggaaaaggggtccttgggaaggttttgtttcctttaaagcagctctagaaacacttcttgtctagccagaaagccctggctcttagagccaggctgggaagctttcctatgcaaatcatagccattagaaactggattcacccaaacatggtgattcccaccgttttcttccttgtcaacacatgtgcctgggaaaaacctgaaagatgctataggaagctgagagcagctgcaaccccacccttaagctttcagacaggactgaggaccacatggttagatagcccatacttcagtggcagatgcattctattttctgagggagtaccagagaatcctgcttctactgtcaacctgcctgactactatatccttggctttgaaaggttgtagtgtaaaagttaatcataggaattcggtcattcttgacatacccaacagagccaagaaaccaggagggaaaaccactcagggtgcaaaatattgtctgaagaatgcaattgaaatagaccctattatcccatggaactaatgtttatgattttttgaataaacatagaaactgactcccccagtcttaaaactcaaggtagttacatttgttaatctgagttcttttttcaggaaaccaaccatcaggcctctagatactatcaaggagctgaaagttatatatcactgaatggggacagtgagacatcagacccttcacccattatgattgcctaactgacctccagcttcctgttgactaaattatcttccttacccctctctaattcctgttttccacatttcttccctgctatataaacgcctaatttattttgtcagggagatacatttgagaatggtgtcccgtctcctcggctgcagcacctgattaaagcctgttctttgacaacacttgttgtcttagtgattggctttctgtgtggtgagccgcaggatctatactgaatccctggcatttcagtaacaaaattctctgcaagcttcactgctttggcttattgtaacctgaaagcaaatttacccacaacttctgagataacttaatataattctaggattcagtttgaccaccactgcttaccagtctgagcttgccagctcccaacccttactacagccaacaaaatttctcaaagaacaataggtaataatttcccttttaataaaactctttgctcttccaacatattgaagaccattgagttttcctgtatgccccatttggcaaaaatttcttagcaaataaaacattaaatttatctgtacattttatttagacttcaatactttagactctaattctatctattaagactattcctgcttagaatatctataatggcttcttctctgttatatgaattctaaccaaagccataaactagactcttcaggtgtcatgatctctatctttattaaatcagcagaggcattgtaatgtctgtgcagctggggctgagaaaagaaaaagaaattgggatgcagaggtgatctcatatcctcctctaccaacaccatcagagtgtggctgcatctgaggaacactctcagccaatggaggcatcaggagaagcagctggggcggcccagtctcacacatctgcttccctgggggtttatgttcgggtttgtaacactatgtgagggtaattattaaactgttgacagtaataagttgcaaaatcttcaggctgcaggctgctgatggtgagagtgaaatctgtcccagatccactgccgctgaaccttgatgggaccccactttccaaactggaggcatcatagatcaggagcttaggagctttccctggtttctgctgatatcaggctaaagcactgctaatgccctgacttgcccggcaagtgatggtgactctgtctcctacagatgcagacagggaggatggagactgggtcaactggatggcacatctggcacctgagattggaagcataaacacaaatggtccacacaattaatcatgtagtaagagaatttccctgaatagccaggctgtactgagccccctgggctgagtaaactgctagtgttctccttccttacctgggagccagagcagcagaagccccaggagctgagcggggaccctcatgtccatgctgtgtcctgagtgggtctgactcctgcaagaagtgtgaccagcctattaagaagtcttcagggcaggaggttgtgttctgggaatatgcaaatgagcagaggatgggcaggctgggcacagctgcagggctggctcatctcagtaactcagcaccagttcagtgtccccaggtgtcccaggtaagaccagggtagcacaaatttgtctccagagaatgtgtttctactgggaactattttattatgagagacattttttaggttttttttgacaatttgaaatattcctcaggagttgatggagtaatgtatttcattggtgtatggggattatttaggagaatattcttgtttgtaggaaatatataataaaatgttagacggtatgattatcaggtctccaaaagactctcatatgatcccggttagggaaggggttactttgccctatacttggaacatttctgtgattttaacattgttcctttctaaaaaaaatcaaaaataaaatttattgacatgatgctatatatacatgtcagtattcggtaatggtgttatgccattgttcttaccactataagatcaagcaatttactacagatccacagagatgatgcctatgtacatggagaaagcagtttgatccagacaaaactggaaatgatttgcaatcattatatcgcacatatctaatgtgcccaaaactgtcccagcctagctcagtagcaggggaagtggatccaactatattagcatcagtgggctgcagcctagggctccacaaaattttactgatgcctgagtaggggagccaaatcacagtgccatagcccgtgcacaaaccttcttgctgctttgtaagccgcctgaattttaagggaacttgcttatattgggagaaaggaagaaaactccatttgtcctctaaatgtttgctgaaaataaactgacaaaaggaagattaataagagaaaaggcaaacaaaattcatttaaagtgcagcaggatatcatagcagggtgattacccaaataactcaataagatccagtagttcatatttcctttccagcgaagacggaattcggaagtgtaggcaatctggagagaatagatgagaacagaagtgcatcttcaaaagaacaggtaatagcctgtctggataaagcatcagttcccagtctcttctatttttgattcctgttttgtgttaatcttccctgatataaaaattctcaggaagaagttttttgacaattggtttccttctggagaatctgctttttggcagataagcgatgtttaggagaaggctttttgtgcatttgctgctttctaaatgcctttggttttatgtaatcctcatacgaatgcagcatagtttgagatgttattttctggattcctttacttacaactcacctaccaagatcctgttccagagagatgcagctacagactgaaagagcagttgacccctgaacaatgtggaggttggggcactgaccacaggtgcagatgaaaacctgtgtagaacttttgcatttctaacttaagtactaatagcttacttttgactgctagccttaatgataaaataaatagttgattaacacttttttaagttatttatatcatatactctattattccaataaactatgctaaagaaaaaaatgtaattaagtaaattataaaaatgagaaaatatatttactacttattaagtacttgcttacaggtgacacacacagaagaaaatacaagtggatctgcaaatttcaaacccaatttattcaagggttaactgtaccaggatgaatataggagtctctatctgtattctagggctttctctttgctgtacctctgctcacttccaatggcaatatacatgtcttatgttctttacagtcttgggcagagaactctgcctgcatgcattgctgaccaaatgacctggaatgtgtatctcttaggaaagtgctatggtttcactgtgtcctccagaatccatctgttgtaaagttaattctcagtgtaatggtattgccaattggggcctattgggatgtgtttagatcatgagtgtggtgccctctagtggaatacattaatgccagtataaacagcaattgtggggctgggatctctctctcttctgcttgtctgtcatgttaagacatggccttccttcctttgaaggaccccaaactccaggcatcatcttgaaagcaaagaaagcagaccttaacctgcccatgccttgaacttaaatttcccattctccagaagtgtaagaaaataaatttgtgttctttatgaattactcagtgaaaaggaatctgttacagcagcttgaaatagaacaagagagacagctcacaatcagtgaggacaggatgaggtgtatacatacttcagcttcctcatctctcaggtggaacagcccggaggaatttagtccatgtttccacaggtggttgatcttcagttctcctgagtcaggtgggttgttgatgcgtcttttacaattcatcttctgttcccttcctcactttcctccttttctcccagcgtaaatttgctgcctaaacaggaatccttattgcaggtggacccaaactaagacagtaaaaaaaaaaaaaaaaaaaaaatcgttaatcttttgtatgaggggtatttctcatctgaattctaataatttctttttctttgacatgtaggaatattcaggaagcacttaatttttctttaccaatctatttcagattgaatttgtgcagtgattttgtttttctgtgtgttaaaaccaaaaattaagttgtaggtcaccaacctgctgaatggactcctcttttgacagaaagcacttcaaagaaatttggaaaactagattaggccatgactggcaggtttagatgtgcctcattatactctcctccctttggagttcagacacaactgaccagcattatcattacaacagagatctctggactgatgaaacagatactttttagcaataagataccatactccaatgtgacagataataggccctggagaaaataaaaatattttatcctaaaaatatttctttgacatattctgaagtggccctgcaaagctacctgttgtgggggaaaattgcattctatagagaatctcctccccttactaagtcttttccaaagagtctgacatttttttctaaggtctgataatcaacattcaccatctactttatttactacccataggattcatctacatgacaagaaccccccattttctagactcaagcatttctttatgatgaattcaactctttaggcagagcttaactctttcaaccagttgccaatcaggaaagctttgaatccacctatgacctggaaacccctgcttcaagctatcccacctttccaggacaaacttatgtgtatcttatatgtactgatttatgtctttgcctgtaatttctgtgtctcctaaagtgtataaaaccaacgtaaaatccaaccaccttaggcatatgtttgcaggacctcctaaggctgtgtcacaggccataagccatatatttggcaaaataacctgtaaattgattgagacctgcctcagatagtgttttgcttacactaggtcacaaaattttaaaatgcctaaaccgcagcagcccggcattcctccaggacctcctcccccgggatcttgcttcaagtgctggaaatctggccactggaccgaggaatgcccacagcctgggattcctcctaagccgtgtcccatctgtgcaggaccccactggaaattggactgtccaactctcctggcagccactcccagagccactggaactctggcccaaggctctctgactgactccttcccagatcttctcagcttagctgctgaagactgatgctgcccaatcgccttggaagcctcctggaccatcacagacactttgggtaactcttacagtggagagtaagtccatccccttcttaatcaatgtggagtctacccactccacattaccttcttttcaacgacctgtttcccttgccgccataactgttgtgggtattgacggccaggcttctaaatctcttaaaactccccaactctgttgcgaacttggacaacattcttttatgcactcctttttagttatccttacctgcccagtttccttattaggtcgagacgttttaacaaaactatccacttccctgactattcctgggctacagccacacctcattgccacccttttcctcacttcaaagcctcctttgcatcctcccctgtgtctccctgccttaatccacaagtatgggatacctctactccttccttggcaactgatcatgcaccccttaccatcccgttaaaacctaatcactgttaccactagagcctgttatcacccacctgttacaacatggcctcttaaagcctacaaattctccttactgagggaagagagagaccctctcatattgttttatattgttttatactcagtacctgttttaagagtaaaaatcaaggaagtgaaatcagagacaggcagcccggcgccaggcctgggcctgcctggcctaaacctagtagttaaaaatcatctcatgacttagcaaccaatgttatccatagattccaagcattgtatgaagaacattgtgaaactccctgttctgttctgtttgactctgactaccagtgcatgaagaccctgttacataacccctagattgctcaatcaatcacgaccctttcatgtaaaatctttagtgttgtgagcccttaaaatggacagaaattgtgcactcaaggagctccgattttaagacagtagcttgccgatgctcccagctgaataaagcccttccttctacaactcggtgtctgagaggttttgtccatggctcatcctgctacattacaactcccctatcctacccatccaggaaccagacaaatcttacaggttggttcaggatctttgccttattaatcaaatcgtctttcccatccaccttatagtgccaaacctctacaccctcctatcttcaatacccccttccacaactcactattttgttattgacctcaaagtcaccttctttactatccccttgtatccctcctctcagcctctttttgcctttacttggactgaccgtgacacccaccaatcccaacaactcacctggactgttctgccccaaggcttcaggaacagcccacactactttggccaggccctttctcatgatctgctttcttttcacctgtctgcctcccaccttattcaatattttgatgatcttcttctttgcagtccctcttaccaatcttcccagcaggacactaccctgcttcttcaacatctctatttaaaggggtaccgagtatccccctccaaggcacaaatttcttcccctagtgttacctatctcggtataatcctccatcagcatacacatgcccttcctgcagactgtgctcagttaatctcccagacccgaatccccaccacaaaacaacaactcctttccttcttaggcattgttggatatttccgactctggataccaggctttgctatcctaacaaaaccactttacaagctcacaaaaggtaacttaactgatcccatagaccctaagttttttgcccattgttctttttgctctctcaaaaaggccctggagacagctcccacactagcactccccaactcgtcccatgctttttccttacacacagctgaaatacaaggctgcgctgctggagtcctcacacaggagccaggcccatgacctgttgcctttctatcaaaacaacttgacctcacaattctggtgcagccctcatatttgcgtgcagcagcagctgctgctgtaatacttctggaagccctcaaaatcacaagctatgctccacttaccctctacagttctcacaaccttcaagcattaatatcctcctcacacctttcacacttactgtctgcccctcgactcctccagctctattcatcttttattgaaaccccaacagtaactattggccatgggcacgatttcaacccagcttctcagttagtaaccaacacaagtcctgaaccacgtgactgcatttccctaatacacataggatcttcctcctttcctcgtatttctattcttcgaattcaaaatccagaccacccaatcaattttcaccaggtaagctggatatgctgtcatgtcccacatctctattattgaaactgctgcacttcctccctccaccacttcccaacaagccaaactgattgctttaactcatgtgctctctctcgctaagggaatgcacattaacatttatactgactccaaatatgctttccacatcttccataaccatgctgccatctgggctaaaagaggcttccttaccacacaaacctcttccattatctatgcctccctaataaaggtcctccttaaggctgctctcctgctggccaagcctggagtcattcattgtaaaggacaccagaaacctactcatcttattgcaaaaggaaatgcctatgccgacaggacagcaaaagaaatagccaatgcctccacacccgctaatattccagctcccactccagaggaccagtatttttcttccttatctatcactaccacctactcttttgaaagcctgctctactagtcttttccaactcagggaaagtgcttcttaaatcatggaaaattcattcttcctgcctcacaagctcagtccatgctttctttccttcatgaccacttccatgtgggatacaagcctctggctcgcctcctgcagcccctcatctccttctcttcatggaaatccatccttaagacagtcacctctcaatgctcgtctaccatgccaccagcccccaaggctttctcagccctcctccttttcctacgcatcaggctcatggatttactccaacacaagattggcagattgacttcactcatatgccccatatctgtaaatttaaatatctcctggtttggattgacaccttcactgggtgggttgaggcatttcccactatctctgaaaaggctactgcagtcatttcttcccttctaacagacataattccctgatttggcctccctacttctattcaatctgacaatggtttggcttttattagtcaaatcctccaagctgtctctcaagctcttgatattcagtggaaacttcataccccctaccatcctcagtcttcaggaaaggtagaaaggagtaatggtcttttaaaaacacacctcaccaagctcagcttccaacttaaaagggactggacagtatttctaccacttgcccttctcagaagtagagcctgacttcaagatgctacagggtacagtccatttcaacttttatatggacttactttcttgcttggccccaaccttgttccagacaccagccctctggacaactatcttccagtcctccagcaggctagacaggaaattcgcccgactgctaatcttctctttcctactccagattcccagccatatgaagacaccctagctgaatgatcagttcttgttaagagtctgagccctcaaactctacagcctcgatggactggaccctacctagtcatctatagcaccccaactgctgtccatctgcaggaccctccccattgggttcaccattccagaataaagctgtgtccattggacagcaagcctgatctctcctcttcctcctggaagttgcaagtactctccactacttcccttaaactcactcacatttctgaaaacagtaataacccttatgaacctaatatgttccttcattctattaggtctattcatccttactctactttttgcaacagggctttacacagtcacccccactacttggactgtgccccaaaacttgtcatccctactatcttctgtctagtcatactcctattcaccattctcaactactcataaatgccctgctcttgtttatactgctggtttacactgtttctccaaaccatcacagctgatatctcctggccctattgccaaaccaccactcttgacttcctcttggagtggatagatgatctttgctggcagggcacactccaatattttcaccatgatgaagtcctattctttatttttatactcactcttattctcattcccattcttatgccaccctctccctctccccaactatctccactacactatcagtctcactcactctctccaagccatttctaatccctccttagcgaacaattgctggctttgcatttccctttcttcctgcgcttacaaagctgtccctgccttacatacctactgggcaacatctcctgtctccgtacatctccgaacttcctttaacagccctcacctttaccctcctgaagaacttctttactttctagacaggtccagcaagacctccccagacatttcacatcagaaagctgctgcccttcttcgcacttacttaaaaaacctttctccttatatcaactctactccccccatatttagacccctcacaacacaagctgctattcctgtggctgctcctttatgtatctctcggcaaagacccactggaattcccctgggtaaccttgcatcttctcgatgttccttcactcttgatctccaaagcccagctacacataccactgaaacaattgtggctttccagctccatattacagataagccctctatcagtactgacaaacttaaaaacattagcagttattattgcttaggaagacattaccctgtatttcactccatcctttgctgccttccccttgctcttcagactctcctcccaggccctcttcttgtttgcttatacccagccccgtaaataacagtgaaaggttgctcatagacactcgacactttctcttacaccatgaaaatcgaaccttcccctctatgcggttaccccatcagtccccattacaacctctgatggctgccgcgctagctggatccctaggagtctgggtacaatacacctcttttagtactccttctcatcttttcactttgcagctccggtattgccttgcacaaggtctcttcttcctctgtggattctctacctacatgtgtctatctgctaattggacaggcacatgcacactagttttcctaagtccctagattcaatttgcaaatgggaccaaacagcttcctgttcccctcatgaaaccgacacgataaaaaagtgttattccactaattcccttacttgtcagtttaggaatttctgcctccactattgctctcggaactggaatagcaggcatttcaacctctgtcacaaccttccttagcctttctaatgacttctctgctagcatcacagacatatcacaaactttatcagtcgtccaggcccaggttgaatctttagctgtggttgtcctccaaaactgccaaggcctcgacttactgctgaaaaaggaggactctgtgtatttttaaatgaagagtattgtttttacctaaatcaatctggcctggtatatgacaacataaaaaaactcaaggatagagcccaaaaactcaccaaccaagcaaataattatgctgaacctccttgggcactctctaattggatgtcctgggtcctcccaattcttagtcctttaatacctgtttttctccttctcttattcagaccttgtgtcttccgtttagtttctcaattcatacaaaaccgcatccagaccatcaccaatcattctatatggcaaatgctccttataacaaccccacaataccaccctttacccgaaaatctttcttcagtttaatatcttctacactatgttcccatgccacccctaatcccactcgaagcagccctgagaaacaatgcccattctctctccataccaccaccaaaaatttttgccaccccaacacttcaccagtattttgttttttcttattaatataagaagataggaatgtcaggtctctgagcccaagttaagccatcatatcccctgtgacctgcatgtatgcatccagatgacctgaagcaactgaagaacaacaaaagaagtgaaaatagccagttcctgccttaaccgatgatattccaccattgtgatttgttcctgccccaccctaactgatcaattaaccttgtgacattccttctcctggaaaatgaatctcaggagctcccccacaaagcaccttgtgacccctgaccctgcccacaagagaacaaccccctttaactgtaattttccactaccctacccaaatcctataaaactgccccaccactatctccctttgctgactccttattcggactcagtcagcctgcacacaggtgattaaaaagctttattgttcacacaaagcctgcttggttgtctcttcacacacacatgtgtgacagattacagccctactgacaccttaacattagctcagtgagacttctgacacggggtactatattttatttgtgtgaagccaataagactgtggtgatttaaacagcagcattggaaactaatgcaaggggaagagatgtctttcacctcactgagagcatggttgtcctctgttcttggaaatatttccaccttgttatctggtgtcaattatgacatattttctagtatttaaagaaaagatctgctgccctaaaatcctatgtccagtaaaattattatttagaaatgaaggacaaattgagaagtcctcagttgtagaaaaactaagagtatttgctgccagcagatccactttaaacataggcaaaatgagccctaggaagataaaactaaagataaagagaggatgttaaataatgttagggacaaaaggctacaaaaatgagaagatagatggatataatgcattgctaaatcatgtgtgatagttgtatcaaagttgtaatactgttttgttcctaatatatgcagataaattacttttaaaaaacaatctatttacaatgggggaggaaacatgacataaaaaaggtaaaattctatatttattttaaatggtaatatattgatgccaacatactgtgagaagctatgcatataaaggaaataccatgacaaccaatttgaaaatcattataaaaagagataccccaaaattaggtaaaattaaaatgaaattgtgaagatgttcaagtaacccaaaagaaggcagcaaaaagaaaacagagaagcaaaaaaagatatagcaaaaaagtagagtgcagacttaaattttaatatatcaatatcaatatattaaatatgcaaattatgaaactttgaaaaagacaacaattgatgaataaaaagaaatgtcccaactgtatgttatctacaagacactcacatcaaatataacagtataagtagattgaatataaaaggaaggaaaatggtatactatgcaaacattaataaaaagaatcagtagcaaatactaatatcagataaagtagactacagagccaaagaatgttaccaggggcagaaaggtacattacataatgaagaaagtcattttggaaagaagacagagcagttctaagtgcgtagacaccaagcaacagagcgatatagtgcatgtggcagaaactaacaaaacaattgcacacagagacttcaaaaacccctttttaatcttcgataggacaactggacagaaaatcagcaaggatttaggactcaacaatatcatcaacccacgagatctaactgacatttatagaacactccaacccataacaatagaagttcacatttttttcttccaagtgcccacaacatataccaagataggacatatcctgcccacataacctctcaacatatttgcaataattaaaatcacagtgaatgtgttctctgaccatggagggatcaaactagaaatcaatattgaaaatgtaacccccaaattttcaaatatatgggaactatacaatattgttctttccaaagaaccagcctttggcttgcctggtgttcagtgtcactttttctgtttgcagttttattgatttctgccctaatatttattatttattttgctcatgttctacttcagatataaattgctcctctttatgtagtttcataaggtggaagctgagattattggttttatcccttttattttctgaaaaatactcatatgcatatgtttatctacgtgcatacacatgcataaatatgtgcagatgcatatgcatacacgtggttttaataccataaattaccctgtaagtgctgctgaatacctatgcgtattttcttttctctgagctcaaactccactcacttgcaaacctgcccacttaatctgcatgttcattggtgtctcaatctagaattgagcaaaaataacaaactcctttcattttatctcaactttcttgaccgctaatacatttaacatcagtaagtcagaatctatctaatagattaaggccaaagctgccaggtcactcctaatctgactcttctcacaccaaggagtgtaaatgacattgatttaaaaatatggtatcatctgcctatgtctccaacaatcttcactgccccaaaactagtttatgccaggatccactttgcccagataagcatctcttctgcttctcacagcccaattcgagtcattactttgctaaaaaataaatatgaccatgggggtactttggttaaaaaaattcccagaatgtcctgctgtacttacaaagcatttgctccccaaacagaaaatgaaggccttattaatttcacatcagtcacatgtggtgatctttaagacactgagagaaaatggctctgacctgccccctcacgaactttctcttttttacctcggttggttaagtcactctcctcatagtgcctttctctgtccttcacacgttcatactgtattccttctaagcgccttgattgtcatgaacctcagtgcccttcagaaacttctcttcaggtcagttgttctcctcatccaggtcagtcacctcctcagaaaaagtagcctctacctccctaactaactgactccttttcctcattaaccacttcctcttcccttgccatttttttcctttatgacccttaactttttctagaatctttttgttgatttatgtttaattagacatggcctttttttcaccagaaaagatataggtaaatgagagtcagacactgactttctcaggggtgcagcctagatacgttcctggtccagcatagttgctcaattaacactttattgaatgaatgaataatgaaaagttagtaagaaactctccaagacataatcaacactcataacctatacacgttgaaaacaacccactgaatgtaaaacatggattattctgagtaatgagaagtttgaatagcagtgtgctgctcttcatagtcagctcttcatagtcagtgtgctgctcttcatagtttgtattttgctggggagataaggaagacatccaaagtccatgataatcaggtaagagtattcttatcttttttaaaaaacaagcaaatagactttgcagtcacaaaaaaattgcaataaatgggactacactatcacttaactctattggctcctgttcacaaaaacaggttgtattattaactcttctttgaaaacaaaccagctccaaacaaaatgccataaaatgagtatgtgcagtcctccctcagtatccatgggaaatagtttccagggcaccctgcagatattccaatttttggagactcaaaacctttatgtaaaatgcacaatatttgcatataacctacacatatcctcccgtacatttcacaccatctctagcctccttatagtacctagtacgatgtctacacatgacttaacttgtgtagattcatccaagtgttactcagcacatggcaaagtcaagctttgctttttggaattttgtggatttttttttcaaaatatttttgatccaggattagttgaatccatggatgcagttcccatggatagagagctgactgtacagctccttataattctgagggtcagctctgtggttcttccattctgggctggctggactgatctctgctgagtccgctcttgtgtctgcagttaccctgtggttcatttgcgactggatggtctgatgtgacttctttaacctatctggaagctggtttgatgtgcaggttggacaacttttggtatcggtttacatgggtcaggaagatgggtcctattccccaatctgtattaggtttgttcccagatcaactctggggttcaagtctattcattgtgggttgtttgggagaaattctacatgaacaaagctgaactgctgtcatttattgctgttagcagttattgttatcctctgaaatgcatcttatataaccaagatctccccagggtggcccaacagtacagctcagctcagcccatcctgtcacttcgctggatgactgcaggtgtgagaaaggcaatatgctcagtcacaggaaaggcaggggcccaccctggggctgaaacctgcagacacagcgttcacacagcttctttgcaaaatacgaagacttcattttctttatacttaagatagttatacatttttttctataatgtccctatgctatttaactatttttaattttcagaactggttgtatttattatttctgtgttaggtgctcttagtcacttatggcaagagtgagttaatagagacaacatacagagtagccatggaacaatagagaagtgtgtgtattcagacaggataaagatcaaaggggtgacaaatacattcttttgagaagcagattctcatagatcaccacaagtcaaggtccacattcaaggtgcagtggcgtgtcagtcacattgtgcaaatggtcagctctgcacattaaacttggctagcacattgcaggaccaaaattacctgtaaaggtatggggaaaataaaccatcatggaaataacaatttgaaggagttctcaattatttatacttggatataaagcagaacgctacaatgaatgaacctacaacctaaaacctttaagccttttaaagaggtttctttttgtcagggtatttctcagcaaataatgataaaaaatttatggataaactacttgcacaattagccacaataaatcccttccctgtactcatcctttggttggcctcattctaaatggatgcaggtgttgcccatgtgtcttgctcaggccaataggataatagcagatgtgacacaagtggagtcttggaaagggcttgcacatcgaagctttcctctctctcacagtgcttggaaaccctaaggtcacaatgagaataagcctgtgcccatctacagtcaatgtcagtggcatggctgctcttcggtctactatttgttcttaaaatgtgtgctaagtttgttatggccatgtaacaaattaccacaaatttatcagcttaagactacacccatttatcatctctcaatttctgagtcagcagttggcacatggctttgtcgggtcctggccattggatttcacaagactgtgccacagtgtagattgggcttcattctcacctgtgagtcccctgagaacatagatactttagagctctttcaggtagttgcagagctcattccttagcatttctatgactcagggcttcaatttctaactggctcttggctcaaggctgctcttaggtccaagaggctgtggacaattccctgccatgtgatgctcacacaggcaatgcccacatggctggttgcttgttcatggtcagcagaaggtttcagagagtgtctctttccagtctgctatgacagaggcttatagaatacaatcattggaaagacatctcataacctatgacatatcatatggattagaagcaagtctaggttccgcttgctctctgtggaggtagattatacaattgtgtgattcactggggagagggttctgctagggtgttctggcatctttagtttcctcaaatatcaggtacttgtactgagtgtgaaatctgtcctgtacttactggcattgactagtcctgtgacccctgggaacatcttgggaagcatactttgtaagagaggttttagggtaacctagctattggaagcataacatttgcaaaatatcctaatctttgtgatttctaacatgtcctcaaggttccttaattgcaattatcataagccaattatctctaaatatccgcaaaatttatatttaatagtaggaaaatgatttattaaggagtctattaaacaagactcagggaaatgatgtcaacacccaattgctgctgcccactgctagactatgtgagacaattttcatgaacaatagaacagatactgcatgctagacacttctgtgagcaccactggcctgctacctctagaaatgtttgcagaacaagggcaattgctatgagtctcaaaatatatatttttttattatactttaagttctagggtacaagtgcacaacgtgcaggcttgatacatagggatatatgtgccatgttggtttgctgcacccatcaactcatcatttacattaggtatttctcctaatgctatccctcccactgcccccgaccccatgacaggccccagtgtgtgatgttcctcaccctgtgtccaaatgttctcgttgttcaattcccacctatgagtgagaacatgaggtgtttggtttcttttccttgtgataggttactgagaatgatggtttccagctttatccatgtccctgcaaaggacatgaaatcatcctttttatggctgcatagtattccttggtgtatatgtgccacattttcttaatccattatatcattgatggacatttgggttggttccaagtcttgctattgtgaatagtggcatgataaacatatgtgtgcatagtaccatgatttataattctttgggtaggtacccagtaatgggattgctgggtcaagtggtatttccagttcttgatccttaaggaattgccacactgtcttccacaatggttgaactaatttacactcccaccaccagtgtaaaagctttcctatttttccacatcctcgccagcatctattgtttcctgacttcttaatgattgctattctaactgacgtgagatgatatctcactgtggttttgatttgcatttctcttatgaccagtgatgatgagcatttttcatgtgtctgttggctgcataaatgtcttcttttgagacgtgtctgttcacatcctttgcccaatttttgagggggttgtttggtttttttcttgtaaatttgtttgagttctttgtagattctggatattagccctttgtcagataggtagattggaaaaattttctcctattctgtagattacctgttcactctgatggtagtttcttttgtcatgcagaagctctttagtttaattagatcccatttgtctatgttggcttttgttgccattgctttggtgttttagtcatgaagtccttgcccatgcctacgtcctgaatggtattgcctaggtgttcttctagggtttttatggttttagatctaacatttaagtctttaatccattttgaattaaattttgtataaggtgtaagtaagggatccagtttcagctttctacatatggctagccagtttttccagcacgatttattaaatagggaatacttccccatttcttgtttttgtcaggtttgtcaaagatcagatggctgtagatgtgtggtgttaattctgaggcctctgttctgttccactggtttgaatctctgttttggtaccagtaccatgctgttttggttactgtagccttgtagtatagtttgaagtcaggtagtgtgatacctccagctttgtttttttttgcttaggattgtcttggcaatgcgggctcttttttgattccatatgaactttaaagtagttttttccaattctgtgaagaaagttattggtagcttgatggggatggcattgaatctataaattaccttgggcagtatggccattttcactatattgattcttcctatccatgagcacggaatgttcttctatgtgttttgtgtcctcttttacttcgttgagcagtggcttgtagttctccttgaagaggtccttcacctcccttgtaagttggattcctaggtattttattcactttgacttaatctgtgaagtgtatttaaattctcattctagagaagaaaaatccaaagtacttggaaaagagaaatcttgccatgagatacacagttcttcagtttcaaagcagagattatctctcagatattctggctcatacaattttcagtacactgcaagacagaagatgtgaagacaacactacccaattggccttacacttgctttgctcactgttaactaagttcactgtaaaaaaaaaaaaaaagattacaataaaacacattgtcaatgaactgtcacaaataaatacatctttagaaccacatccaaaatccagacatagaacatttctatagctccaaaacattttgacccactcttttggaatcaacttgctttctgcctcacagatcagggaattttgatctgcttcctgtcagtacagatttcattttccttgtaagagtttcacataaatgaaacataggatgcgctcttttgtgtctggtgacttttgtgcagcatgactctttctcagattcattcagatgtcctgtgttctaattatgtgctcctctttatttttgagtattatttaactgttcagtaattttatgatggatcccttcatctattgattgccgtgtgggttgtttccattttgggctattatggataaagttgctgtgaatgttcttgaacaagactttgcatgaacatatgtcttcatttcttttgggctaataccaaggcgtgtagttgctgtgtttatcagtaagtgtttaatactctgtccgactttaccgaaagtggctataatattttatatgtccaccaataacttattatagctccacaccctccaaaatatttcaattttttttttaagatttcacctaattgtcactcaacagtaaccagaatagctagtgattattaagctatgtttttcttcccattttcttgtcaatttggggaattgatgtgttacaggacattgagaacagaatcaatactgtcctagttccctatcaaacacttttatcaagccataatatttaggatggtaacatgatatataaagggagtgttggagtagtaataagtattttcaatacttattatattccataaagcaatatatcttcaatgaaatggcatttaactagacttagcatagtaaggttctcatctcaaccctagtattcagtattagcaaaagtttgaggaaaaaaaatatccagcaacataagccagagagtgttttgctagtcaagtagcactgcaatactgatgctcttctaatgccagcccttcacaataatttccactcagaacatttggttgcctccttgccttgttctccttatgggacttcatgctgagggcatgtggcatcacagagggagcagtgcacttgggtgcagaaatatagcttagtagattgtctggccttagaggtggctgcaatggaatacacattttcaaggaagttccctgttaaacctcctggtaaactgatagttaagaccaggtgcggggacttatccccgttatcctagatgtttgcaagatcaagtagggagggtagcagaaatctaggagttcaagaccagcttggaaaacacagggagactccctcatctctagaaaaaaaacactgtttgttaagatgtggtgtgaacaatggcatctctaagtgattatttattaacatttgctgagaaaattagaaaatagaacgatgccttctgatccaataatatcataataaagatgtgaagtttttaaactatggtaagtatagagaacataaaattgcccatcttagccattttcaagtgtacaggacaatggcattaagtatagtcacattgttgggctagcatcaataatatccatctccagaactctttccatcttctagaactgaaactccatagccattaaatgacaaccccctccccgtttcccctgctcccagtccctggcaacctgtaatcaagttctgtctctatgacagtgactgctgtgaagcaggtttgctgtgccctggttaccaacctgtcagagtccagggagacagaacaatcatacacaacaagttacaagaatctagtttagtatttacaggtgaccagcaaggcacggcagaagctgaggatttattgtgggtctttaccctgaggcacaggtaagtggggctgatggaatcttgactgtgtgtacccctcttggaccagagctaaggaaccccagaaagaagatgctctgggttttaaaccctggtgtcacaggacacatggagctaaagtactggaggacttaagtacaggaggacagtactagagggagctggatcagaagccagtctgttctgacctgtccctcgctatttcagaatgttacatttccagcacattctacaattattattgagaagtgtaagaaagagagtggggaaaatcaagtgagtccaggaccatcagaggactggagtgaagtcgtcccccaacacagacatcctccgtagaaagctattccattttatacgcctaccaaccaccgtgaactggaggcacaggtgtgtcttgtcagacggatgaagcaccttgactgacacaatctcaaagcaacatcattgagacagagccagaaaagatttcactgggccaatgaaaactactaccagaggcagaatgatcaggcccacctgaagcagttatgtagcccaggatcccatgatccacagaagaagttgctaaaggggtgaaagaagaatccttcaggtgggattttctgaatctgcagaatccattttctgcaattatgagcttgtttccagatctcctctacttgaatttctaggatacctgaggtgtttatccaggtatagcagggggtattggaaattgtatacattcctcccagttgggattttttaaaggtctagagcaacactgttatcttaaacatccatcccgatggagttaagggatgtctgctgggttaccaaggcagtggctatggaggaggagcaatatctgccatggtcagggacaagttccttatcatttcactttttttcatgagcactgactcctatacatagtaccaaaaatatcataaaagacataaacctatcatctgttgtaccttctggtaggtccctagtaagtctgaggtacagctttgggcttcaggctctatgatttacctaattccaaggagcaatatccagagacaaccccagcatgcccaacatgcaggatctcactattccacagatatccagagatggcatcacatatcctgcattttggtcactcccaaaccgcttacagagaaagatgtagcccttgggtgcatacagccccccttttcccatttttcttcaatcactctgtcatggttatgctggtattggtgcgttcattagccaagtctcactgatagtagagttgcatgagcaaagttttgctcatacaatattgtctgtagacagagggctagcattagtccagtccttgtttttatcattgccattgggatgtttctcatctatgcaatcaaaaaagtatggtgcatcaaaatattagtccaccaatgttttttttaattgtggtcatgacattcgccagaggcaattaagttaaacaggggtcctccagtttcctcccatgtggcaggtgtcagattctcactttgtgggccagtgcttgggtccttttgatgtacaccttagtattaggaatgttggtgtaatttacccttggtagaatgaaagggaacctctagttaatgacagaatgaggtcaagaatgggagattcactattttgaaagatcaccctggtgacctaaaagaagctaacaaagacattgtgcttctaggcctttgctgcctcattcttgtcaaaatgcagcctcacaggttaatgcatcgtctctcacccatcccagggtctcaggtgtcccctacccatctacaagggttgggccgtgttggtgtaggaatgcggtctggctgtccttgctctgtgaacaatccattgcctttgtcacttgatccagatatttcagtcctgattgtccactccaggaagggagattctgccctgtaaaaactggacatatttcataatatcaccaacactaaagggaggataagatgtccctggcaccagaagagggcccctagctccgtgatatttcttagtcttgttatccatcactgtgggatcttgtagaaaggaagcacccagaggaaacataatcctcctattagagttagggggcctgtctggggcattgtaatggcctagattgcaaaccaccccagagcatgtattctaaaggaaaaaaagaaaaggaatggttaggaacactgaaatagctttcacaggtccagactaatataagtgtctgcctggcctacctttacttccacccagctctgtgtttctcaacatgcactatttccctttttgtggcccaggatctttaatgtacatatttctctagtcagatgggataccaccccattaacagactttgtagatgtcctttctgcatattgctgtgtgattccactgatctagcattcactaggatcattggcctgtggatgcagggtgcatggaaagttcatcgtgttccatgagagtgtgcctattgtcacgttgcttgggcagtgaaagatgctcctttgtgagtgagaagtctcatggagtatccaaaaatatgacataaattgcactcaagggttacctaggtagtcccagcatcaaattcagcatcatatttctttttcctgcaggtggaaagctgtggccatagtcctttccttcacactggggattctttaatagtccagtctctcagttgccattttcctgaacagatggcaaggctgttgacaatggccgaggatttagtggatatgtggcatggtgcgttgttgggacagcctgcatggccattaccactgaatgtagttttgcccactgggtagaaagcccatgttaagtttcagttaaaaaagtggccatccactggctgaatggtggccacacctagtggatctgtcagttagcattttgctcagccttcagtgactcctgccatatggaaatctctgaatcttgggctccacatgggcaaataaagagccaaattatcacctacaagttatttggtcccttctagcaagctccccatttgttcatggagccacagatcctgtggggtcctgactaaacctgatcaagaatgtgccatttccatttgataacatggctctgttcagattgttcagttttactaatggtgtttgtaagtatctaagtgagaatggacagctaagggaccagtgtcacagtcacacatggtgctgaagccttaacatgttcagtctccatcagtgcctaatagcaagcaaggagttgccattcaatataaacacattcagtggctgattcaggcaacttatgtgtcctaagattgagaggctggtgcactcattgatagttttctgttgctatacgctccactgagtatgcatagaggttgtggatacctggacttccatctggttagcaggctgtaaaaatcttagagaagtgactgggccaggccttgttgaacagattccaaggctactgttgcaaaacgcctttttcaaagttggcaactttgttcatgattttgactaagggaaccaaaagaacacccaggtgaggtttatgccgtctcccattcgcaaaggggcctacctgccactgagtctccttttattcagtgggtgccacagcgaccaatgtttccagctgttcagttggcataataattaactatgagtacacagctcactttcactatacatatattccttgatggaagttacagcatcatacatgattagcgtgtcagaaccttcaccacatctgatagggtatcaattcaattacctagggtttgtgtgtcagttttgcttgactaagaatatgttttctcctttctatagagacggctgcacctgtgcaggtgataagatcatgaactgcaccctttgccttacttttttgttgtaaataatttgcccgattcaatgccatattatggaagaatttcttaactgtgatgaaagcacttggaaaatcctcaaataatatttcatgcagaaatataactgaaagaaagacaaatgcatatacaggaaaacaactgctgctcttctcatgttggatgaggcctgctaaaaacacctgacaccagctgttagtctgatccttgatgtctggtacaatcttgggttattctccttggaaaagtggatgctcagaagtgccagtatccccatgagtcccagttaactgaaattcatattgttaagcccatgcatggatagtcatgacatcagttcatgagattccctgggaaagctgggaaaggtaactgatgaagtccatgttttgaattattttaattattttgagctcctgcttctaatggcctttagataaatattcacttggaaaggatttattttttctactggtccttttttggaaggtccagtcatatctcctccagagtgactttgtgtccaatccttcagatgtgtttcttctaaggcctgatgatctgtcaaaaccactagtcaagatagtgatattgttggtaatatccagagcggggagaggacaatagtactcccaatattgcgggaggtgtacacccctctttgtgttattgttcttaatatccagggggaaaacaggatgacgttactaccaatatcgtggggggtttacaccctcccttgtgagattcttcataatatccggcaggggggtggataggactatattattcccaatatcgtggggggtgtacacccctcttgtgatattattcataatatcctggggggagacgacaatattactcccaatatcgtggggggtgtacaccccttattttgatattgttcgtaatatccagggttggagaggacgccattacccccagtattgtggggagtgtacaacccccttgtgatattgttcgtaatatccagggagagaggaagatattactcccaatatcgtggggagtgtacacccccaacttgtgatattgttcataatatccaggaggggagaggacgatattactcccaatatcgcccgggctgtacacgcccccttgtgatattgttcgtaatatccgtgggggaagggaagatggtattacttccaaaatcgtaaacacattgtgtgtacacccccctgtgatattgttcgtaatattcggggtgggggggagaggatgacgttactttaaatatcgtaaacacgttgtgtgtacacccccccaccccacgatattgttcataatatccagggagagagaggagatgatattactttcgatatcgtaaacacgttgtgtgtacacccccctgtgatattgttcgtaatatccgggagaggagagtatgatattactcccagtatcacggagggtgtacaccccccgtgatattgttcataatgtccagtgggggagaggagatgtattactttcaatatcgtaagcaacttgtgtgtacaccctcctttggtattgtccataatatccagggtgggagaggatgatattactggcaatatctcggtggctttacacacccctgtaatattgttcgttaaggagttaagaggatgatattactcccagtatcgcgggggagtgcacgcctctgtgatattgttcataacatcttgggagagacaggaggaaattactcccaacatcgcggggcatgcacagccccctgtgatactgttcgcaatatccagcggggaataggatgacattactcccaatattgccggggatgttcaccccactgtaatatttttcttaatattcaggggggaaggatgatattaatcataacactgcggggggtgtacacccttctgtgatattgttcattgtatccagggatggttggagatgatattactttcaatatcgtaaacaccttgtgtgtacacccccctgtgatattgttcctaatatccagtgggggaaaggataatattactcccaacatctcgggaagtgtacacgtccctgtgatatttttcataatatccaggggggcagaggatgatattactcccaattttgcggggggtgtacaacccactgtgatattgtcgtaatatgaagtgggagagaggatgatgttactcccaatatcgccgggagtgtacacccccctgtgatattgtttgtaatatccagggggggattggaggtgatgttagtttcaatatcgttgacaccttgtgtgtacacccgcctgtgatattgttcgtaatattcagagggggagaggatgataatactcccaatattgcggggagtgtacaccaccatgtgatattgttcataatatccagagaggggagaggatgatattatgcccaatatcgtggggggtgtgccccccctgtgatattcttggtaataatcggggggagatgacattacttccaatattgtggggaatgtacacccccttttgatattgtttgtaacatttggaggggagaggatgatattactcccaatatagtggggggtgtaaaatccccctgtgatattgtttttaatatccggggggatttgagatgatattactttaaacatcgtaaacaccttttgtgtacacccccctgtaatatcgttcataatatccaggtggggagaggatgatattacgcccaataccacggggttgtacatacccctgtgacattgttcctaatatccaggggaggaggggttgatattattcccaatatctcagggagtgtacacctccctgtgatattgttcataatatccaggggtgattggagatgatattactttcaatatcataaactttttgtgtatacacgcccctgtcctattgtttgtaatatccaggaggggagagtatgatattactcccaatattgtggggggtgtacaccctcttgtgacattttttgtaatatctgggagggagaggatgatcttactcctagtattgcaggtggcgtactccctgccatgatattgtttgtaatacacagggctgccaggatgatattactcccaatatcttggcattgtaccctggcccagcatgatgttgttgttcgtaatacccaggcagggagaggatgatataactcctaatatcacatgcagtgtaccccctctgtaatattgtttgtaataccctgtggtggagaagataatattattctccatatcaggggtgatttactcctcttttgtgatattgttcctagtaccctgtggtggagaggatgaaattgctcccaatatcaccaccgatgtgacattgttcataatactcagggcaagtctttcctgtgtttgtcccatgatagggaataagtctcttgagatctgatggttttatgaagaggagttctgcacaagctctctctctttgccttttgccatccacgtaagttgtgtcttgctactttttgccttctgccatggccgtgaggcctccccagccatatggaagtgtaacttaattaaacctcttttttttggtaaattgcccagtctcggatatgtctttattagaagcatgaaaatgggcaaatacagtcaattggcaccaggagagtgggccgctattgaaaagatacccaaaaatgtggaaatgactttggagctgggtaacaggcagaggttggaacagtttggagggctcagaagaagacaggaaaatgtgggaaagtttgaaactccctaaagagttgttaaatggctttgaccaaaatgctgataatgatatggacaatgaaatccaggctgaggtggtctcagatgaagatgaggaacttgttgggagctggagcaaaggttattcttgttatgttttagcaaagagattggtgacattttgctcctgccctacagattggtggaactttgaatttgagagagatgatttagggtatctggtgggagaaagttctaagcagcaaagcattcaagaaatgactcaggtgcttttaaaggcattcagttacataagataagcagagcataaatgtccagacaatttgcagcctgccaatgtgatagaaaaggaaatcccatttctgaggagaaattcaggccagcagcagaaatttaaaaaagtaatgaggagcccaatgttgttaatcctcaagacaatggggaaaatgtctccagggcatgtcagaggtcttcatggctgcccctcccatcacaggcccagaggcctgggaggaaaaagtggttttgtgatccaggcccagggccttcatgctgtgtgcagactaaggacttgttggcctgtgtcccagctcttccagccatggccaaaaggggccaatgtagagctcaggctgtggcttcagaggccccaagccttggcagcttccacgtggtattgagcctgcaggtgcacagaagtcaagaattggggttgggaaaccttcgcctagatttcagaggatgtatggaaacacctggatgcccaggcaagaagtttgctgcaggggtggggtgccatggagcactgctagggcagtgccgaagggaaatgtggggttggagccaccacactgagcccctactggggcactgcttagtggagctgtgagaagaggggcactgtcctccagatcccagaatggtagatccactgacaacttacaccgttcacctggaaaagccacagatgctcaacgccagcccttgcaagcagccaggagggaggctgtactctgcaaacctacagggacagagttagtcaagtccacagaaactcacttcttgaatcagtgcgacctggatatgagacatggagtcaaaggagaccattttggaactttaggtttaactgccctcctggatttcagacttgtctggggtctgtagtccctttgttttggccaatttctcccatttggaacagctgtattaacccaatgcctgtacccacaattgggcctaggaagtaactatcattcttttggtcttacaggctcataggttgaagggtcttaccttgtctcagataagactttggactgtgaacttttgagttaatgttgagatgagttgagactatgggggactgctggaaaggcatgattggttttgaaatgtgaggacatgatatttgtgaggggccaggggcagagtgatatggtttggctgtgtccccaaccaaatcccatcttgaattctcacaggttgtgggaggtacccggtggttggtaattgaatcaggagggcaggtcttctctatgctgttcttatgatagtgagtaagtctcatgagatctgatggttttataaagaggagttcccctgcacaagctctctctctttgcctgccaccatccacgttaagatgtgacttgctcctccttctgccatggttgagaggcccccccagcttatggaatcgtaagtccattaaacctctttttttgtaaatttcccagtctcaggtatgtctgtttcagcagggtgaaaacagactaatacaggattcagacagatttagaattttaatggcttcttgatggatttaccaatttataattataaaatgtccattttatctcttgcgttaaagtcatgacctagtttctgttgctcagttttacatgatatgtacttttcatcctttcattttcaaagccattctatattcttactatagtgtgtatttaatgattaacatacatctttgattttaatcctgtctgataattttatgatttacttggaaaaatttgtttatttacgatgcaattattgtaaagttagggttaaacctaccgtcttgtttcctctgattttcttgattcatgctttcatttgaattagtttaattatagattttttcttatattaacttgctaaatatgcaagattattatacagaagatatcctcaacttattaatgcctaatacacatatagtgtattaaaatttctctctcaaattatttctaggtaagtgacacaagcagaatcaaccttcggaagatcatctatttcctgctgggttgacctggaatgtgtgatatgacctaaggtaacctttgagtcaccacacagacctagagctctgtgtgatgcagcacttcctcaggagcttgcagtggcatcagggcccagccttgaatgccaggcaggggtctctcgactctgtgattcttcccaggaaatacataagaacttgcatctgggttcatatctcaaacgcaacccaccagtctctcacgtactgacctctgctccaagtcttcagatggttatttttcatggggtaaaaatatggcttacatattatcttgtaattctgtttaagatggcatacttatgttcctttattctttcaaacttggtccttattgttgaaacccagctttggagttcagaaaactactttttacttcaacatgctgtggttgagactgtggaaagacttttggcactaggtctttatttttgcatacatttgcagcaacatatctagtaacttaaaaatctagaccgtgaagagttatattttggtactccctgaaaaaagtaggaaaaaatacagtgcctgctggtgtcctggtcaggggtctgccttcggaaaagtggtggggggaggtggaggaggggagggaaactgttttaatattaccaaaccttatcaacatacatatactctagtaactgctaaaccaaatcaaaagaatgtattagttttgcgttgccagtaatcagtctcaattaggtgcctgttacgcagaacgaatttacttgatgaatgaatgtagggaaggaagagaggcttagaatgagctttcattgagctttctcttctctcgtgtctcattgctcaaaggggaggtgtacctcctcctttttgcagactctgtcatgcaaaggccgctgcagctgatgggaacttaaaatgtggtgcctgaggtgtagctgagaaatttatggtcatgagccctcagctgtaccaagtcctctgagttctccaacatcttggtctttaggcatctaagagaatccacagtgcctgctctccacagaaacaacacatctgggcagctaggccacagcaagcagggaggtttgtgttcaggactgtaccattgtgggagaataatgtgtactttgctggcagcaataaaccccaacatcctcagcatccatcctccttattttaaacatgaaatctgtccccgacccactgccactgaacctgtctgggactccagggtccctgttggaaaccaaatcaatcaggagccgtggaggctggcctggcttctgtaggtcccaattcaaataggtgtatccattactgtgaaaggggctatgactggatctacaggagatagaggctggctttccaggggtgacgggcagggagagtagaggctgggtcacacagcatctccattggatcctgaaataataagagagaagtgcaaggttatgtacaaacattgtgagccattttaataattttctgtctgttatttatgttttgctcaattattttttgtgtatgattttggttaatactcccaaaacatacaggtttaaaaagaaccaagatttgcaaagcacaaataagcctctagaagtcacctatcccatccccctctttctgtgtcacagctttcactaaagtacatgtccttgctccttctggaatcttcctcactctcacagatctagacatcacatgccccatcctggaggacaagacacatctaacacgaggacagaacacacatgggaggtggcagggcccacagagttcaccctcccaccccatcatcctccctcatttcccttctgctctcagcagggacccagtgcattagcagccctgggagctgagcagggagcctcactgtgggaaggtgaactgaggagtcctgatcagtcaaggcaaggttagagctgagcttttatctcagactcacaagggaaggtcttccctaggggacagtatgcaaatcccctggtgggtgcagtggggtggaaagagccaaggagaaggtggggacctctcttgtgagcaaaatgacataaatatattttatgtttttaaggatatcaagagaggtaaaatctgtttcctgagtggcagaagggacatatttagatgtttcctgctatttcctctacccaatttctagttcgttaggactttctcaggcatgttttacacttctctttaataaggttgagctttcataaatatttggtgattcttatttcttggttcaggcttatttaaaagagcctaggtttgttttattttattttatttaaggaaaaacacacagtgcaaaaggttcaaatcttaagggtgcaaatgaatgtcaaaatccagatcatttcatgtcatgatccacatcaaaatatggaaggtttccaattctcttgctgctttcattatgcaccttcccagtcagcaactgctgctcaaaacacaatcaatgtaactgatactgtgacatctattataattgtttttttttcctgtacttaatcttcatatcaggtaaacattttttgtagcttctttcttatttctttcattttttgagggcttgattccttcttatcaatttgaattgctgtctgctctcattccctgttattctgaaggattttctcttgaattttccacaaggcacatatgctataatgaattagtctttgtgtatgaaggaacatttctaccttgcttttatgtttaaatgattgttttgctggatatagcatttgtggctgacttttctcccccagcatttaaatatatcattccactctcatcccacctctattagtaatgatgaaaatttagccaatacctttattattgcttcctagtatagagtaagtcagtattttagtgatgccttccaaattctctgtgtctttgtctttcaacattggtactataatgtgtattgttatgaactgtattgtgcttatcctagaagggtttcactgagttactttcatgtacagactaatgtgtttcatcattgtgaaaaatgtttttcattatttctccatttttttctttttcagtttttattttagaatcaaaccatacatgtacagatatgttacaaagttattttgcatgatgctgaggtttggggtatgacagaaattattaaccagttagtgaacattgtacccataggtagtttttcagcccctgccctttctccctttgtgttccttctagcacaatgtctattgtgcccatcaaccagggattcaataaagaaactgtggtatatatgcaccatggaatactatgcagccataaataagaacaaaatcttgcccttgcagaaacttggatgcagctggaggccattttcctaagtgaacagatgcagaaacaaaaaaccaaaaaccacatgttctcacttataagtgggagctaaacatggggtattcatgggcataaagatgggaacacatttttagcctctttctgtcttctcctttgtgattcctaatacaaatttgttggtattatacacatggacctataatgtctgaggttttattcattcttctttataattttttccttctttatatgagaccatttctattgacttgtttttcagttcactgattcttgtgtcatcttaaattgctattgagtctatctaatacatttttcaattgagttgttgtacttttcatttctagatttcccagtatgcttgttttcatagttttgtctctgtttgagagcctctattggttgaatcattgtctttacaaattcctttttcagtcttttattataggttaaaataattctttgaacatatatttgataagggtggagcacatagacaccatggagatggaccataaggcagggagctccgaattagattaggtgaattttgagtctctgactatatgatgctcttgtgggttttaattatttcccatgttttatgtttctcatattacaaatagcttttatttttaagatagtaactattatagaaattcagcttataaatccctggaaatttctaacagaaagattgatgaaaagagggtttttttaggcccccacaccagcctctgcctgggacctgactttgtctctgagccagtggaatctgtgatgaggttttgagttgggcagtgaaatcaccacagggcaggctgtgctctgggtgctttggatgacaggaggacactccttcagggtcagtgatgctgggagttcaaagggagactcagcatggagctgcctgtgagttatcccagcaatcctgtttggacagtgatcatctcacaagtgtgctcggaagccactggatggccaaaatgtgggctcaggttggagaaggacaaagctatagggatgaaaatataagactcatttgatactctgaaatatcagtacaaccatcatgaattatatgggaagagaaaggagtcacaagattgtgattttttatttgatattaaaatatgtcacctctgctcatttttccctcaaggatgtacctactgatatacatttaaccaaagtcactgtttttaattttcattttagtaactgacagcctatgtgcagagttcctaaataacgaagccagaccatcattgctatgggtgaagccaggaagtgactgtggatgtgaacaaatgtgagattcatgtacacgtctccaaagacagaggccactgatctggggagaacctgcagtcatttcactttcccatacccagatgagaggacaccttgatctgtgttcatctgatgaactctaaaatctggaccatattctgaaggtgtagttcacacttcttttctgtgctagtgggactctctcactgacgtgtattgtaccctctgcataggacagtctgtgatacatactacttgttttctgctaaacacccatcaatcatgtcatttatgagtcttccataggtgttacctaacctatggctatggggtcttccaaaagaatgggccggaggtggagctgtgaaactgtagctggataaaaagtgtaaatgtcaagaaagggtattgaagtggtgataataataataataatccaaattagtctgggctcttggctgtgattactggtaaatgtgaaagagtctaggtttggtttttattagttttatttcaactgataaagtagccagagtaaagtgcataaatcttgaatgttcaactgaatacagtttttgtgtaattcattgtccaaatggaatgatagaatatttcacattcccttgtgcttccctcatggacaatctttgtcagttatcacccctcccacccagcaaaattaactgtctttctgacatctatacaatcatttaggttttcctgtcttaaactttatataaatagcattaagtgtatttttatctttttagacttggtattgctccttacaacttttgaggccttcatttctttcagaggattcaaggtcctgtcttatgtcatttcctgtgattctgaaggattttctctcaaatgtcttgtaagagacatagctgctatgaatgaatgtattttgtttatcaaataatttttttgctttttctttagatttgaagggtattttcgatggatatagatttcctggttgcctttttttttcctttcagcatttaaatatgacatttcactccttctagcctctattggtcctgatgaaaactcagccaatggctatgttgttgtttttctgtatatagtatctgctttcattcttgatgcaatgaagattttctctttgtctttcaatattttaatataatgtgttcagttattaattcctattgattatctaaaagatttttattgaattttttcatctaagaattttttattacttttgaaaagtttttgtcattatttctccaaagatttcttcagccactttctctttctctcctcctttgtgactcttattatacatttgttggtattcttcactctgagctataaatctctgaagtcttcttttttttctaaactttttctttagactcaataatttctatacctctattttcaagttaactgattgttctgccatctcaatttgctattagacctagctaacaaatatttaaattggtttattgtacttttcatttctagagttccaatttggtcattttttatattttccatgtcttttcttgagcccctacttgccgaatcttctttttttttttaaatattttcttttttatgtcaatgatcatagatttaaacataattatttgaacatctgcatattaactgctttgtagtctttgctaaatccaataattgggacaagttagaattagctttcattgactattttctgttgttattattgtagctgctttatttttattcctttaatattgttcatacttctctgcttttttccagaagttgtgaaactaaaaattgtacatttttgatagcatattatagtagctgtctttagattttgggcttttttattttaattttaacttttttagaaatagggtcttactttttcacccaggctggagtgtggtgctgtgaccatagcttgctgcagcctcaacctcttggggtccagaggttctgcagcttcatcctcctgagtagctgggactataagggcatgccaccactctctgttatttttttttttaattgtaagataagagtgtcactattttgcccacccagcctggtctcgaactcctggcatcaagtaatccttctgcatcagcctcccaaagtactgggattacaagcttgagccaccatgtcaggcctggaatttgttttgtttttctgatcattttttaattttcttcttagtttcttgtctgaacttactgatagtacctgacttatgacagttggagttataatgttttgactttcagatggtgtgaatgtgatatgcattcaagtagaaatagaaattctagtatttacacaactattctattttctctttcaatatagtattcaataaattacatgaggtattcaacactttattgtaagataagctttgtgtaagataatgttgaccaacagtaagctaatgtaagtgttctgagcatatttaggataggataggctgaggcataatgttaagtggattagatgtattaaatgtattttcaatgcaagatatagaaaaatctgtatctcatgtggcgtttgaccacagatatctctgcttctttctgttcttaatattaatatttagtttgattttataggaactacacatgtatctgcatagcgaagtggtcaccaatgatctgagacattttgctcaaatatctggaggttataaatctatcttctgtcaacccatctgtgtgtagtttaaaaagcaaactgcatgcaaaatgcagctagttcttacctccctctggttttactttgcaccggaaactcctagttctcatcactcatatctataacttctaggtcactaggaatatgtgcagagattatttcagcaatgtgggtctatcttatccaggaatctgctatttactatcagcagatgtactacttgcctcaaacaaggcatcatcttggactagcaaggctgtgggctttttctgttcatttcctatggtgttctccctgtttagctggaaacactgaagaattatttcccactccttggcttcactcaagtccacccactttggcagcaagctgccagttttatttgctatccttacatgggtaaaactccagttctgcaattcatattgactgagctgggaatagaagggtgctgtcacaggcaaaaggctacagacattttctgtccttactcaaagcactagtactttttttttctataaagaatatgcatccttaattattttatgctttgccaattttcagagtgctgaaatagttttgatatttcaactttatatttataggtgtgtttgttgtttattcttgcacagatttattaaactctttgtgatgccataaacagagatgccttctgaaatgcgtttaaatgaatgtaatagccacactgaaatggtatgatgtaatggactaacataagtaattttggacttgagaacttgagctccaaaatggccaaatagagcagagatgctaaaactgagtggccaccacactagctgtctgtaaaggaagcagctggtataatctagtaaacactgatggtcttcttgaggtttttgtttcatgttgaatcactgtgggaggccagttattatactgctgacagtaataaactgcaaaatcttcagactgcaggctgctgatggtgagagtgaactctgtcccagacccactgccactgaacctggctgggataccagtggccctggtggatgcaccatagatgaggagcctgggagcctggccaggtttctgctggtaccaggctaagttgctgctaacactctgactggccctgcaggagagggtggctctttcccctggagacacagacagggtggctggagactgcgtcatcactatttctccagtggtatctgaaattggaaataaaacagaaatgcactcatgtaatcaaaatcaaacccactgtctttaagtagagccaaaattgttgatctacattgaattttaattatatttcttgctgagcagaggtggcaggagttttcactgatgtgcaaaaccacctcatattcccctcacctgggagccagagtagcaggaggaagagaagctgcgctggggcttccatggttccgtctgggtcctaactgagcagttcctccccagagctctgacccaggcattgatatgggctctggaaggtagggcagctgggagggacatgcaaagcagctggggtgggagctgagctttcagctgcaaagaccacctgcttcttcctctctgcactgagcatcctgcgccgccctggttgtcaggccagaaaagtctgttggctcagtctgagtgtagaactcctcccttgtgctcagagaatttcgctcctgtgtctttcttctcctcaatcacctaaatccacccagaagatgtttggcacaagcctgttaagaacaatataaaaagctgtgttttcacttctctcttcctatcctcaatatgcccagtcatctccctaagtgcattattggatcgatggaaatgaagagtctgttaaaacttaatcttccagatacacctttcatttgcttgttagtaatgttttctgagggtcctgaagctttccattaacccagccacataccctctttgagttaaaaagtgaaaaacttctgtttacagtcacatgtcctggcagccctgacatagatgctccatggcttgccgattgcttgaaattgatcaagtaacttaacttccctgtgtctcggtttccatatctgtgtaactgtgacaatactggtacctaccttatagtgctgtagacagtttaaagaaaataagataaaacatttacaatagtattcaggacattatgtatgcggcaattaattttgtttttatttattaaatattcagcactacagtcatcatcattatcataaatatacttacttagcacagaaaagagtcttcagtctaatccaagaatgttttatccacagccaaatttaattctaaggcttttccttcactaactctacacaactctttaaatcctaatgatttggtcttaatctgtgctaaagtactcacaccttcaatcattcccacccatccctgtctaactcattaattctcatcatccattatcaaaatgttactctataaaaggttcccatgtcctgttgctgtccttctttcttacacaatctttattctaccctgttatcttttgtcttattcttgccccaggacaataaggaaaagctaccatcattacctgttgacttgctccagtataattttttcaggcttgttaccttggaaatgaggactatgtctggcaaagaaacatattcatcgggtcaatgtgttatgaaataaaatattttatctacttatgatccaataattaatttagacctacttgaacggtttttttttaatgaacgaagaagaagatgatataagaggaaaatacaatacaatagaaaacacaagctattataactcttgcttcacggatttctacatatatattagacatatgctgggtatatgtgtgcaatggtgatccaaaaactgaacgctaactggctgaaggaaagcctgtattacattgggtcttgtctatttttccaattatgaacagaaagctacagtactatttgtatgagtatcaaaccttctagctgctgtgatggaggtagagaagatttactgagactaaagccttggaagtactagaagtttgtcctgtgatgttatgggtgttgctgtggttgttgttgttaggaaatacagtggaagtcaaagcaagtagaaaatttacaagctctgctcttcctcatactcacaaccccttctagagatgacagatagtggcataggaatctctgacacctctaaggaagtcttttttgctctttccgggatctttcctgacaagtattgttttgagtcacagatgatgtggaagtaggtgtagaagaaaggactagagcaagggaagaagttttcaatcccaggtagttgttgtaggcacagggaaatggaatttttcatagatttatgctacacttctatcatgttggggagagaggcatcaaaccaagcttattcttgaaagaaacattacattattttaaagagaaggaactatgcatttcttgtcaaatagatgtttaaaattcaaagctacaatttttttttttgacagtatcttgctctgtcgcccaggctgtagtgcagtggtgcgatcttggctcacggtaacctccatctccctggttcaagtggttctcctgccttagcctcccaagtagatgggattacaggcatgtgccaccacacccagctaataacaggagggagtaaagggccacacaagcatgtacacaagagacaacttttcttcttttttacagaataagtctaaatgtaaaatagcgttataatgtatggactcatgtttaagacaagtctcttggttttctaatttgtgttgaacccaagcagtgttgtgatagaaaatgagtttctttttctttaagctgaatttgaatttgctccaatagcctaatagacaccctagtggtaagtcctctgtgatgctcgccattgtccccatgtctaacaaggatttctactggacatagaagtttttctaagtccaacaagagggaaagagactgggccatcattgttctcatctcagatttccacttcctgcatagaaggtatacatataggtagccagacgttatgaaaatggattgtaagcatttgttagtgaacaaaatatgactcaaacagtatttttattttttatttttaaatttctattgcttattatttgagacagactgtcactctgtcacccaggcaggagtgcagtgggtgcaatcttggctcactgcaacattcacctcctgggttccagtgattctcaagcctcagccacccaagtagctgggattacaggtgtgtgtcactacgtccagctcatttttttttttgtatttttagtagagacagggttgcactgtgttggccaggctggtcttcctgacctgaaatgatccgtccatcttggcctccaaaagtgctgggattacaggcgtgagccaccgcactgggatttaagcaatatttttattaagtaaagtgtagaagaaaaagtgtaagtaaggtgacaataagaaaacaaaatgccgtaatggaaaacgataactttagggcagaaaacaagaaaaggcaaaccaagattcctgtagggcaagcctccaatgcacaatccaaggaggaatgtcaagggtgaaaactctggagcatccagatagtggcccaaaataccaaatgctgaaaacccagaatacccaagtaacagcctatgagtgtccccacaccaaatgccaggaaaccctggagtatccaggggctgaccagtgcagaaaatcctggagcctcagtggggtggccaacaatgagccccaaaggcctggttggggccataaaacaatgtgactctggcttcttagagtcaacagaacaggagaattcttacatccaagtgtcctgccttaaacaattgcacaaacataattagcagggacccaaagaaaaaactgcaaagcaaacacatatatcggggcagaaaataaaataaaatggctgatggataaataaaatggcattagaggagaaatgactaagagaaagaacaatgaggatgtagtcaggtgtgctatgggggaattcaaatggactatctagccaaaggccttatttcctggatcatctatataggcaggtggatagatgggacacttacaggtgtgcaggagccaaaatggggccaagcagtgtctgacatggggcctgcatgaagatctctccaggcttcccagctcggatgggttgggctcctatgggggaactggagcacggagcggctggcctgcatgaagcagtggctctgtggcctcttgcccatccccagagctccaacacctgtcaggaaagatgatggttcttaaaacagcctttggctagtgttaatagctctgcaatgttaacaactcagcataaagtcacacagacacacagacactgtagctttgatcgctgtagcgctgatcaccgtctcatcctctctcactgatcgctgtcttgccacttctccaatagctgtcttgcccattgctgatcactgtgtccatcttctcataaagtgccatctcttgctgtctcttgctgtcttgcttctccgctgtttccactgtcttactgccacatcaaatgctgcttctcaccatctctagtggtgagtggctggctcaatattgatgcaaggcaagtcctcagctttgctcaggaaggaatgtaagagtaagccagtaatagaagaaaacagctttattgatggggcagcagtgttacagctctgtgactactcctgcggagcaggggtaattcataggcagagggccgagagtagcagccaggggcatttttacagtcacatttatacccacttttaatcatgtgataattaaggggtaggttgttcagaaatagctagaaaatgggtggtgttgccccaacttccaggtgttgctatggcaggggcaggaatttccaggtgttgccatggcaagcgctgtgacttctggatgtttctatggcaatggtaaactctcatggcactggtgggtatgtcttatggagaggtcctttcagaaccctgttcctgttttggccagcctcacatctggtcctgagcagagtcctgcctacctcttgcctcaaaagtaacaagaaatctgtaatgaaaatttacccagacagaaaactccaattttatatttggtagttagtgacatggtacttatcaaagttacacaaagattcaagtgaataaaaaatactctcagaattattataggaggtcataatgtcctgtagtccaaaaattaatatgcacataacaaaacaaagaaattaaaggctgatatccattgtgaatataaaaataaatatcttaagaaaaaaagaaaaatgcaatcccactgtatatctgcacatttagtgaacacacattgtaaaaagtgttacagtttttataaaaactcttgataggtaattttaatttctgaaaaatgtatatgaactataaggtatgttggatctcttcccctaacttaaaaaatatttcttcacatttaaattctttaccaatttttaatgactttttattgcttagaattttagttgatataaataagaaatgtgtattaaaagcctaccattttgatttaacctatgaaatatatttaaattcttggaaaaatccaaaaatacctagaaaagtgagctcttgccagaagatacacagttctttagtgtcaggctgagattatctcccagaaataacttttggctcatatagcttccaggacactgcaagaataaaagatgtgaagacaatgttacttaattggatttgcaattattcactattcactgttaaccaattttattgaaaaaaaagattccaatcaaatacactgattttaagtgtactgttgggtttaataaataaatacattcttggaagcaaaatcaatacacacaacatttctgtaactccaaaaagttttgtcctgctcttcagcaatcaacttgcttccacctcacagaacagaccatccttattcagcttattgttagtatagattccactatctttttaagaatttcacataaaggaatatagcacatgttcttttgtggctggtgactttcgtgcagcataattgtttcctaggctcattcatgtcgccttgtgtcctcgtgatgtgttactctttacttttgagtactatttaaatatgtagtaatttcacaatgtatcccatcacctgctgatgaccatgtgggttgtttccactttgggctattatggataaagctaccacgaatggcattatacaaggctttgcatgaatatttctttatttcttttaggcaaatacctaggagtgcagttactgggtcttacagtaagtgtttaatactctgtcatactgttttccaaagtggttataccattttacatctcagcccagaattgatgagagttctcaatgtttcagctacttgtttttaagactttttcttaatcatcactcaacagtgaccagaatggctaatgatcattaagtcatgttttccttacaatttccttgacttttgtgggtgcttgacttgtatcaggatattgaaaacaggatcaatattgtcttaaccccttttaaacactttttctaagtaatgatatttaggatgataacaggagatctaaagggaatgttgggagtagtaacaggcattatccaatatttattatcatactccttaagacaatacattttgagtgaaatagcattcagctagactagggataaaaaggttctaatctcagctttagcattaaatattaggaaacctctgagaaaacaatccaggaagacaaatcagagggtgttttgctagtggagaagtgctgcaacacctaaaacctattaatgccagatttttgcagtgatttccactcataaagttgggttgactcctagccttgttctcctatgtgtctgtgtgactttatgctgaggggatgtgacatcacagagggagaagtgcacttgtgtacagaaacatggcttaggagattggctttggatgtggctgcaatgaaatatatattttgaagaagtcccctatgaaatgtcttatacattgtttcttatggcagggtgctcgggctcacacctgtaatctcagcactttgagagaccaaggaggaaggatcacgtaaggccaagaatttgataccagcctgggcaacatagggaaaccacatgtgtacacacacacacacacacacacacaatttgtgaacagtggcatcacgaagtgattatttatgaacaattggctaagaaaattacaaaataaagcaatgtcttctgagctaacaatactataataaagatgtcaattatttaactgtagaaaatacagagaacataaaattgtctatcttaaccatatttaaaagtgcagtgcagtggcattaagcatattcacatgttctgctattattaccgatactgtctccagaattcttttcgtcttataaaaactaatatctataccccttaaacaatactccccccgtttcctctatccttatccctagcaacctccattccagttctgcctctatgtcagtgacatctttgaagcaggttcactgtacactggttaccaacgtacctgagcgcgaggaacacaacacccccacacagcaagttacatgaagggggtttattattacagataagcagcaagggatcacaaaactcttggactcattatggatctgtcccccaaggcatacgaaagttatgtggagctgatagagtcgactgtgtgtaccccgcttgcatcacagctcaggaatccggaaaagcagacactctgggttttatatcctggggtaatgagacgcacagggctaacgtgcttaaggacattccattctatgagaaactggaatacagcacaggtaggctgttctggccagttcctctctatctcaggatgttacaattccagcacattctacaattattcttgagaactcttaaaataatcaagaaagtggagagaactaagtcagcccagggtcattggagaactgtcttgcagttaccccaccacctagacatcccccttagtaaagctagcatatttcctacacccaccaatgtcccccaaactgaaggcagaggtttatcttttcagattgacgaagcaccttgatttacacaatctcagtgcagattattaagccatagtgagagtacatttcgctggtctaaggaaggctactaccactggcaggagggataagacccccaaaagcagtgacctagtctaggatcccatgatcaagaaattaagatgccaaagaggtgaaagggggatctttcagatgccccattgtctgcagccattgagcctgcatcaggatcacctctacttatatttctaggatacctgaggtgtttatccaggtacagaaggcagtgttgggtgttggtaattacatggaacatccgttatgttccacgagaatgtgcccattgtcacgctgattgggcagtgaggttgtttcttggtcagagtgaagtctcatggagtatccaaaatatgacataaattcctctcaagggtggccatggtagcccgagcatctaatagagtgacatatatttagcagtccaggaagcaagctattgccatagtccttttctccacacaggggatcctttagtagttcagtcactcagttgctgttttcctgaccagatgactgggttgttgaaagtggcccatgatttaatggaaatggagcaaaatatagtgttaggggcagcctgcatggctgctatcattgtatgtagtttggcccattgggcagaatggccatgtttagtgtcaatcaaaagatgccatcccctggctggatggtggccacacccagtggacccactggcatgtgttttgtacaatcatcagggccccatgccatattgacataggcatgtctttgaatctttgactctatgtggccaaaggagaagctgaattgtcccctgtgggtcatttgttcccttcttgcaagcttgtcatttgtttatggggcacatgggtattgtggcatcctggttagggctgattcttactgtaacatttccatttagtaatttggatctgttgggcctgtccagttttattgattgtgtttgtaggcaccaaagtgagaatctgtagttaaggtagcagtgtcactcctggtcctctagctctgagatactcaggccctatcagtttcctacagcaagtaaggagttgccattcaaaagaggcacaaatggtggctgcttcaggaaacatttgcctccaaaatctaagtctggtgcacccagtgacaattttacattgccacagactccagtcagcatgcctagaaatagtggacacctggatttacatcgagcaagcaggctctaaaggtcttaaagaaatgccttggacatgtattgttgaatagattcgaaggctaccgttgcaaagggctccattcaaagttgtcaaatttgttcatgcttttgactaaggtgaccaaaaaaaaaaaaaaaaaaaaaaaaaaagactcagggggacagtgcagctaggtaagaatccagtggctttcccgagcttatttgtcttgcatttttggtgacatggattgttgttcatatcggcttcctctggcaggtccacctggaaagcattatatttagcaagaataaaggaggctgtgaatgatgtcactgcggactgcgtatattccctgttgcaaatgtcaaatccatgaagcaaaaagggatttactagaggttattaaattccttacaaattgttgaaaagccttaaaaaacaggctccagtcaaagcctctagaacaattccaagaatcgtactgctggcacaggtcgggggagcatctcctgcgcctgagactccacattcaagctgtctcttgcagcagaagagagagcagctcttctcactactgcccccagaaggacagcagctctggtatcaactatcaactgctagaaatctgacccctttctctgactgcccatcagatgtgttactacagagtcgttttggattgagatgagggaggggaaatgcctgatctcactcaaatgtgctcattttcctggtctgagtcacagccaggcagcacagtcctgtgggcacaatatcttcacttgccaggttcctataaaatgggagtatctttcttgactgtggaaaatatggaggcgaggagggtcaagcaatagcaaaaggagtacttggagttgcctgagcttccactctggtttccccaaatgttttcaatccatttaattcatgataataaacacctttctgcctaaccagccataatcgcttttcttaggtccaaatgattcagtgataaaactaaagagaaaaaataaatacacttttcaacgttgaagctgaccaggtgtctgtctctggtgtttacccctccacatcccacgatgtgtttcatcttccctttgcctcactggagatccaagtgcaagtaatgcttcacatgactgtgatccctagaacttcatcctgatgactgttgaaatcttctctgagttttaccagtggaaatggcaataaatagaaagattccagaaggtcccctagggtccatattttctgtacttcctctctaaaatatgtaaagtcaattatgtttgctcttgctttatatgggctagatctatggccccagcacacatctgaacgccctgtgttgacaacttatccagtattgtattgagtctgaatggtcacatgcttatcatatcatttcttccaatttcatgcaataattgtcatgtcaactgtttggattaagaaccatcagccagaaaaccacagccctgagaaaatagaaatagagtatttcaagctgttcagtgggcatagcaatgatgagtctacagctcattttcaatatataaatattctgtttatgagagtaacagtgtttcagagcctccaccacatctgacagcataacaatgcaatagcacaagagtttgtgtgccagcgttgcttgactaataatgggtttttctttgtctatagggtaagctgcacctgtgcacatgacaagatcatgagctacactttgcttcactttttttgaggtcaataaactgcttgatccaaagccatattatggaagaaattcctgactctgatgaaaacacttggaaaatcctcaaataatattttatgcagaaacataaccgaaaaagaaggcaaattcatatattgcaaataaccagtgccttcctcatgttgcatgaggtccactagaatcacctgacaccagctgttagtctgagccctgatgtgtggtacaatgttaagggttcaagaggcatcagttttcttggcaaattaggtgttcagaagagccaatagccctgtacatctcagttagttgaaactcacattactgagtccccacagggaccttattaacattggttcatgaggctacctggggaagctgggaaaggtgattgactgaagtccatgtgttgaatcatcctgattattaaaagcccctgcttgttaatggcatttcacttaatattcacttggaaagcattttttttattatggctcatttttgaaatgtctggtcatagcttttgcagaatgactttgtctgaaatcagcctgttgcatttattttaagacttgatgatctgtcaaaaccaacagccaatatttattaaactgctgttatcttgcaatgggatcatcagatgtaaccattgcagtttacccacggttaggatttttacatttccagtgcttctttgacaatgacactaatgtgactctatccagcgtgcattgttgtgagaactctatttggcctatcatcattgtgggcatgaacataatggagactttcataggatgcaatggttaatattcaacattagtcaaaatttgctctagtcctaccctcggagctctactgggttggaaaaatattttaggtaaggacaaccatttggtaaagttttaaaaataaaggctacaaataaattttctgtagcaagagtattgcatacataatagaataaatgtgcttaaatatgaatactatatatatttgtagccaacattttatcaaacaaatatatattcacttctatgtatcttatatatatgcacatttttccataaataaggtaaattttaattttttattgaaatactagttttaattctgttcttaattttctcttaataacttcataaattgatcactaaatattcacatttataccaccaatttaagaaaaaaatacatatgtttatatacacgtagaggtgtaaataccgtatcaggaagcctttatgcataatgattggttactggttaaatacacaactcagtgacagaaaacagtaaacatttgttttcgtgttcatggatgctcacgttcacaatcctctggctgaccaaggaagggctctgatgagtcgttcctctgcagggcactgagctcaccttcagcctacagatatgaattgtctgaggacaaggctgaacagcagtgactacacatgacacaagattcttgtggcaggtcacaggagtgaacaacatcccaaatcaaactgcacagttgaatttaagtccaataatttctaacatagcttcacacattttaaatatattcctttatttcagtgagtacacattttcaagaaaatgtttactccatttaattatagaagggtttgatcattccatgaacaaataattatgttttcaaactttacaatcctgaaaatatttgcaaatgtaaatttgcattaataagaaaataaagctggatgtgtttccaacatgtggcttcaaatataatttatttaaatggactcattggggtaaaaatcattttaacttatgtaaatatccctttttgctgtgcttgtgtcctatagagttgcccaataagagttcctcccgtgagatttggaaatcagaaaaggaagactcaatattatccattggtaactaagacaggtacaaggacagaggtgaggactggagaaacacctggaaggatgttgcaggaagctaagagcatcagcacgcctacccctaagcttccagacaggactgaggaccacatggttagaaagcccttactttaggggcggatgcattctgttttctgagggagaaccagagaatcctgcctctaatatcaactttcctgactactgtatccttgtctttgaaaggctgtagtctgaacgttaatcataggcattggttcattcttgttatacccaacagagccaagaaacctagtggggaaaggcactcagggtgcaaaatattgctgctggaatgcaattgaaataggccctgttatcccatggaactaaggtttatggttttttgaataaacttagaaattgtctccccctccctgtcttaaaactcaagatagttacatctgtcttacctgagtcctttttttcagtaaaccaaccatcaggcctcccagatactattaagaagctgaaacttacatatcactgaattgggacagtgagacatcagaaccttcacccactgtgattgcataactgacctcctgcttcttcttgaccaaattatcttccttacccctccctaattcctgttttcaacatttcttccctcctatataaacccctaattaattttgtcagagagatacaattgagaatggcgtcccatctcctcggctgcagcacctgattaaagcctgttccttggcaatacttgttgtcttcgagattggctttctgtgtggtgagctgcaggatctacaccaagtccctggtatttcagtaagaaaattctctgcaaccttcagtgctttggcttattgtaacctgaaatcaaatttatccacaatttctgagataacttgatataactctaggattcactttgtccaccactgtttaccagtctgagcttgccagctcccaacccttcctagtgccaatgaactttctcaaagtgcaataggtaatatttccctttttcatggaacactgactttttctttgttcttccaacgtactgaagaccactgagttttcctgtatgcctcatttggcaaatatttctcttcaaataaaacattaaatttagagattcatctctacattttatttagacttcagcagtttattctaattctctgtattaagactattcctgcttagaatatctatagtggcttcttctgcattatgatttccaactgaagccataaactagactcctcaggtgtcatgatctctgtttttattaaataaggagaagcattgctatgtctgtgcagttggtgctgagaaagagaaaagaattagggtgcagaggtgacttcatgtccccatctaccaacaccatcagagtgtggctgcatctgaggaacactctcagctgatggaggcatcaggagaagctgctggggcagcccagcctcacacatctgcttccctgggggtttatgtttgggtgtgtaacactgtgggagggtaactattatactgttggcagtaataagttgcaaaatcttcaggctgcaggctgctgatggtgagagtgaaatctgtcccagatccactgccgctgaactttgatgggaccccactttgcaaactggatgcagcatagatcagggacttaggggctttccctggtttctgctgaaaccaggctaaataattgctaatgccctgactcgcccgacaagtgatggtgactctgtctcctacagatgcagacagtgaggatggagactgggtcatctggatgtcacatctggcacctgagattggaaacataaaaacaaatgtccacacaattaatcatgttgtaagagaatttccctgaatagtaaagcagtactgagcaccctgggctgagtaaactgctagtgttctccatccttacctgggaaacagagcagcaggagccccaggagctgagcgaggactctcatgtccatgctgtgtcctgactgggtctgattcctgcacaaagtctgaccagcctattaataaggcttcagggcaggaggttgtgctctgggaacatgcaaatgagcaggggatggggcaggctgggcacagctgcagagctggcgcatctcagtaactcagcaccagctcagtgtccccacgtgtcccaggtaagatcaaggtagctcaaatttgtctgcagagaatgtgtttctactggggactattttgttatgggaaacattttatggtttctttttgacaatttgaaatattccttgggagtcgatggagcaatgtatttcattggtgtatggggattatttaggagaatattcttttttgtaggaaacacatagtaaaattttagaccctacaattttcaggtcttcaaaagactctcatgtgatttctgttagggaaggtggtacttatcatatacttgcaacatttctgtgagtttaacattgctcctttctaaaaaaaaattaaaaataaaatttattcacatgatgctacatatatttgtaaatgttaggtaatggtgttatgccattgttcttaccactgtaagatcaagcaatttacttcagatacactaagttgataccgtgtttcctcaatgcatgcagcaattacagatccaccattatcaagagctctaggtctctttaatatccagagactaaatgggctgcaccttattcctgttttgcaccttattcctgttttgggcaccttcatagtctaccttcttttctgccattaagtattatttcccaacattcatctctcttagtgagggtgatcactgcatggagcatgtccctgccatgcaccataggtgacactttcttcttttactttttatcagggacatcatcctgacccagacaccaagatccctgttaacatcttttggaaagaggcactcaatcttttatcaagcaactgcccaggtacatggagaaatcagttggttccagatgaaactggacagggatttgcactcgttatatctcatatctctaatgtgcccaaaaatgtcccggcctggttccgtgggaggggaagtggatccaactacatcagcatcagtgggctgcagcctaggactccataaaattttactgatgcctgactaggagagccaaatcacagtgctgtagcctctgcacaaaccttcctgctgctttataagctgcctgaattttaagggaaattgcttatattggaagaaaggaagaaagctccatttgtcctctaaatgtttgctgaaaataaactgacaaaaggaagattaataagagaaaaggcaaacaaaattcacttaaagtgcagcaggatatcatagcaaggtgattacccagataactcaatgagatccaggtgtttatgtttcctttctagggaagaggtaattgggaaatgtaggcaacctggagagaatagatgagaatagaaatgcatcctcaaaagaacaggtaatcacctccctaggtaaagtatcaactttgagtctcttccatttttgattcctcttttgtgttaatcttccttgatataaaaattctcaggaagagttttcttaaaaattggtttccttctgaagaatttgcttttaggcaggtaggggatatttaggaaaagccccctgtgcatttcctgctttctaaatgcctttggttttatataatcatcatacaaatgcagcacagtttgagatgttattttctggattcctttacttgcaacccacctgccaagatcctgttccagagagatgtggctacagactgaaagagcagttgtcccctcaacaacgtggaggttggggcactgaccactggtgcagatgaaaacctgtgtagaacttttgcatctccaagttatgtagtaatagattacttttgactggaagccttaatgataaaataaatagttgattaacccttttttatgttatacatattatatactctattcttccaataaagtatgctaaagaaaaaatgttattgagaaaaccttaaaaatgagaaaatatatttagtacttattaagcgcttgctcacaggtgacacacagaagaaaatataagtggatctgcaaatttcaaacccaagttattcaagggttaactgtaccatgatgaatgtagcagtccccatctatagtctagggcttttccctttgctgtatctctgctcatttccaatggctatatatatgtcttatgtgcttcatgatcttgggcagagaggtctgcttgcatgccttgctggccagatggcctgcaatgtgtatctcttaggaaagtgctatggtttgactgtgtcctccagaatccatcgttgtaaagttaaatctcagtgaaatggtattgccaggtggggcctattgagatgtgttagatcatgagggtggagccctctagtggaataccttaatgccactataaacagggtttatggggctggaatctctctgtctcttctgctggtctgtcatgttaagacatggccttcgttcctttgaaggactgaaagctccaggcgtcatcttgaaagcagagaaagacgaccttaacctgcccatgccttgatcttaaatttcccattctccagaaatgtgagaaaataaatttctgttctttatgaattacacagtggcaaggaacctaacctgttatagcagcttgaaagagaacaagagagacagctcacaatcagtgaggacagaatgaggtgtatacataccttagcttcctcgtctctcaggtggaatagcccagaggaatttagtccatgtttccacatgtggttgatcttcagttatcctgagtcaggtgggttgttgatgtgtcttttaccattcatcttctgttccctccctcactttcttcctttcctcccagtgtaaatttgctgcctaaacaggaatcctcattgctggtggacccaaactaagatagtaaataaaatcattaatcttttgtatgaggggtatttctcatctgaattcttttatcatttccctttctttgacatgtaggaatattcaggaaacacacaattttttttttaaccaatctattttagattgaatttatgcggtgattttttgtgtgtgtgtgttaaaacaaaaaattacgttgtaagccactaaccagctgaacggactcctcttttggtagagagaacttcaaagaaatctgaaaaactaggttaggccatgactggcaggtgggtttagatgtacctcattatatggtccttcctttggagttcagacacaactgaccagcattatcattacaacagagatctttggattgacaaaacagatgctttgtagcaataagataccatactccaacacgacagataataggccctgaagaaaatcaaaatattttaccctaaaagtatttctttgacatattctgaagtggccctgcaagctgcctgttgtgggggaaatttgcattctgcagagaatctcctccccttactaagtcttttccaaagagtctgacattttttttaaggtctgataaacaacattagccacctactttgtttgctacccataggattcatctaggtgacaagaacctttgcttccacacccccttttctaaactcaagcatttctttatgatgaattcaagtgtttaggcagagcttaactctttcaaccagttggcagtcaggaaatctttgaatccacctatgacctggaagcccctacttcaagctatcccacctttccaggacaaactaatgtaaatcttatatgtattgatttatgtctttccctgtaatttctgtctctccaaagtatttaaatgtgtattcttgtcaccctgggcacatgtttgcaggacatcctaaggctgtgtcacaggccataagctttgggaaaataaacctataaattgattgagacccgtctcagatactgttttgtttatactggtcacaaacttaaaaatcctctaaaacaatctacacatcaataaatctacattagagacagtggaatgatcataccttaacagttaaagctcacaatttaaaggaacctgagtctaagattttggccagctctcttgcttcataaaaaatacttcgtgatttttaaaattttactttagagaaaggcaatttgggggaatatatttattgtcaatgggatgaataatgtctctaccctaaaagatgtccatgtcctcatctctggaacccaagtgttacaggagttattaagaaattattttaggcagataggaaaagagtgtccttggtaaggttttctttcctttaaagcagctccagaaacgtttcttgtctagcaggaaagccctggctcttagagccaggctgggaagctttgatttgcaaattccggccattagaaactgagtccagccaaacctgtcaattcccaccatcttcttccttgcccccacatgtgcctgacaacaaggctgcccccacatatccccatgtgtagagaatattttggcaccctgcatttgcatattaaaagtcttgttgggaaggccagttattttgcaggcttcatgaatggcatgcctggtcaaaccagtccctagagccctatataaatcagacaccacctcctccagcctcctcatataagagccacttttctgctgcaatggagttttgtctttgttggaatccctcctccctctgtctctgtgtgggggagctgttttcttcttccttccttcttgcatattaaacctttctctccctaaaaccactccacgtgtgtctgtgttgttttatccaaagtggtgtgagaccaagaaccctggtgttcctccagtcaacggagccgtatcataaaaattctaccttacatagcaaaaagagaacttgacagatataagtgaagaataagcgacccagttatctagatgaaaccaatatgatcacaaaggtccttaaaataaaagaggaggcttgcagtcagagaggagctgggacaatggagagggatgtggtttgaagagggaacgggttactctgctacaaaaaaaaatatgaccacgggggtactttgcttaaaaaatatcccagaatgtcctgctatacttagagagcatttgcttcccaaatagaaaatgaaggcctccttcatttcacaccagtttctgctacatgcactgtatcgctctgttgcttggtgtctacgcacttagaactgctctgtcttctttccgaaatgactttcttcattatgtaatgtacatttctgtcactggtaacattcttggctttgtagtctactttatctgatattagtatttgctactgattcattttattaattttgcatactatgccattttcttttcttttatattgagtctacttctagtgtcatatttgatgtgagtgtcttatagacagtatactgttcggacattcctttttgattcatcaattgctgtctgttataatttactaatttgcatatttaatatatcgataattattgatatactaagatttaagtctttgctctacttttttgctgtatctttttttgcttctccgttttctttttgctgccttcctttgggttacttgaacatttttagaatttcattttaattttacctaatttgagggtatctctttttatagtgatttttaaattggttgtcatggtatttcctttatatccatagcttctcacagtatgttggtgtcataatattaccatttaaaataaatataaaattttaccttgttttatgtcatttttcttcccccattagtaatagattgtgcacatatactcatgtacccttcacaccatctctagcctacttataatacctgacgcgatatgtatacatgacttaacctgtgtggattcaaccaagtggtactaagcacatggtgaagtcaagtttttctttttggaactttgtggattttttttctatatatttttgatccaggtttagttgaatccatggatgcagatcccatggatagagagatgactatactgctccttataactctgaggatcaactctgtggttcctccattctgggctggctgaactgatctctgctgagcctgctcatgtgtctgcagttaccctgtggttcagttgtgactagatggtctgatatgacttgtttaacctatctggaagctgatttgatgtgcaggttggacaacatttggtttcggtttacataggtcagggagatggggcctgttccccaacctctattcagttcgtttctagatcaactcaggagttcgtctattcattgtaggttgtttgggggaaattccacacagaacattggtaatgaagaagctgaactgctgtcatcagttattgttatcatctgaaatgcatcatatattaccaaagtctccccagggtggcccaacagtgcagctcagctcaccccatccagtcacttccctggttgcctgcaggtgtgagaaaggcaatgtgctcagtcacaggaaagacaggggccctccctggtgctgaaacctgcagatagttttcacacagtttcattccaaaatacaaagacttcattttctttgtctttaaaatagttatacattttctttctataatgtccccatgcttttcaactaatttgaattttcagaactggaagtatttattatttctgtgttagatgctcttagtcacttatggcaagagtgagttaatagagacaggatatggattagccatagaacaatacagaagtgtgtggattcagataggataaagatcaaagcggtgacaaatacattcttttgaagcggattctcataggtcaccagtcaatgtccgcattcaaggtgcgatgatgtgtcagctacattgtgcaaatggtcagctctgcagagtaaacttggacagcacactacaggaccaaaattacctgtaaaggtatggggaaaataaaccatcatagaaaaaatagtgtgaaggagttctcggttatttatacttggatatcaagcagaacactataatcaatgaagctataacctaaaaactttaagacttttaaagaggtttcccttttctcagggtatttctcaggaaaaaatttataaattatggataaactacttgcacaattagctacaataaatcccttccctgcactcatcctttggttggcctcattctaaatggactcaggtgttacccatgtgtcttgctcaggccaataggataatagcagatgtgacagaattggaatattggaaagggcttgcacatcgaagctttcctctctttcacagtgcttggaaaccctaaggtcacaatgagaataagcctgtgcccatctccattcaatgtcagtggcatggctgctcttaggtctattatttgttcttaaaatgtgtgttcagtttgttataaacatgtaagaaattacctgcaaatttatcaacttaagactacacccatttataatctctcaatttctgagtcagcagtcagcacatggctttgctggatcctgcccattggatttcacaagactgtgccacagtgtagactgttcttcattctcacctgagactccctgagaagagagatattttagagctctttcaggtagttgcagagcccatgccttagcacctctgtgactcagggcttcagcttcttactggctcttggctcaaggctgctctcaggtcccagaggctgtggacaattccctgccatgtgatgctcacacaggcaatgcccacatggctggttgtttgttcaaggccagcagaaggtttcagagagtgtctctttccagtctgctatgacagaggcttacagaatacaatacaatcattggaaagacatctcataacctctgccataccatatgggttagaagcaagcctaagttctacctgttctctgtggaggtagatcacacaatgccatgactcactggagacaggtttctgctagggtgttctggcatctttagtttcctcaaatatcagggtactcgtactgagtgtgaaatctctcctacatctacttcatcgtgctgtgtctgactgatcagacatttgacacatgacttttttttttttttgtgacggagtctcactctgtcgctgaggctggagtgcaatggcatcatgtcggcccactgcaacctctgtctcctgggttcaagcaattctcctgcctcagcctcccgagcagctgggattacaggcacccaccaccatgccaggctagtttttatatttttagtagagacggggtttcaccatgttggccaggctggtctcaaactcctgacctccggtgatccacccatctcggcgccccaagatgggattatagggatgagctaccatgcctagcctactttagtttttaagtagatttaatgaaatctatttagtagccaaaagccaagaatgccaatagttttacctggctactctctgaaacaatggtattaaaaagggtctttccagcccctttccagcagaaagacaggtgctaagaaacagtggaagtgtgaaggtgggggaagggagagaaacagtttttatatacctaaactaacccagctgcatgtaaaccagtaactactcatcaaaataaaatacagaaagcatattagttttggtttggtgtgaaccagccttaaatacaaagttgttacactgaatgggtttaattgaccaaaatgcgtagggaaggcagaaaggattaggatgcccttctactcagctttatctgctgtcaagtctggttcctcaggggacacatggatcccctccattgtcctgcagattctgccaggccaaggctgttaaatctggcggggtctcatgtgtggacttctgggtgtatacagggagaaactagagaaaggccgagcagatttttactgcatgtaggtaatctacgtgggcttttagagaaaaaaggctttagataaaaagtgtttgacaaagtcacacatggtttgtaaaaaaacaaaaaataaaatacaacttgaaaactcttggagaagtgacactttagtttcccaaatcactcttcttcatacacttccacttagctttttttcaccttctagctctgtggtcttagaaggacatgcacttaaaataatttgtttccataggaatccaacaagtaaaagcataaacaacatcaaataaactacatcattagcatagaagcatgtcaaagaaactgagattagattttgagttttggcacaagtattagagaaatagagaaaagatttaaaagatagaataagacttacacaagaaagcaggacagcaatacgacaattgaacctatcatagaataataggttgtgataatggatggtgagaagaaatgcattggacagacatgcatgggcatgattgatttgagcaatttagcatggatcaagacaaaatctttaggatttaaagggctgtgagctgggtagtaaaaagccccattttagcacctcttggggctgtagatggaaagaacttggatttaaaactattttcaataagtgtctgctaagtgctaagtattatagctataaggatacctaaattaatagaagcacatattatctgttggatatattctaaatcttttaccttgtttaaattgtaaaccgacctatgaggtagaacctattattgtcacagcattgcgggtatagaaaaggaggcaaaggggggttaagttactttactaatgtcacacaacatgtaagcggtaaagctccatccccaaccccaagggtttgacttcagggcctgccaagacaacatctggactgttgcatggatcttgcctggctgtacatgaagctctaattccaggatggatgaagattccattagaacttggagtagcattaataaaattgcttccttgagaccaggcgaagtgtccagaaagcaaaggagtttaactgcttaaaggaaaggtgcagatttgtaggaaatgaagctctggactgtgaacagagtttttcaaaacaattaaggagaagagaaattgagtctagtttgatagatgtgttgtgcagagtgagtgtagtggagattagagaatcagccaaggaattatcccctgccttcatggatggcatcaacatctgtcttcatggcaattgtattggcagcctgagtgtcagagcctgggtcctgcccatccatgcagctgtggtcacctttgcacctgcagtgctggagttacttgagtgttactctttgaggtagcttcaggacacttggtaaaaatcactaagtggcaagtgaaaggcttggaagaaaagttctaatcagctcttcattcccacctgatgcaatttttgctgctgctgggaccccaagttctttgtctcctccccgccgcttttttttttttttttttttttttgagacagagttttgcttttgtttcccaggctggagtacagtggtgtgatctcggctcactgcaacctctgcctcctgggttcaagtgattctcctgcctcagcctcccaagtagctgggattacaagtgtgtacccccacgcctggctaattttgtatttttagtagagatggggtttcaccatgttggtcaggctgatttcaaactcctgacttcaggtgatccacccaccttggcctcccaaagtactgagattataggtgtgagccatcgcgcctgaccccttgcctcttttgtaaatagaaatcaacaccaggccaaacagaaattgtctcaggcaaggtttaataggtttgtggcaagagcaaagcaagggagcagcctatgggtaagagatcctggtggctattccttgaagtgcccagctcttaccattttaaggaagctgaggcggaaaaaggaatgacatacaagcatggttaggcaaagttttctttgcatttgtgcagtggagcgtcatgctctaacatatataacatggtgaggaaatggaggataagccctgccttgggtggatattttagtattacaatgagattataatgaggaaaaatcagtgaaaggtcagttctggggaccatcccaccttcagctggctagatctcatttggtgctttggggaaatgccagctctatcagcaaccttggaagatggtcaggttcttatcaggaatgttagagttccactttagaaaccttgggaggctgggcacagtggctcacgcctataatcccagcactttgggaggctgaggagggcagatcactggaggtcagcagtttgagaccagcctggccaacatggtgaaacgctgtctctactaaaagtacaaaacatagccgggcatggtggtgtgcacctgtagtcctagctactctggaggttgaggcaggagaatcgcttgaacctggaaggcataggttgcagtgagtgtagatcgtgccactgcactgcatcctgagtgacagagtgagactctatctgaagaaaaaaaaaaaatgaaatcttgagatactcaggccctatcattttcctacagcaagcgaggagttgccattcaaaagaggcacaactggtggccacttcaggaaacttttgcatccaaaagctgagtctggtgcacctagtgacattgccacagactccagtcagcatgcatagaaatagtggatacctggatttccatcgagcaagcaggctctaaaggtcttaaataaatgccttggacatgtatagttgtatagattccaaggctaccgttgcaaagggctccattcaaagttggcaactttgttcatgattttgactaaggtgaccaaaaaaaaaaaaaaaaaaaaaagactcagggggacagtgcaactaggtgagaacccagtggctttcctgagcttatttgtcttgcatttttgttgacatggattgttgttcacattgtcttcctctggcaggtccacctggaaagcattatatatttagcaagaaaaaaggaggctgtgaatgatgtcactgcggactgcgtatattccctgttgcaaatgtcagatccatgaagcataaagtgattaactagaagatattaaattccttacaaattgttgaaaagccttaaagaacaggctccagtcaaagcctctagaacaattccaagaatcatactgctggcacaggctggggaggagctcctactgcttgagacattcaagctgtcttttgcagcagaaaagagaccagctcttctcactactgcccccaggaggacagcagctctgctatcaactctcaactgctggaaatctgacccctttctctgactgcccatcagatgtgtcactacagagtcgttttggattgagatgagggaggggaaatgtctgatttcactcaaatgtgctcattttcctggtctgggtctcagccaggcagcacagtcctgtgggcacaatatcttcacttgccaggttcctataaaatgagagtatctttcttgactgtggaaaatatggaggcgaggagggtcaagcaatagcaaaaggagtacttggagttgcctgagcttccactctggtttccccaaatgttttcaatccatttaattcatgataataaacacctttctgcctaaccagccataatcgcttttcttagatccaaatgattcagtgataaaagtaaagagaaaaaataaatacacttttcaacgttgaagctgaccaggtgtctgcctctggtgtttacccctccacatcccactatgcatttcatcttccctttgcctcactggagatccaagtgcaagtaatgcttcacatgactgtgatccctagaacttcatcctgatgactgttgaaatcttctctgagttttaccagtggaaatggcaataaatagaaagattccagaaggtcccctagggtccatattttctgtacttcctctctaaaatatgtaaaatcagttatttttgctcttgctttatatgggctagatctatggccccagcacacatctgaatgccctgtgttgacaacttatccagtattgtattaagtctaaatggtgacatgcttatcatatcatttcttccaatttcttggaataattgtcatgtcaattctttgcattaagaaccatcagccagaaaaccacagccctgagaaaatagaaatagagtatttcaagctgttcagttggcacaagaatgatgaatctgcagctcattttcaagatataaatattctgtttatggaagtaacagcaccattcatgattagtgtttcagagcctccaccacttctgacagcatagcaattcaatagcacaagggtttgtgtgacagctttgcttgactaataatgggtttttccctgtctatagggaaagctgcacctgtgcacatgacaagagcatgagctacattttgcttcactttttttgaggcaaataagttgcttgatccaaagccatattatggaagaacttcctgactctgatgaaaactccttgaaaatccacaaataatattttatgcagaaacataaccgaaaaggaaggcaaatccatatatagtaaaataaccactgccatcctcatgttccatgaggtccactagaatcacctgataccagtaattagtctgagccctgatgtgtggtacaatgttaagggttctggaggggtcagttttcttggcaaattgggtgttcagaagagccagtagccctgtacatctcagttagttgaaagtcatattattgagtctccacagggacctccataacactggttcgtgaggctagctgggaaagctggaagaggtaactgaagtccatatgttgaatcatcctcattattaaaagccccctggtcgttaatggcatttcaattaatattcacttggaaagcttcttattcttgattatggctcatttttgaaacttctagtcatagctcttacagaatgactttgtctgaaatcatcctgttgcatttcttttaaggcctgatgatctgtcaaaaccaacagccaatattattaaactgctgttctctttgcaacgtgatcatcagatgtaggccttgcagtttacccactgttatgagttttacatttccagggcttccttgacaatggcactgatgtgactccatccagcatccattgttgtgagaactctatttggaatatcatcattgtgggcatgaacataatggagacttttataggatgcaatggttaatattcaacattattcaaaatttgctctagccttacccttggagctctactggattggaaaaatattttaggtaaggacaaccatttggtaaagttttaaaaataaaggctacaaataaattttctgtagcaagagtatgaattaggtgtcatcacaaataccattttttttgtgtggaatgtaacaattatttaaatgtatataatttagataatattttataaataaaatatgtatatattgcatatataatagaataaatgtacttaaatatgaatactgtacgtagttgtagccaacattttatcaaataaatatatattcacttctatgtatcttaaatatatatgcacttttttccataaagaaggtaaattttaattttttattgaaatactaattagttttaattttgtgtttttctcttaataacttcataatttgattactaaatattcatatttataccaccaattcaagaaaaaatatgtatgtttatataggtagaggtgtaaatactgtatcaggaagtgtttatgcattaattacggtaactggttaaatgtacaactcagtggctgataacagtaaacatttgttttcatgttcatagatgctcatgttcacaatcatctggctgatcaaggaaggtctctgctgagtggctcctctcagcagagaggagcctgtagattgtattcagcctgtagatatcagttgtttaacgacaaggctgaacagcagtgactacacatgacacaagattcttgtggcaggtcacagtagtgatcaacatcccaaaccaaaccgcacagttgaatttaagtccaataatttctaacatagcttcaaacatttaaaatatattcctttatttcaatgagtataagtttttaagaaaatgtttactccacttaattgtagaggtgtttgatcattccatagacaaataatcatgttttcaaccttcacaatcctgaaaatatttgcaaatgtaagtttgcattaataagaaaacaaagctggatgtgttttcaacatgtggcttcaaatataatttttttaaatgacctttttgggggaaaatcattttaacttatggaaatatccctctttacctctcatgtcctatagggttgcccaataagagggtcccccatgagatttggaagtgagaaaaggaagactcagtattatccattggtacctaagaggcagagagacaaaggtgaggactggagaaacacctggaaagatgctctaggaagcgagaacttcagcaattccagacttaaacttccagacaggactgaggaccacatgggtagaaaacccttacttcaggggtggatacattctgttttcagtgggagcaccaaagaatgctgcttctaatatcaactttcctgaatactatatccttggttttgaaaggttgtagtgtgaatgttaatcataggaattgggtcattcttgtcataccaaacagagccatgaaaccagaggggaaaggcactcagggtgaaaaatattgtttctagaatgcaattgaaataggccctattatgccatggaactaatgtttatggttttttgaataaacatagaaattgacttccccgatcttaaaactcaagatagttacatctgtcttacctgagttcttttttcagtaaaccaaccatcaggcctcccagatactatcaaggagctgaaacttacatatcactgaatcaggacagtgggacatcagacccttcactcattatgactgcataactgacctcctgcttcttgttgaccaaattatctcccttaaccctccataattcctgttttcccacatttcttccgtgctatataaacccctaatttttgttggtcagggagatacatttgagaatggtgtcccatctcctcagctacagcacctgattaaagccttttccttggcaatacttgccttagtgattggctttctgtgtggtgagctgcaggatctacgctgaatccctggtatttcagtaacaaaacactctgcaaccttcactgctttggcttcttgtaacctgaaatcaaatttgtccacaacttctgagataacttgatataattctaggattcactttgtccaccactgcttcccagtctgagcttgccagctcccaacccttcctagtgccaatgaactttctcaaagagccataggtaatattttccctttttcatgaaacactaactttttctttgttcttgccacatattgaagaccactgagttttcctgtatgccccatttgggaaatatttctgtgtaaataaaacattacatttagagattcatctctacattttatttagacgtcagtagtttactttaattctctgtattaagacaattcctgcctagaatatctatagtggcttcttctctgttatataaagtccaactgaagccataaactagactcctcaggtgtcatgatctctgtctgtattaaattaggagaggcattgctatgtctgtgtagttggggctgagaaagagaaaagaattagggtgcagaggtgacttcatgtccccttctaccaacaccatcagagtgtggctgcatctgaggaacaatctcagctgatggaggcatcaggaggagcagctggggcagcccagcctcacacatctgcttccctgggggtttatgttcgggtgtgtaacactgtgggagggtaactattatgctgtagacagtaataagttgcaaaatcttcaggctgcaggctgctgattgtgagagtgaattctgtcccagatccactgccgctgaaccttgatgggaccccactttgcaaactggatgcagcatagatcaggcgcttaggggctttccctggtttctgctgataccagcctaaatcatttctaatgccctgacttgcccggcaagtgatggtgactctgtctcctacagatgcagacagggaggatggagactgggtcatctggatgtcacacctggcacctgagattggaaacataaaaacaaatgtccacacaattaatcatgttgtaagagaatttccctgaacagtaaagcagtactgagcactctgggctgagtaaactgctagtgttctccatccttacctgggaaccagagcagcaggagccccaggagctgagcggggaccctcatgtccatgctgtgtcctgagtgggactgattcctgcatgaagtgtgtccagcctattaataaggcttcagggcaggaggctgtgctctgggaacatgcaaatgagcaggggatggggcaggctgggcgcagctgcagggctggctcatctcagtaactcagcagcagctcagtgtccccaggtgtcccaggtaagatcagggtagcacagatttgtctgcagagaatgggtttctactggagactattttgttacgagagacattttttagattttttttgacaatttgaaatattcctcaggagtcggtggagtatcatatttcattggcgtatggggagtatataggaggatattctttttttgtaggaaacacatagtaaagttttagacgatagaattctaaggtctttaaaagactattgtataattccggttagggaagggggtatttattgtatacttgcaacttttctgtaagtttatcattgttcctttctaaaaaaaattaaaaataaaatatattgacatgatgatgcatatatttgtaagtatatgcagctagagagaaaaaacagatcacctacaaagggaagccatcagactaacagaagacctctcagcagaagagattgggggcctatatttaacattcttaaagaaaataaattccaactaagaatttcatatttggacaaactaagcttcggaagcaaaggagaaataagatccttttcagacaagcaaatgctcaggaaatttgttaccaccagacctgcctaacacaagcttctggaagaagcactaaatatggaaatgaaacaccgttatcagccactataaaaacacactgaagtacacagaccagtgacattataaagcaaccacacaaacaagttggcaaaataacaggctaacagcatgatggtggtatcaaatctaacatatcaatattaaccttgaatgtcaacaggctaaacgccccacttaaaagacacagggtggcaagctggataaagaagcaagaccaaatgttatgctgccttaaggagacccatctcacatgcaatgaagcccatggactcatataaagggatggagaaaaatctaccaagcaaatggaaaacagaaaaaaaccaggattttaattctaattcagatgaaacagactttaagtcaacaaaaatcaaaaagacaaagaagggcattacataacagtaaagggttcaattcaccaagaagatctagttactctaaatctatatgctgccagctcaagatcacctagattcataaagaaagttcttagacactttgaaggagacttagattcccacacaataatagtgggagatttcaacaccccactgacagtattatacagattataatctgtataattaattttctgaggcagaaaattaacaaaggtattcaggacttggactcaaccctggatcaaatggaccttatataaatctgcagaactcttcaccccaaaacaacagaatatacatattctcatcaccacatggcacatatgctaaaattgaccacacaatcggacatacatcaatattcagcaagtgcaaaagaaccaaaatcatgccaacctctctcggaccacagcaaaatgaatgtagaattcaagactaagaaaatcactcaaaaccatggaaattaaacaacatgctcctgaatgacttgggtaaataatgaagttaaggcagaaatcaaaacgttctttgaaatgaatgagaacaaagatacaatataccagaatctctgggacacaggttaggcagtgttaagagggaaatttatagcactaaatgcccacatcagaaagttatacctcagattaacagcctaatatcacaactaaaagaactagagaagcaagggaaaaccaattccaaatctagcagaaaacaagaaataaccaaaatcagagttgaactgaagtagataagacacacaaaaaaattcaaaagatcaatgaagccagtgcctgtttttattttgaaaaagctaatgagataaatagaccactagctagactaataaagaagaaaagggtgagtatccaaatacataaaattagaagtgacaaaaggacattatcactgaccccacagaaatacaactaaccatcagagactactatgaacacctctatgcacaataactagaaaatctagaagaaatagataaattcctggatgcatacaccctcccaagactgaaccagaaagaaattgagtccctgaagtgagcaaaaatgagcttgtaattgaatcagtaataaatagcctaccaaccaaaaaaatcccaggtccaaatggattcacaactgaattaattccgcggatccttctatagtgtcacctaaatgtcgacggccag

SEQ ID NO: 4 - DNA, 149172 bp, Artificial Sequence
  RP11-1134E24
  misc_feature (148933)..(148933): n is a, c, g, or t
  misc_feature (148940)..(148940): n is a, c, g, or t
  misc_feature (148944)..(148944): n is a, c, g, or t
  misc_feature (148947)..(148947): n is a, c, g, or t
  misc_feature (148953)..(148953): n is a, c, g, or t
  misc_feature (148959)..(148959): n is a, c, g, or t
  misc_feature (148961)..(148961): n is a, c, g, or t
  misc_feature (148969)..(148969): n is a, c, g, or t
  misc_feature (148971)..(148971): n is a, c, g, or t
  misc_feature (148979)..(148979): n is a, c, g, or t
  misc_feature (148981)..(148981): n is a, c, g, or t
  misc_feature (148986)..(148986): n is a, c, g, or t
  misc_feature (148990)..(148990): n is a, c, g, or t
  misc_feature (148992)..(148992): n is a, c, g, or t
  misc_feature (149000)..(149000): n is a, c, g, or t
  misc_feature (149003)..(149003): n is a, c, g, or t
  misc_feature (149009)..(149009): n is a, c, g, or t
  misc_feature (149014)..(149014): n is a, c, g, or t
  misc_feature (149020)..(149020): n is a, c, g, or t
  misc_feature (149026)..(149026): n is a, c, g, or t
  misc_feature (149033)..(149033): n is a, c, g, or t
  misc_feature (149039)..(149039): n is a, c, g, or t
  misc_feature (149047)..(149047): n is a, c, g, or t
  misc_feature (149050)..(149050): n is a, c, g, or t
  misc_feature (149063)..(149063): n is a, c, g, or t
  misc_feature (149065)..(149065): n is a, c, g, or t
  misc_feature (149070)..(149070): n is a, c, g, or t
  misc_feature (149072)..(149072): n is a, c, g, or t
  misc_feature (149074)..(149076): n is a, c, g, or t
  misc_feature (149078)..(149078): n is a, c, g, or t
  misc_feature (149082)..(149082): n is a, c, g, or t
  misc_feature (149084)..(149084): n is a, c, g, or t
  misc_feature (149089)..(149089): n is a, c, g, or t
  misc_feature (149093)..(149093): n is a, c, g, or t
  misc_feature (149095)..(149095): n is a, c, g, or t
  misc_feature (149098)..(149098): n is a, c, g, or t
  misc_feature (149100)..(149100): n is a, c, g, or t
  misc_feature (149102)..(149102): n is a, c, g, or t
  misc_feature (149104)..(149104): n is a, c, g, or t
  misc_feature (149106)..(149106): n is a, c, g, or t
  misc_feature (149108)..(149108): n is a, c, g, or t
  misc_feature (149113)..(149113): n is a, c, g, or t
  misc_feature (149115)..(149115): n is a, c, g, or t
  misc_feature (149120)..(149120): n is a, c, g, or t
  misc_feature (149122)..(149122): n is a, c, g, or t
  misc_feature (149124)..(149124): n is a, c, g, or t
  misc_feature (149126)..(149126): n is a, c, g, or t
  misc_feature (149130)..(149130): n is a, c, g, or t
  misc_feature (149133)..(149133): n is a, c, g, or t
  misc_feature (149136)..(149136): n is a, c, g, or t
  misc_feature (149140)..(149140): n is a, c, g, or t
  misc_feature (149148)..(149148): n is a, c, g, or t
  misc_feature (149152)..(149152): n is a, c, g, or t
  misc_feature (149154)..(149154): n is a, c, g, or t
  misc_feature (149158)..(149158): n is a, c, g, or t
  misc_feature (149160)..(149160): n is a, c, g, or t
  misc_feature (149169)..(149169): n is a, c, g, or t
  misc_feature (149172)..(149172): n is a, c, g, or t
ctggccgtcgacatttaggtgacactatagaaggatccgcggaattctacagatattctctcactgagagacaagaataactgacttatccaggctgcaagtctggtgcttgttctatttgatagtctgatgctgtaagttttttgtcacaaactctgaagagtaaagtggaaactttgactttttgcttctgattgcagatttctatccaaagagggagttgagggaaatgcttcctgttgtcctaattacacagtactaagtgaacactggatatggagtcagaagggaaagtagacttgtgagcccatcacatatggagaaaacacttttggttcccattgttggcagggacagggaggcaggccatgttgcctttcacaaaaaaaaaaaaaaaaaaaaaaaattctgctaccatccctgggagctattgttagaaggtcatgttcaacaaactcgcaaagtgttttcttgattgttgtttgtgtcaccattactcaacgttgtgtagaatgtagtcaggtgatattatccccaattttataccgagacttattttaggtggattatatgactcagtcagaatcgcatcaaagcagaaccagaaccaagtttgttttcaactccagtgcttctttccgaagttttatttccattgtcagccacttaactattttaaaacgtatcttttggaatagggatctctcaataggaatccacagcaaagatgaagagaaaactagatcagttgccttggcaattttgtccactcagaccaggacattcagggatttctagattgaatttgtgtttccttctgactacattgttgaaatgatctggatcatctcctaatcttgctcttggactctctaggtgtattctcagtgtctgtgagggagggcatgtgttttaagcagtaaattcctaaaggcctgtggaggcccaaggccatgcacactgagggagttgtggatcaagtggcatgatgggcccagtctatttctggcagagctgttattttagctgttattctctttggccagttatctcccttagagtagtgcctctttaaatgctttttcatttggtgaaatctaaaaatttgtctctaaaaggcatgctgccaggcctcttttcatattaaagtggtcatctccacattgtagatagtaaatcatgttcaaagaaaagaccttaaaaattcttcatattgccttgcagaaatcacagtattttagatgtgttggggagcttcacaatcactcagtttaacccattcatgttacagacagggaaactgaggcctggtgactttcccagttattaacaaggtagtgactgagaagggacttcagttcgctgtttttaatgactgtatagtgagcatctgatgtttggtcttctacagaaagggaacagagttgactaaagtgaaaataccctagttcagacatcagaggcaaaaaaattaatcataatcacaacagcaccttacagttgtggagtcctttatagtttttagactcttagacacagagaaatagagaaatataaatatggaaaataaggtttatttgatattttatgaaatggaaccctaattcaccaacatttttacccctttatagtactgcaataatttgttgtgagactctgaaatcgtttctgaattatcagaggaagaaaatcatttaaaaaaggaaaccagagctactggctctatcttacttcggtcatggtcttttaaaatctattcaatttattttaactagactaattcattcttaaagtaagtcagctaacatggaattttctgaggttacttaaaaaattttggaaatttccttagctctgcatgaagtatttttatctcttcttcttcttttttttctaaagaaatagtgtttgtgggtcttgataactgcccacaacagattttatatcatctggttttgatagagcaagggggtctaatgaatgattgaaactaacatttataaaatctttcaaatttgagaggcaggttcttggaagaaggaggatacaacagaatggcctctgtgtcactggtaggactctgaagacaggacttactgcctatgttccgacatgaagaaacagactagtgaagtatgttgtcaaaactttgagaattgtaaagcaatgttcacatgtaggttgataaaaataacagaagaagttatgttaacctaggtccgaccctaggtgctgtcatgttgtcactaccttcataataagcttcaaagaggtgctctgttattatctttaaaaattacagacgaggaaactaaggtttagacagtgttagtaacttgctcagggccagtcactcaatgtgtggcagagctggattccaagtcagtgctgtctggctctaaagcttagattcttttcattgcacttttattattaaaccaaagaacttatgattaaaatattttctgctttccttgacgatttatttcaagatctaaccatttctttttcctggacattctgagcagggagcactagctctcaacttccctgcctctaccctctggctgggctgcaccttctcctgctgcctgttcctcctgcttcatcagcacacagtgggactatacattagccagggtgttagacaggccctccctggaccttgtcttactttcccccttgtgttatgaggacaagctctgtagtaactacattgagaatcttaggagcaaaggctccccacccccatgggggcacgtcagtgacatttggctcctccattttgcttaagaaacctgtgaccagaccctcaccccaggcccatagtgagaaaagcctgttttcatttcttctttcaccaagcccatctggatagagcaggtgcagggctaggctcttaaaatagaagcccttgtttcatgtgacgtggcacggtggaaactcccttgcttccttgcctgttgatcagattaatgaaatgatgaaggtctctcccctcatcgtggtgttttcttgacttcctgtcattgtcagttgacctttctagtttcttcatttgtaaaatacaggacttgttcttcataacctcaagggtccctcctatctttgataatctgtctccatgcttccgattaggggtcagattttggaatttaccatttctatcttgtttatttctcccagcaatattattccagcaggaatagctgggactaaaacttattcttggttaaagcacatcatctcaccatcttgacatcccatttgctctataccatcaaccatctctgaccctgaaccccagtctccttctttgtaatttaggaataataataccttattcatggtgtgaatcatatgagagagaggatttaacattgcttagcaagtgatacacattaggcattcagacaatgcttgttcacttggggtcaaataataaggtccattttctcttcatgacttctagctattgattagctttgaggctgaaaaataagtttaagatgggccctctgacctcaagaggctagcaatattttatcttctttttaacgctatctcctataggaaggaaagctagcaatattttggataagacaaaataaatacatatgaaacagagaatggattaagtctggaaaatccttccagtgctacacctaggacaaggtaccccatgcagagcaggtaaattcttaaaaggatggtctctgagtcaaattttggagagtgaagtgccagcatagctgatcatcctaagaaaaagtcaagaccgcaagttatgggttccaacagtggagaaaaggctaaggaaattatgcactgttagtaagatagaatgatgtgcaccattcaaaatggtcaatatgatgcataagtagaaaaaaagaagtgctgtgaaacaacagcaagtgaaagaatttgaacacaaaattctagtaatagtgtcaatggctatgtatgaagatactcagataaatgttagaaaagaatataatgtgggaaatgaaaataatagatgtgttagggttatgggtttttggatgaatttcaaaaacattccttttattaggctttcacttcttaagtcaaacattttgaaaaatttcacattgtatgacttggattgcataatataccagttcctgggctaaggttccatctttctctggggcaggatttcctctctggttttcatcgtgatctctgcctttgaatggcttgctttttcttttaagagaaaaaagtatgacaaatccagtaggtgatggaatcctctctcttccatttatatttctgtggatcttccttctcaaattgcctataacttcatattgaatctgaagaaagggagagtttctaggagccctgatataagggctcagggatttgtgctgccatttctttagaaaatgcctgattttcccaagaatgggtcagctctaatggaggtacctattccttcaaggaaaagcagtcaacttagcaaacaggtaattccagaggtgatttacgttttactttggcagatggagccttcattttcaatagaactccctgtgaacttcctttaaaagtgttttgacttttctggaacacatggactccatgcagtgacgtgcccggtaggcagtaatgcatacttagggctggccttccacagcttgagtaggtgggttccctttaaatgaaacaatctgaagagatgcaacacaactgtgacccttggtggtcttccagcttttaatctgattcaggccactcatttcaaccctatgcaagccaatttgacgcaaatgagtccaatctaaccagtccaaaaaatacttgggtgtttgtgccaataaatctaacgatcaaatcattcccccttgaattagaagttaacaagacaggatagctcatactgccctctagtcattcctgccaccattaagaagcctggggctctttcttaccccatgtgccaacttctcagggcctccttgtctaattttgcttgagaatgtagagtagaggaaggagaaatggacagacagcctagagaagtgacttacagtctgggttcagctctaactactaatagtgttgaggacgtcagtcagcttctcgaagtctcagtctccatatttgttaaaataaagagggtagtctggtttttctggccccttctctcctgtcctcctagactatgaattcatttttagctttttaatgcaaatttttgattcattagaatctagcttcttcactctgccacttttagttggctcttcttagagcattagtgcccaatttgcactgttagaattttcccttgtttgtacccttcaaaatttttctttttttgggcaaggattgtatttttttctttttaactggctccttgaggatagatgttgtgatatctgtgtgcttgtatgtcctcaactgtgccctgcactgttagggcccttgtcaaaacaacacatttctcagtgattctgagactctttctcttatctatagaagtcataactcaagagtaaaatcataccaatattttacataaaccctagaatttttatagatctattatttctttttagagtacatattggaagtaacttcacaaggaacattttctttacttttttttttggaaaaaagatttatgcttataaccaaatgaggttgtttggcaaatttgtctggagagacacacacactcagggcaaataggcactcctttcctgggcaactcaattacctcttgcctctggtcaaaccactccacaaataaagtggactgatcctcttgactctatgtgtaagtgcccattgtgtgtgcacagagctggtgagaacggccatggtgctaggtgggggtggtgttggtggagttggactagattatctgggatcatgcgaaatggaaattcatttctagctggctggcttcagaaggtgccatctcctatttttatatgaagcgtgctttggaactcagggcaacgaagggtgggtgtgctgcacaaggacagcagaagagtgagctgactggtccctgaaatcgcagttggaaagtggattaccagtgcagtagaactcttcacggaggcctggaccatcaggtctaatggtgttgttccaggtgggtggtcatgtggagcaaaaatatttgaaatcagcgagcacgtacctgagagatgacttttccacttgggctagtctcttgatatttctggtcctgtttcttcatctgtaaactgggttagtaatgtcacactctgtgagttggtgcatccagataacaaacaaacaaacccacacacagaaaaacaatccccataaatgccctataaacttatattaatcatcaacaattcatttatttgttcactcacttatttattcaacaaatactcgtatgaccaaagcactgtgctttgtgctaagctctacaataaatatagaattgtataaagatcaaggagtaaaaatcctagttcaggtcctcaataaatgataggtgaatcatagactgaaacgtggaagtaaagtaaggaggtcttccacgactattgtgatcttcaaatgttcttttgggtgcagagtttccccgggaaactgccagtttctataatggacaaaagactttgcttttcaggagtatatattttgataggaaataaagatagaaatacttggaacttagacaaattaaatacataaatgatggatagtatgtagggaatacagtactgtggggaatcaaagagagggtgaattctgggtgaaatcaggagggtttctcattattcacagatgatctcttacaggaggtgggaatttttaggtcagctggaaatggaaccaggctttcatgttcagatatacttgcagataaacaactcataagaattataagactaacagcttcgttagtttacatttgacaatttatttgtgcctcattattttgggatgtgtcaagaatctgataacatgggtgataatgctatttgccactgtaatatcaggtagtcctagtgaaaatgcaacttttaagaacttgtttaattgtatctaccaactcttactgcagaatgtagacttgaaagaagcacattcctttttcttacataatcattaggggttactacatttctgagcaacaaggctcaagagtttccaatggaaatgtaatttcaattagaaaaccaaattgaggttgagggtggagagagccagctgcagaaggtatctggacagcagcatgtatctgcaggcctgcgtgtgtgccagggtgggggcaaggaggggtagattgtgtcattttccacatatgtttatttagcttctcctgtttcagggactttgggttttattaatagtcaatttaggatattgtgcctccatcctcaagcattgtcaatcttaaaaggatgggtgggagtggtaggcattaagcctcagaatcttctagccctttggctggagtggttctgtctgctattgctgcaacctgaggaaatctttcaaattctgggtgggctgctctggttaatatagtggagactctaacaaaaattatgtcatccagcaatagagctctggtgcagtgagtggcagactaactgatgaacatctcaatgcacagcaattctcagcagccctcagccagggcactcctagggagggcctctggttacaatgctcttcagagcctgcccagtctgtctctgtttctctgtcttttctttcctttctcattattcccatcactattattgtttctctttctctaaggtctgtatattatcctttcccctagttctttgaaaaatttacttcagttgcacacacaatagaattaaatgataaacatcaattttctaaataaaatgctgtgtacacccacactcacacccacagagtattttctatttcttaacaacaacaagaaaaacaacaaaatgcatagtaagaattaaaaaatctggaggaatattgaaggccagggcagattatttgtttagattagtgatccttaacccagaatttcctcacatctagattattgtctggtggatgacaaaggaaaatatatattggaaacccagttgtggatccttgagaatacagtagaaagaacagtgaaaattgaaagggaaaaggtgagaaaaccttcttattcatgtccaggaacagaattgggcttgaatttggtggctgcagctctgaacggactcaaagtgagtgtctgtaaatcctgctcagcaacacgaggacaggggttgccatgtcctcctcttccttatgtaccttccctcatctgcctccctatctctagcacatggaccaggggctcataaatgtctgtaggatggaaaaatctaggaatacatgtggggtcagaagttgtaagagattgggttgaatatattctgattccccaagttgtttttgtctacttattttctttttcttctctgtgatggttctttttttcttgttatttgtatctttgcacaatgaaagacaaaaaaaaaaatagttctagtcactagaggacttcagtaaacatgctatcacttacctgcttatgaaccaagaggttgggaaggcaggtctcagttggcatgtagcccgagaagagtttgtcacatcttagagtctagaacctcctttcccacagagatacaaaacacacagttaactcactggtattttggctgggaagatagctgaatgatagcaccactttaaatcatatagtgatgactgctgctgatgatgcacatttcttttcagtatgaaatattagttttttgggaaatccaatgttcaccctaatcttgcagcattttgtaatttccatcatggcactgagcaggaggcaggatgggctgaagggaaatacactgaactgaactggatccttaggcctgtgggtgagacacagtattggcagatagtgccttcaccttgtggctcagtttcttcaggtttcaaaattgagagacttttttcacttttacatgttaagtaggtaaggatgaacggaaggattgtgatgtattgcatattggaagaaacaaaggtatcaggtcaaaattaagaagggtttatttgtggaattactgcagggagaatatccactgagctcagccattgaactcaagaacctgttagtaattaagaatatgaaaagattgtgaattgagcaccttctctgcaccatgccccgtacaaagtggattatacacaatatttcatttgctgttcacagtgatgttgacatagaggtttattgttattgctttattataaacaagtaaccccaaacaaagaggggataaaaaagtgatagattcccatgtgagagctcactaacccatggtatcccaatcagagggctagagcattggaatgacgtgtgaagacactgttgatgttaggtaattcccaggttggttaatgtttgggcaggaggggtataacttctctggcctccaatatgtgttaggcaccccttctgtgtgcttacgtagagctctgtaggcactcctctcagctccatttctccatgttgcaatttctggttatttgtttatacactactctaggagctccttgaggtagagagttctgtcttgttgactatgttatctgcaaatcttcatagagagccaggtacatggaaatgctaatacatttctatggaattagtgaaggtggacattcatacgtccaggcatatgaacaggtttttctctggagttggtgttgtttggtgtagaagggctgtcaatgagccttatgacttgaggaaggatcaacagatgggtggatagaagtacagatggttatatgcatggatggaaagggaatatggtagaagagaatgcttctgtcatgggctctaggaagtttactgaaatatattctgaaaggttgatatgtatagttcatccttattcttcccagcctctcttttctgagatgaccaaactattcaacataaatggtttcctgctgctcttaaatatttccaggacacttctgggtctcctgaagcacctgcttgctcacagcttcattctcacgtgaagtctgcataggtcctgttaccatatcagaactcttagaggacacttattctgggctgaggttttccaaggtgagaactccaggactggagatggagcagtgcatttaggtgaagtgatatcaaacaaggttggggttggtgttacttcccatcccagtgctggacacagccttggccaggtcctgttgtgaccccaggtgcacggggccttgggaacttctgaaagggtgtggagtgctccacccagccctgttggaggaggatgggagcgaaagcaacagatgtgctcaaggttctgttttcagttccccaaagggtcttctccttgaccaaagcagtgtgacggttgctatgacagttgctatcttggtccctgggactctccctcataaggtagcattactttttttaatcttctcaggcaagtaaccatgaaactctgtaataaccagtctgaggtggggctggttgggggcatgtttgggcctgagtactgggatgtgatggtggaatatgctggggtaccaagaggtacctttgattaatgagttatttttccaaattagaccaacactcctcctagttgtcttaggcttgatgactctccatttctgcagaagttcagaattcttcccttgagatgtctgcaattagttcattgttgcaaattataaaaacataacaggtagaaagaacactgaccttgaatctcaaatctgtctctaccaggtcatgtcattcagtctctgcttgggtcttctcatgtgttaaatgagagctttgatttccaagctccttttcactctgagagtcactgatgttttgcctctgaaaatggcaaccatgaagagtagttactgagaaaccagcactgtgttttagagttagggctcttgatcaggctgcctcattttgaatcctgatttgggaatttctgatgatgtgatcttggacatggtattgactttctctaagtcttagtttttttttttttttttatctgcaaaagagggtaaaacaagctaccccagaggctgctggaagattcagtgacatgttgcttgtcagtgttgagacattgtatccattacaactatcatagaataaaaacctgttacaagttggcatgggccgagctgccagcaatttcatacatctcttttatgcctattttgtttttcattttgatcatcaatattttaatggtgtgtcataaattgggggctctttcttatttgttcttggacccatggtgaaataaaagcttgtatatttttttagaaggattcatagagatgaaaggcccttactgaacattcagtctgaccttattagttttaaaggagctgactgagacctaactgttattattacaaactgatattattggaaaccaacacagaacctaccatgtgcaaaactgtgggaaaggcttggaagtctgggtttgacaacctgagtttaaatagtgattctttgtcttactagctccgtaatcccaaacacgtaatgcaatctttcttagtctgtttcttcatctatgagacagggctaatgagaaacatctcagtgtatggtatgacagcaaagggggtcatacaggtgacagtgctagcaaatgtcagtcccctcctcttctctacctcccaactcccttgaccctctcctctgtcatcccttttctggctgcgtgcagagaatcttgctagctttagggatacaaaaggttccagagttgggagacagactgttctcatacagagatcaataaccacatgatatgggtagtaagggccattcagatcctgagaagagtttggcaggtcaatggagggtggaaaggatgagaggaactggggagagagacagagaagagggaaggaaaaggaagggagaaaagaggacattgtgtatctgagaacaggaaaggagcaagtggaatggaagaaggagagggaaggcagcaggtgagggcatgtctgttggggtgtttatggagggttttttcagggaaagggtctgcaaatggagccaacaagaaaggaactggcaggtggtcaggatgtcctcctgtgagagtcactcttctccccatcctctctcctcttagcttcaccctcgctagaacttttccttgctcatttcaattttcaagattttcccaagcttctaaacctacaaaatctaagcgacacacatttactggagaaatcacaaacagatcccagccctcctgtggacctctctgcatctgtgccctggatacctctttctcctttgtttctgtggatgaaacatctgtgttcctagctgaggatgatacctctacctgtcttcacccacccttctcacctactcaggaacattgctccagcaatttctcttctctcctcttcagcaccagcttttccctttctaccaaatcattcttatcagcacttaaaaatgctgtcgtttctctccatttaaaataaaccctcacctgtgtatcatgtagaactatcaataagaaaaatattaaaaaataagaaaataaagaaaaaagataaaatatatcctctgtagagcccctttgtccttccagtgaccacctcatttctctccttccctcttctaattctctccttgaaagcattgtccatgcatgctctctccaatttcttcgctctcattctcttttgaacccatttggatcagacttttgcccctggcattctatagaaactgcacttgtctagttcaccagtgattcccaatatggctaaatccaatggcccatttccattcctaatcttggttgacttgtcatcagcaattgacacagttgatccattttttcctctttgtaacatttttcctcttggatcctaggataacaacactgtcctgtttttttcatctccttctctagccagtctatttcaatcttcttttctggttcctcctcatcttgctgacttctttacgttggagtgcctcctggctcagtgcttggatttcttttttggtatgtcgttgctaggtactctctcccagtctgatggctttttacaccatgtgtgtggtgatgacatcacgtttgtgtctccagcactgacctcttgcttctgaattctagactcttatagccagttgtccatctgacatctccactttgttgtctaatagacatctcagactcaacgtacccaaaacagagctcctaaagcttcaggaatcgagactgtgtctattgacataaggataataaaattgattaggggaattaaataaaatagaaatagaccaaacttacattgtcatttgatttccaacaaaagcaccaaagcaatctaatgggaaagaaaagtctttacacgaatagtgctggaattttcagcagctcatgaaatgtatatatattttatgaaaaaaagtaaaaataaaagtaaaaaatggtgctggaacagctgcacatccacatggaaaaaatgaaccttgacccttacctcatgctatacacaaaaattaattccaggtgaattaaagttgagctcccaaacctatgcctatgttctatagacttcttcatttcagttaaggcaactctatccttccaattcatcaggctgaaaaccctggattcccccttcagttttctctcttccccacatcaacactagcagtgcttcctggcagggctactttcaaagtagcttcatctcctgcttggattatgtaacaggctcccaactggggtttccacacatcttcctatcccaccctggatgggttattctcatcagatcacccagagaaatcctgtttatgtatgtcagatgatattattattatttttattatttttgagacagggtctcactctgtctctcaggctgcagtacagtagcacgatcacagcttactgcagcctccacctccctgggctccctacctcagcctcccaagtagctaggactacaggcacacaccaccacgcctggctaattgtttgtataatattttttgtagagacagggtttccccatgttgcctagtctggtctcaaactccacccacctcagcctccctaagtgctgggattactggcgtgagccaccgtctccggcctcaatattattattttgctcaaagcctaccagcctcatctcacttaaaagaaatgcttcctgtgacccacaaaacccgacatgacctgccctccctataaccctgtgtcatgagcactccgggcacatgcccacctcagggctttttatttgcagttcctgctgtgctcttacctatttatccacatggtttacttcccacttcatttaaatctttacctgaatgctaccttcttagtgacacctttcctgatgaccctgtcaaaacttataaccctcctccaacaattcctgcccttgctttaatgctctgtttaccccgtcgttatctaaaatactatattttaaaatttatcaatctttatcatttatctccccagctagactataagcttcacaaaggcagggagttttacctgtgtgatagcctcaggatcaaagacagtacctggcacatttcaggcattcaatacatacttactgaatgaaagaataaagtgtggccaggcgcggtggctcacacctgtaatcccagcactttgggagactgaggtgggtggatcatctgtggtcaggagtttgaggccagcctgacgaacatggtgaaaccctgtctccactaaaaatacaaaattaaccgggcatagtggcacatgcttgtaatcccagctactcaggaggctgaggcaggagaatcacttgaacctgggaggcagaggttgcagtgagctgagattgcaccattgcactccagcgtggacaacaagagcaaaactccatctcaaaaaaaaaaaaaaaaaagactaaattgtgattgaggtttacagatgactggtcagtgtttcccatatccccaaactgttttcctgcttgatgctattatttcatggggcaagttcaatttccttatccattgcttgactgtccaattagattggcagagcgttaatggcaaggactgtgtatcttatcttgtactgttctatatcctccactattgctgccattgtgagggggaacaagggagtggcttccctccatccagttccctacatcatatgtcatatcatacaaatatattagtatttataaatatattaggtctacctccttctctgtgcaaaatatgtcatatcaatgtctgagttctagtatgttcatattcttgggcaattatgtaattatggcttatgttgtcataacttctatgcccgtatttataagaaaaaaatattgagagcatttccaggaaaataattgactggaagaagagagagtggtaaaaaggaattaatagtgagctaactatcagtatatacaagcccagccttctaggatctggataacccgaagcaagaatttctctgtcagttttctcatctgtataatggtgagagtgggggtgttgaagtagaaaaatcctttgattaatatttattctaatccttgactaggtgctcagtgttagtccagggaactctatcttatttcttcatgggccagcttaatgtcaagatccaaaactcttgtgtaaagcttgggaccattttcaaggatacatttagtagtttacaataatctagataacactgactgatagaaatatgcaggaaatacagaaaattataatgtgatccacatatataatttagaagttttcactagccatgttataaaagtaaaaagaaatctgtgcaatcaattttaataatatttttgtttgcacacaagatatacagggtaatctcaacatgtaatcatataaaatattaatattttacacgtattttttgtacaaaatgttaaaaattggatgtgtttttacacgtatagcccatcttagtatggactggccttatctccagagctcaataactctgtgtggctagtggcaggatattggatatcaagtctagaacatacgtgaattaattcaaggttcaagcacattaaggctgaaagagttatgactgaagaacaagttcaaggaggaaatcaaacaatagccaaatttcactgagctactccttccattactaatgataacaaatatttatagatcccttagtatatactaggcctgatgcttagaactttatatgaactgtttcatttaatcctcacagcaatcttacaagtaagacctccaccccctttcagatgagaaaactgaagcacaaaagtgcagtaacttgctattatgacttgtgagcatattttcccaggcaattatatgcacagtatgatgtaggtaaagcagcccaataatttattcactatatttctccatgctcatggtaaggactgacttgatccctggtggtcacccacttgtgctccctcagtgagggaagggctgcagagcccctggcccgtgtcctagtgactcaggcttgggatctccagcagctgctatggttgacaatttagtttagtaaaatgttagatcctaccctgataactgttataaaaaatcctccttccccttccccagcacaggtacccagcccaaggggcactttctatggaaagatgaaaagaactgacatggacttgagctcactgggggtgcaggtttcaagaaagaacaaagagagctgttaggttgaagagacgcagttgaagagttaagtcttggaattgttaatacctggaacaaggcacggtgtgaaaagacaaagaaacacacaaacatcaatctgtcctcctcttttctctttctgtttcatttcttatcctccatcagtcagactttgcttcctctttctcctccttcacctcctcctccctgcccttcccaatttctttctatcttccatttattgttcttccaaaattcgtatactcatcctctcttctccctttctcttttctccaaaataatatgttcaacttactgacttgctcagggacttgtgggggcgaatgtattagcaccaaacctaggaaacatggcgaattctaaaaacttgttctcatagaaaaaagagttaaaaatagaaagctacagtccagttttgaagccacagaagacctcactctgatgtatagacattagagtcagaaaaagactttgaaaagaccagtgaagctccttgtcccacagacagtgtgagggagggacaaggggaattgtgtgcccaagcgtacttgggatggtgtaggtggctgataagagtgtcagtggaggtggtggttagcatttggagtgccccaatcttgtgacactaaacatttattgttatactaaccccactgccaactaccaggaagttttcatttttcttactgtgtcttagtctccatggcatctataaactgttttcccccaatgtccaggcatcattcctctcccacagttgatgtctggctctgtgccatgggtgtgggcctgcctcttctctctcagaatgactgctgtttcatgcttggtgagccacgcagtatgccaagctgctgtctctgacctggagaaaggatacccatcctaccacaggtggggcatatcatgggatggccttcctggttttccttggcagacacatttttctcacttttttttttctctcctcccttctctttttccctccctctttgatttcttctcttttccttttctttctcttgcctcacttctgccctagatctaccatgggacccagggagctttggagccatgcaacccacagtgtgctaagctttttactcatgctatttcttttaatcttcacaattctttacctatcaggcattaccatcagatctgcaccttacaggtgagaaagggaggcccacaccgattaagaaatgtgctcagggccacacagcctgtacatgtcagagtaagggcattctcatgccaaggttcattttcagagccaaaagcataccacgtctcaggagaagcaggctagatctcttgtctgcttggcttttaactcatgctgacctgaactttctggatttgagtaactctcagacctgtggagcccgatttctgtgagtggattttgccagccacctggggaggtgaacccttgctggggtatggctcatcagtgtagaagggagttccttcagaggtacgctgtcttctcggccatccccattgtagtagtttcttgggtctgccctaacaaagtaccacaaactaagagccgtaaaacaacagaagtttattctgtcataggtctggagacagaaatctgaattcaaggcacaggcagagttagtgtcttctgcaggttctcggggagaaaccatcccacacctctccagcttctggtggctcccagcaatccttggtgctctttggctctcagctgcatccctctggtctctgcctccttggtcatgtggctttcttcctatgtgtcactgcatctccaatctccttcttcttataaggacaccagtcattggatttagggcccactcggatccagcataaaaaaaaagtttaaaaaaattatttggaaataattatagattcacagaaagtagcaaagacaggatataaagcacagaggtctgatgtgtcctgcacccagtttctcctgttggttacttcttacgtaattacagtacgatattaaaaccaagaatttgacattgataaaataagtgtgtacagttctatgtcattttatcacatgtctagatgcctgcaactaccactgcaatcaagatacagatttatcccatgatcacaaagatctccctttatagtttcgcctactcttctttctccaccaccctaacccctggcaaccagaatctgttctctatccctataattttgtcacttcaacaatgttacataaaaggaatcacatggtatgtgaccctttcagattggcttttttcactcagtagaaagtccttcagaatcactccagttctctgtatcaacacttcgttcctttttattgcctcatagcattctatggcatggatatattacaatttgttaggctagttgcctattgagggatgggttggctctttctagctttggctacaacaaataaagctgctgtgaacaatcatgtatgggttctgtgtggacataagtttttatttcctgggggtaaattcccaaggagtacaattcctgggtcatatggtaggtgtcttttgtttagtttttcaagaaactgacaactattttctagagtagctatacccttttatattcccaccagcaatatatgaatgatccattttcaccgcatcctcacaaacatttcagtatgacctaattttgacttgattacctctgcaaagaccctatttccaaataaagtcacatttatgtgacccatttatgagtaccaagagcaaggagttgagcatacctttttgaaggacacaattccacctgcagcacctgtcttcacttgcttaggttatgggtgggtttcccttcagagtgttatcttctgagaagaaggtttgaattcatagctggattatgcctgcctttgattgttcaatttggcccccagggatgagtgagcaagttcatgtcattggaagggacattactgagtctcacccctactcaaacctccaaagtttgaaagatttgatactcatcaacattctcaagaggcagaagggcaaggtgcttccttatgtagtttctccatgactgtccttccccactttcccagtactgactggaaagaaaaacaaagcaggacaaagggattgtcagtcatttgagggaagggatgctgtgttagttactcctgaaccccttcagagtgtaggcagagagaggtacttagaaaggtgtgttggatggatgagtagctgagaggggcagggccagagtgccccatagaatgaggaagagtcctcatttacatgtgcccttcccccttcccaaacatgtgagtgttcatacatgggtttccagtgtctgggcaaggttaattctgtcctctgtccccttgctgaaggtctgtttcatttaatttctatgtatgtgtgctcctagctagccaaacagggcacagatgccaggaaaatagcaggcctgttgttttgttgagcaccttgagccctggaaggcagactcattcagggctcaagagggcaggattaggcaggtagctatttgatcccaggcccccccacttaccagctgcgtggtcttgacctattacttattcctcttctatctattaactgggtataagatgttctttatgtgaagttattttgaagcataatgtgtatacagaacagtgcacagatcataactgcacaaccccacacgaggaacagaacattaccaagaccccagaagccccttcttgtcttctcccaggcactaactcgcccacccccagctaagagtaatttccatccaaatttctaactttatttttacctggttttgaactttatatggatgaaaacatacagaacatatcttttgcattgagtttctcttatgtaacattatttttatgagattcatctgtgtgagtaggtatagttgtagcttgttaattctcctcattgggtattctaatgtataaacataccacagtttaataactcattctattgttggacaatcgggctatttccaatttttggcttttgtaaataaagctgctttgaacattcttgcatagttttttggtgggtggggacactcagtcatctagaagtgggattgctgagttatagaatatatttgtctctcagctttatagaacctttgcaacattttaatgaatgtttttaatctcacagtatagtgtggattaaattaggttgtggaaagtactcaatacggcccttggcagacaggagtccctcagtacctgtttaaaaatgtaaataaggcatgacattccattaagtctaagtaccatgatgaacttaaacatttccctattgtttgtttatttaattgcttttattgtgttgttattttatatcatgttgcaatgaatgattctctttatagcaggtttcttcttttgaaaaatttgctttggttgattctcagggaattgaatcaaaggatatatgactgtaagacctgtcacccttaaaaaggactatgagggcttgctgaggaggggaaaacaaggaagcaagtctctcctaccatggcccaggggactgtgaggacagaaggcttgtgggtttgagggaggactgtcttgcagaggatgatagggtaaaatagaatgaaggatgatttttataaatggttatgcgccttaggatgactacatatttagtcccttataagagaaattgagtagttggtaaaacaacagataataattattaaatgaggaaagagagaaaccacaggtgcaaagattcactttatttattcattctcctccaacattagcataattaaagccaaggaggaggaggggggtgaggtgaaagatgagctggaggaccgcaataggggtaggtcccctgtggaaaaagggtcagaggccaaaggatgggagggggtcaggctggaactgaggagcaggtgggggcacttctccctctaacactctcccctgttgaagctctttgtgacgggcgagctcaggccctgatgggtgacttcgcaggcgtagactttgtgtttctcgtagtctgctttgctcagcgtcagggtgctgctgaggctgtaggtgctgtccttgctgtcctgctctgtgacactctcctgggagttacccgattggagggcgttatccaccttccactgtactttggcctctctgggatagaagttattcagcaggcacacaacagaggcagttccagatttcaactgctcatcagatggcgggaagatgaagacagatggtgcagccacagttcctgaggaaagaagcaaacaggatggtgtttaagtaacaaagttctgcccttgggtgtgttgtttgcggataatcacagggcatgttagggacagacagaaaacagcatgcttatcccagataattatagcaaggagaccaagaagcgtatttaaaatcttgatgttttgagtttcttcctagcttccccctattccttaataaagttctaaattgttttgttggagctctttgcagccattctgagggctttgcatgcttttctgaccttgcagtaaactcaatgctttaggcaaagaatggccacgtcatccgaccccctcagagtttagaattcagaacaggtctgaagaagaccaggcagcggctgagtcaaggaaagcctccgtccgcttttatttcccctgtgcctcttccaggactgtgctgggataacaggctcccgggggttactttggctgggctgggctaaaacctccctgcagagcaggccctgagccctgcctctgcgcctgggtggtgtcagcccctccaccttctgactgttccagcaactctctaagccctcccaaaggcctcaaggcctgtaaccatatgcagcaattttcagccataccaggagaggtcaactgtaatcttggccacctgcctaagaggaagtggctagcttcacttctgaccctcagcaactgccaggtggcctcttggaaatccccctctgggggattccacccgttgggtgggagagcagtagttaaaatgtaaaataagaatcttttgctgggagaagtcaacagatagggagaagtcagctgataacagaaatagttttttttttttttaaaactaacttcactgttaaccaagcagttcaacatgaaagactgaatctcttatgtttaatattttcttctcttttaatcttcataactaatttttttcagataattgtataaaataaccatggtagcaaaataatgtgatcactggaaaataagcagggaaaaacatgctatgaagatactcctatctgggtgaattcttgatagctttacatttttcatctggcatttaaacattaaacagttaatgtatttgacatgaaaattatttcaagttatcttattagttttaatagagtttaaaaagtgtttaaaagagttttcaaaaggctctaaaatcattttgaaatagtttaaaacagttttgaatcgttgtaagttagttttaatagagctttaaaaaggccctaaaatagtcctatcaagttgttgcagaccaaaataatctccttaaatatcacttttgagatcagctggggtaaacgacagcaacacaatgacaaatcattaaactattttagagattatgaaattaaaatactcagattaaaattttcctatcacagaattaaggtactggaaaatatgtttaagtttttattaatcacattgctataggtttagatattttgtacaactgaaataaaatcacacactggcagctacatttttgaaagttaaaaacatggtcacgaatatatcttattttaaaatcagttaatataccttaatggtatttaatgccaaattcaaagtgaattgatcaagccctcagtggccaggtcatgggtgtgatttttactctgaaagaattacatatttctttctttttggttgagcttttgttatttaaatacatttgatgagaggatattgaaataattaaatagcactgaaaaaaaaaaaagctttaaattatttacaatcccctaatggaaattttcactaatgagatatcataatgaatgtgaattttatttctgaaatctctaataaatcagtcttctccctggttttcccagctcagcgcccattacgtttctgttctctttcccttagtggcattatttgtatcactgtgcatcaggaaagctggctacggcagcatcaatcgggcagacacagggtggccacggccactagcggcaaggcggctgccccaagagcgcggtggcatggccaccaaagccactcaatcgagaaagaccgcggctctgtctacagctcgcggtgccacggccttcttggcagaataaaaatgtagacaagtaataacagaggataatgaaagaacatactctttaaaatatttcctatttttttcacagacccacggtcattaaaaaatgcaattatttactttttttcatttaaacacatttctttgagattgagcttttgggaataaccacctttccaccattacaataagagataatttcacgtttagtctaatgtacaaattggatttttaaaaaatgagctctatctgtgaagcccttattcctatagaatgtgtctttttgagtttattacttattacagactctaaaaacaacattgctgctgattttcaagtaagctgcctcttctacatagcaaataggtacacttcacttttccctgatttttcttagggcgtgctattgatttttattgttgtctgacaaaataatttatcaaacaaaagggagaaagactaaaaaatgtatttttccacttttctgtatcatgcataatcagcaacaaccaatacaatatttggcaagagtgaacaaaaataaatttacttttgctccttagaaatacaagggttcctttttagttacactttttttttttactttgtgtcattcagtttagagcaatttaatctttttttctccaaatccatttttgaagctgagtttaacttttgcaacccatggcaaatcttaaatgccctcatttaccaatctttaccaaactcctatttaagcctctaaaagtcaatactggccatcagacccaaatttcagaagacaatagtgaaaaattacttacgtttaatctccagtcgtgtcccttggccgaaggtgatccacagtgttaacttaattactttccccttaacaaaaatctcttttcgctgttaatatcactaacctgaccgatgcagagaaaatcttgcaattgagatgcctcacttaactggctagcgcttggctgttccttaagatgaactaattttctatcccttactcatctgactttttgaaagaatctggtactctttggaattgacctgagctaatatctcaaacacaaaaacgctccaaatttaaaaccttataagaaaaagcattaggaaagtgcacttacgtttgatctccaccttggtccctccgccgaaagtgagccacagtgagggatctcaccctttcccctcaacaaaaacctctcttgaagccaatcatatgagataggctgcttgttcagagaaaaatctagctatttcttccccatttcccccatgaatcctattctcctctcaaacccaatgattcgtctatttgctcagctttttaagttcattttctggtgtcctgctatttacttctgggtcaccaggtttattcaaccaaaatatcacaaaacttgcacaaatgatacaatggcactaaaatctcacgaataattgagacagatgtacttacgtttgatatccactttggtcccagggccgaaagtgaatcacagtgattcgtcttaacttttccctttacaaaaacctccctgaaagctcagcaagcctctttcccccaatgaagttattttgatttagaaatcttaaaaattagccacaagctagcgtcctgtggaacaatttcccctcctctgtacctaacctgggaatgaagtttgttagatccctggcatccgactaatgaaaatccacacaaaggaacacaaagtaaactaattagcaacagtgaagaatcagtggaaaaaagtacttacgtttgatctccagcttggtcccctggccaaaactgcacacacaatggttcctcttaacttccctcctatacaaaaactccctttctgacaattgaccaaggctctgtccagaacatgttatgttccccaggacatttctgaagctattacttagacaagttattctcacccaatgactgaatcttgcttgctcttcaaagaaaatgtgcaatcaattctcgagtttgactacagacttatctttatcttttccctgaaggatatcagaggctgattgcagagtcaccttatagatcacttcatagacacagggaacagaagacacagacaactgaggaagcaaagtttaaattctactcacgtttgatttccaccttggtcccttggccgaacgtccaccacagtgagagctctccattgtcttgctgaacaaaaacccttctcaccaaaggggaacagagtcctgggtcagctgctgaagctcaactcccttttcgagcaggtgtggaaaccctgaggcttctctgacatagcatgtgtttattttcttaggtgagacctaaaatccaagaagagaatatatttacgtctatggcctgatggttcctttctttagcaacttgccacatctggactgcttattatttatttattttttagaaagtagactgaatgttaattacaaagaaaaacaagcaattaaaaaaaatggccagtttttttgtactttcttttggggtgggctgggggggcttttgcaaaggataaacttcatttagtgtaattatggaaatcatcagcttctcaatgagtaataattacaggttgtcttactattttatcttctcctttgctgcaatgttatttaaaaaaaggtagactaaatatatatcaacttaaggctcataactttgaaatgcattttgaaatgtagctccagatggtatacgaaaccaaagtgaagactaatagagtagaaaagtagactttacttggttggtttgtctgttttcacagcacaggaagagctcagctcttactgagctggaccaggcgcatgccatctttggagctgccatggagtcccagtgttccatagtgtttccatagtaatctcatcaacaacactgaagaccttttcagtattttcttttgagtccagctccatttttgcagccttgtatctctcttaaccttccatctccaccccttccatacattactcccacctccctacactccttagagtttttctatggcctccagctttcacaagcactccctctgcttgggaacatctttgtccacctgggttagcttgtgaactgctaattgtctttcaaaattcaactgaagagagaccttctctcagattagccctgagcaggtgacctgaatttacagagtacagagacaggtcactgggcctagagtacctaattattttttattttatttatttattttttttgagacggagtctcgctctgtcgcccaggctggagtgcagtggtgcgatcttggctcactgcaagctccgcctcccgggttcacaccattctcctgcctcagcctcccgactagctgggactaaaggcgcccgccaccacgcctcgctaattttttgtatttttagtagagacggggtttcaccgtgttagccaggatggtctcgatctcctgacctcgtgatccgcccacctcggcctcccaaagtgctgggattacaggcgtgagccaccgcgcccagccgagtgcctgtttatttttacctgctttcagattctcttctacccttctaaattataagctgtttgatgttttatttgccctgtatttgggaggctccgtccagtatctttacttagcaaatgcttaacaaacattttcagaataaataaaaaaaaatacctaattgaaagtcaataatagatcagagatgctatcatagaccaaagactaatactgactgccacaacagtaacttttacaacagaaatcataactacaattctaaagattaggggtaggtttatttgattctgtcactggcagctttgctagttgccttgaatagcagaattagcatttggtctcaccagaagatgaggaaggagagggatcaagttagaggtggagagttaacattggcaagtgaaatttaatgtgcaaaatagctgaccaagggcatagtccttttttaaaggggacacaaagtgattttctctgcagacatacacgcaataccaatcataaagggtgacatttattgagcacttactaagtgccagacattgtacatggatcatcacatttaattattcccaagactctatgaactaggaactaatattatcccctactttgtaggtgcaaaaacttgagggcagagaggtcaaggaactggcttatggcagtaagtggcagagctgtgacctaaactcagatcccatgtttttaactgaactatatgcagattatactccaggagtaaagtcactcaacggaagcaacaagcgtgacagggaatgctgggatgggggaaggtaaaaggaactccttagactgggataagtgtgtacagacgtatgtataagactacacatggaaatattgtttaaagagtgaaaaataactaaaatcctcattaataggagtttggttaaactgtgctagagctttacaatgtagcacaaagcagacattaaggggaagacgtagacttctatatagttacgtggaaggtgtttgtgaaaatgcaggtcactgaagagtatgtgtggtgagatatcatgatcccatctacattgaatatatatgtatataaatacgggctgaattttaaaagacataaattgtgcttggtagttatctcctgggattgcagaggaggaacaatgacactttatgccatctcctcctactcttctgtatggtgatgtgaatatattcattttatagtttttagaaataataaaactgtactaattttgaaaaacagtaaactctgacattgcctattagcattctcgatattcctgtgcaatgcataaacataactttttaaaagatatgtacacacatgtgtgagttttctttgtcaaatacttttctataatctttaaatcaagcatgccaaaaaggtaaaagctttcctgtttcagtgtaggagatagtcgtctgcaaaggaaagagatgtaggggatagaaacaggaatgaaaaagatgactgagctgttcgagggacttatgttcctaagtgagctaattggaaatctaatatgaacagtgcaaccgaataactattgtaaagcagtatttgtaaacaataaaagatgattatcataagtaccattgttgcaaaaactattttattgatcacatgcagtggtgatctgtaggaatgattgttgtgatgtttgctgtaacataaaatgaaacatgggaagtggctgagatctttaggatgtgtgtggttcattttttgaaagcaaatgttgtctcagaagcatctgtgagactctgccaggatccaccgttctacaaaatatctgtgatggacattgataagattgatctgttgaggaaaggcaaggtgtcagtaagatagtctgagagcttcttggatttcatgtaaaagagtgctggaaatagaatttcttggggaacattccaactaactcatcactgaaggtgctttacattgaaccctcagcaaagttagattatcagaaaaaaaatataaactgctgtggaggggacaggaaggaaagtcagggagggaggggggcaaggagagaaagagcgagagagaggagagaaagagagagagagaggagagagagagcacaagtacacacttcaatgcacatctataaatcatcctgaaaactactgataaattattttagcaatgttcctcagatgtaacatttcaagaaatatcatttttgctttttatttggcataatttactagccaatttaggaagttcccctcacatcagtaacatacagtacatcacccagtatgtcagaggacacaatggcataagtttgccttttgcaaggtttgagggatggccatttccctacctgactcaggaaagtctgtagctgatatccatcttcaagtttgtggttctttctctctatatatatatttgagctcagcagtcatgctggagtccagagtaggtgattctttctgctttagcttgactcctccttaagattgtaactctctcagttttacattttttgtcagacgtaagctgacattccacaaggagaggaggaaattctgtggttcacatccagtggtgcttggaacctgattggttgtcattcttccagctagtttgtcacgagtggatatctgtcctggattcccaaggatcaaggctgccccattagccaggaagtagggagatagaggaggtcacttgagaaagagctgcttctttgccgcctccaggttgtgtctgtttcctctcatatctgaagacagatgtgctggcagaagcaaagtcctttgtccggccacgtgcaaatgcatgggacataaatatgaacagagattcttgtcccactctagaaaatgtagatgttcatcttgtttccaaggggacagtaaggctgcaggtgttttttgacttccttgagagaaagagaagatagcagcaattgtatcagggcttactatcctaggaggggttcagccaccgagatttacatattcagtgctgtggtttttgtttcattttgcaagaggaacgagcccctcaagctctgtcttagagttccctgccctccctgtctacctacttggcacccagcccctatgttctcttctcgtattaaggcatagaaatcatgggcaactactgttcaggctggctctggatgaagttgtgaaatcgatgagttggggcttagttttgcagacccccaaatgccctgataatcctggctcgaaggggtgtccagcccctccacacctgtgggtatttctcgtcaggtgggacgagagactgagaaaagaaataagacacagagacaaagtatagagaaggaacagtgggcccaagggaccgtcactcagcatacggaggacccgcgctggcaccggtctctgagttccctcagtatttattgattactattttcactacctcagcaaggggaatgcggcaggagaacagggtgatagtagggagaaggtcagcaagaaaacatgtgagcaaaggaatctgtgtcacaagtaaattcaagggaaggtactatgcctggatgtgcacgtaggccagatttatgcttctctcacccaaacatctcagtgtagtaaagaacaacagagcagcattgccgccagcatatctcgcctccagccacagagcggttttctcctatctcagaatagaacgaatgtacaatcaggttttacactgagacatgccgttcccaggggcatgcaggagacagagggcttcctcttatctcaaccgcaagaggccttcctcttttactaatcctcctcagcgcagacccttcacgggtgtcaggctgggggacggtcagatctttcccatcccgcaaggccatatctcaggctgtctcagtggggagaaaccttggacaatacccagttttcctgggcagaggtccctgcggctttccgcagtgcactgtgcccctagttaatcgagaatggagaatggcgatgacttttaccaagcatactgcctgtaaacatgttgttaacaaggcacattctgcacagccctagatcccttaaatcttgattccatacaacacatgtttctgtgagcacaaggttggggctaaagttacagattaacagcatctcaaggcaaaacaattgttcaggatacagatcaaaatggagtttcttatgtcttccttttctacatagacaaagtaacagtctgatctctcttttccctatcctggctgaggctagagctccaagtctaagaaggaggataggaggcggacaggccaatggaaacaatgaatgaacaacagatggaaacaaggaatagtgtggatttttgagttcattagcgcgtcctccactctttcaaaacctcctttgcaatgacagaagaaatataaaaatgataatgaatttatttcgtggttggagaatcatgagaggtcctattagaagaaaaaactttgaagaacaccacagagatttaaaccatgtcattgaattcatagagaaactggaatttagaaacattttttccattgcaaaaacaggaggcgtccttgaagcagccagttctagttttccccacagagccccagaaaagccgtacttcagagctatcgggctgggaatggtgataggtggacagtggagagtggaataacacctgggtcatctctctgctggttacagacagcttggccctcatgcttcaggccgtgggaatagagattgaaagaaaaagggggcaagttaataggcattcaatagtaatgggatttaaaaaaccctcccaaaccactagaaggaaaagaaatagacaaaaataataaaccaatccagcaaagtttaggaaaagtgaataaaaaattgaggtaagcacgatacataaaagtacaaattaagtttgaaggaccaagtcaaaatatacagtcacaaactattgtgaatgttaaattatttaaaactttaaataatttatctaaaaataaaaataaaccaaaaagatgactatgtatgttttcaaggatatttgattcactagagaaacagttcatttgcttcctatttatgatgattaaaaactagattgcaaaagttagatgttaatgtaaagaaaactttatgaaaatgataatggatttttatctagtagaaaagataaccccaatgcttatggttttattgctctgtaggacattaacaagttgtgcatcttatttagcaaacttattctaacattagtagatgtgagtgtgtgtgtgtgcgtgtgtgtgtgtgtacgtatacatataggtgtgtgcaggtatgtgtatatgtatgtatgtaggtatatatgtatatactagcaaatgataaagttggttcaaaggacgatgtacagtagtacctccttatccacaattttgctttctggggtttcagttacctgtaggcaactgtagtctgaaaatattaaaaagaaatttctagaaataagaatttactcattttaaattgtgtgccttagtagcgtgatgacatatcatgcccttccgctccataccagcctgggactgaatcatccctttgtccagcgtctccatgctgtctacacttaccctcctgtttagatgcttagtagccctcttggtcatcagattgactgtcatgatatcctagtgtttgtgctcaagtaactcttattttactgaattgttctattttattactagttattgttgttaacctcttactgtgactaattaatgcattttatcataggtaagtgtgtataggaaaaaacatagcatatgtagggttgtgcaatagcatccactggggggagaattttgctgaagttagaacagagaagactgtccagaagaaagaattttctatacttgccaccttttttctgtttggtgtcctcatgtaagtctcagtgttacgatctgtctccccacctcaatcactgccctctgtctctggaaggaaattccccttgggctgaggccagcatggtgccagacaggagagatccagtacccactctggaaaatttcataagataactggttctccaccttcttcagggaccttttatcatatctcatgtgcccatggcatttgtcactgccatctgcacaacactgaactccagcaacatcaactgagaagaaagagagagagagggagaaagagaaagagagagagagaaaagtcgtttgttgattgagccacacaaaattttttttctaattaaattatatatccaggtagctgcaatatgctacaatcccaaatacacatatttattaaatatgattcaaagagcattcattgagtactctgtatcaaggcacaatgtaaaataagtgcaaaattactggtgattgttacgcctttctgtgggactcgactctctctggttggaggtactgtgtgggagcacgtgagctccaatcaggtggtctggagggagcaaaatgcagctgttggaggttaaatatgaagggaaatagcagtaggcatcggatagcatagaatgaaaataaaagtgcatatacttccagtgcctgttttacagattccttgtctttttttttttttttgaagacggagtctccctctgtcgcccaggctggagtgcaatgctgtgatcttggctcactgcaacctccgccttctgggttcaagcgattctcctgcctcagcctgctgagtagctgagattacaggtgcgcaccatcacgcccggctaatttttgtatttttagtagaggcggtgtttcactatgttggtaaggctggtctcgagctcctgacctcgtgatccacctgcctcagcctcccaaagtgctgggattacaggcatgagccagtgcgcctggcctccttgttttttaaaactagttcaaaccctcaactcataatttgggaaattcaggtcataggatgccctgttatttataaggtatccagcaatgcatggaacagaatatttaacttttaaaaaacttatattaggttgttgcaaaagtaattgctgtcattttctcctttctttttctttttctttctttctttctttctttttctttctttctctttcttcttttctttctttttctttctttctctttctttcctttctttcttttctttctctttcttttctttcctttttctttcttgtctttctctttctttctctttctttttctttctttctctttctttcctttctttcttttctttctttctctttctttcctctttcttttctttcccctttctttctttctttctttcttgtctttctttctttcttctttctttctttttttctttccttcttctttccttcctttcctttccttccttcctccctctctccctcccttccttccttttccttccttccttcccttccattcccttcccttccccttccttccttccctccctccctcccttccttccttctctctctctttctttctttcttcctttctttctttctctttcctttcttctttcgttgttgtgttccagaacgatttagtgttacctacagttcccagagaaagaatcctgtcttgaggggtggctggggcagggctactactctccctgctctgtgctctagtggccaggtggatcagctccagctgccaggtcaaatttcctagggaatggaattctgtctttttaacaagaacaaaataggtgcttagtaaatataagatgccttcagcttttagtatatgcataatcataaatataaatttgtttaaaacctgaactattctgatgttctcactggctagccaaacttaaaatgtgtatttggacttgaatttcccaccaagggtgttactagcttctttactgttgcagctgccttttgttttgtttttgaaagtttaaaaaaatacacaagggggcttttgcttcctgaaagatggagtagaattacttttacctatttctctcaagtaaagtaaaaaccccggacattgtacgtaaagcaaacttatgaagactctggaagctggagagaagaaggcagaccagttaggaacattgggacccaaggagcgacccagcagtgcattccacggggtttctttttgcctcatccattccagacttggttctggagaagtttgtcaacccagaaacaccaacaggcccagaaaaacataaagccctaataaaaagctggctctctctagtcaaaggagaaagaaaggggaagcccagtaaaacaattcttaggcagtaacggctctgctccattcaaacacccaacttctccttcctgagtggcaagagaggaaattcgctgagatgagtttaaatgagatccaaagcctcataacacaatactccaaagtccagatttcaaatgaaaaccacacatcccaacaggaaccaggggaaccaggaaaatctcagctttgatgagacagttaagaggcgctaatactgacatgacagagacgttagaattacctgacaagaatgttaaagctgccatcgtaagaacacatcaaactcaacaccaccatcaatgagtaagatcataaatcaacatttctggaaaactccaaccagcaccagcagaattcgcattcttttcaagtgctcatggaacatataccaaaattgccatatactgggccatgtaacaaacctcaacaaatttaatagaactgaaatcacatgaagtgtgttctctgaccacctggaatcaaactggaaatcgataatagaaaaataatgggaaaaatgccaaacccttggaaacaaaacaacacacttctaaacaatccatgggagatttcaaggaaaataaaagattatatattgaatagaataaaactgaagatgtaacatattataatatcaaggatacagtaaaagcccaaagaaatgaaaacttatcccagaaaaatgaaaacttagcacaaaaacgtatacaatacacaactattcatagtggttttatttgtattaaaaaaaaactggaatcagtcaaaatgtcctacaatagattaatggtaaaacaaactgcggtacatccatcccatggaataattagtaataaaaagtagtgagttgggcacggtggttcatacctacaatccatacctacatacctacagcactttgtgaagtagaggtgggagaatcgcttgacctaggagtttgagaccagcgtaggcaacatagtgagaccatgtctctaaaaaaaatttaaaaaaattagctgtgtgttgtgtcccatgcctgtagtcctagctacttgggaggctgaggcaggaggaagcttgagcccaggagttcgaggctgctagagagagttatgatctcgccactgcactccaccctgtgtgacagagtgagactctgtctctaaaaaaaattaaaaaaaaaatagtgagctgttgatacacatgacttgaatggatctgaggggcattatgctgagtataaaggtcacatattgcatgattccatttacataacgtttttgtcttttcaaaaatattgcaaggggtacttggttgcagggtgtgcgcatttttcaatttacaaattggcctcaaattcgtgtattaagtttcattcccacatttgcaatgataagtcctccatggagtttcctcactctacatcctctccaatacttgatattatcaggctttttaatttttttccactcaaatggtcaatacgttgtattttatttttggtttaaaatacatatttgtgttttctgatcactcatgaggttgaccatttaaaaatgtttattggctattggggtctcatctgttgtgaattgcctgtttttaaggtatgcccacttttttattgagtttcttatttttttcactattgcataggagttttcaatctttcttccctcctcttattctttaataacagaatcccaatttttttacagggcaacagtgtcccagccaaaaatctaattcctcagcttctttgcagttaggactgttgagacatcatctgaaatctattgtgcatttctggaaaaattttgcttgatggacagaggcaccactgcttatttctcctttgtgttctatcttcttctatctggaacttggcagaagcacccatcttgcaggatgaaagtcacaagctagagtggaggagcaggcagggaaaggacctgggtcctgcagcagctgtctagctctgaaccacctgcctccagagtccgccttggtgagaaaaatgtatctctttatctgatcaagctcctctagttagatttcaactacatatagctgagtgaatactgatgaatactgaataatgaatgctggtacaactttctaatatcttctcttagagttctgcattgaagtttttaaataagtttagtctatacctttcttttccattttcagtcttcaattttgacttcaagataattctagtcctatgatgtgatttatgtttctaaataatggcatttaccctctttcactattccctggaattggaaaaaataggttatttatttatttatttatttatttatttgggtttgggtaaaacttaaccatatgtttaacaggacctggactttgatttaagcaaacttagggtaaaaacagtttaaagacaatcaaggaaattggaatagaaaatgggtattggatattagggaattactctcaattatgctgggaatcataatggaatggtggttgttttttaaaagtccttatcagttggcaacgtattaatgattggctgaaaaatactgccagtgtctgtgtgtgaggaggtgagagaacagagtaattggatgaggggggaggcggtagttgaaacaagattagcaaaatgttaatttgtgaagcttagggttcattatactatttgtgtatattcatatttctataaacactaaaaatgaaaataaagtggtctcgtgttgctgactgtgactgtcacactctgtcagcagatggcagtgttgtataaaccatgagcctacataggcctaatggatcattgtgcttgctaagtaacaaaatcaatgatacgatataaaccaggtcagattttattgcttttagacaaaagggcaaggtaagatttgcagagtaaagaacaggtacagagtaataataaattattttaaaaattctaagtgattcattaaagtcttatagacaagttgggtagaaaagtacgtaaaaaccccataaacctataaacttactagaattataaaatcatttggtctctctctctctctcaaactctccccttatttgcattttaaatcagtattttcatacatatatatttgcaaaaccttattgatttcattgatgaaaatgacttggagtttgctttaaaaccttacacgataaacataaatattattctgtagttctttttacccaacttttaactggcatagtttaatctatgaaaacagctccatattttaaaagattctctaactatgacaacaggcaacatttcatagatgataaaatgtcttatcaactaatacctaatattttaacttaggttatgtacagtagctttaagaaccagttgtagaatttgatatatagaaaataatatagaccctgtcactgggcaaacttatggtggaatcattttttgtgttgttgtggacaaattagttattctttctgaacccctgtttggatatatattttttaaagcccataatttgggcatcctcataaagtagtgacgtctgaaattaaacaatcaatgtaagagagctagtttcctttctcggcaagagaatatgactctaaaatttatgcccaagttagactatttttatcttgcctctttcccctagaatatttgggtttaattaaaaatttacaatgaaattagaaaaataaaaataaaaatcgaaaatcaaatggagataaaataacagtggtaatcaaaatagacccctattttgatctaaaaaagaaaagaaaaaaagataatttggacatcataaaattaaacttctgctcttcacatggcacgttaagaaaataaaaggcgccacacattgggagaacatattcataaaacacaaatgtgagaaaaaaatcatatgcagaatatacaaagaactctcacagtccatagtaacaacaccccaataaaaacttgaccaaaaatttgaaaggatatgtcatcaaagaaggtatatagtgaagttaaaatactaggctcgagcaagtggaaccctcattcactgctgatgggagtgcaaaagagcacagcaactttggaaaacagtttggcagtttcttataaagttcaacatacacctaccagatgactcagcagtcccaaagctaggaatttacccaagtgaaatgaaatcctgagttcacacaaaaacctgcattggaaagcttacagcaactttattcttagcagctaaaaattagaaatgaccaaatggctttaaattgttaactagataaacaatctgtggcatatccacacaatggaatactactcaacaatagacagtgaactagtgctacacgaaacagcaaggatgaatctcaaatgcattctcctaagtgaacaagtgaacaaagccagactcaaaaggcttcacattgcatggctctatttacatgacattcaggaagaggcaaacgattggatcagacaaaaaccagtggttgccaagggctggggtgaaggaaggggcataaaggaactttaaaggatgagggacttgtcctatatcttgaatgtggttgtggttacacagctatgcatttgccaaaacttatagaaatatacacgaaaaggtggcttttattgtaatttatacctcagtaaacctcacttaaaataagcagtttttgattgaacataaaatctggttctgagcttcttggaaaccgactaaatgaagataatgtgttatgttacataactttcatctaggggaaaaatttctagtttctacgtgtgactgaaggttttcctgggataaaagttgaagacaatttctatcttggggcattgcataggagctgctaaatggataatattgggggcactgcatagaaacggcattggataatactctcagtagtaatttcatagagaataaaaaacagaattcgtatgatcttttttttacttgtataaatttaagcaatacaggtgcaattttgctacatagctatactgtgtagtggtgaagtctgggcttttagtgtatctatcgcctgaatcatgtatattgtatccatttagtattttctcatcactcaacctccttccacccttccacccatctcaatctccagtgtttatcataccacactctatgtccatgtgtacacatcatttagctcccacttataagtgagaacatgtgacatttgaccttctgtttttgaattatccacttaagataatggcctccagttccaaccacattgctgcaaaagacatgatttcattcttttctttatagctgaatagtatttcattgtggtatgtgtatacacacacacacacacacacacacaccacgttttctttatccaatcatctgttgatggacatttgggttgattccatatctttgctattgtgaatagtgctgcaataaacaagtgagtgcagatatcttttttatataataatttatttccctttgggtagatacccagttgtggtattgctgaaccacatggtagttctatttctagttctttgagaaatctccatagtgttttccacagaagctgtactagtttacattcccactaataatgtgtaagtattcccttttctctgcatccttgccaacatgttattttttggtgttttaataataggcattctgactgctgtaagataatatctcattgtggttttaacttgcgattctctagtgattagtgatttgagcattttgttttttgtacgcttcttggccatttgtatactgtattagtctgttcttatgctgctaataaagacatacccaagattgggtaatttacaaagaaaaagtggtttaattgactcagttccatatggctggagaggcctcacaatcatggcagaaggcaaaggagaagcaaaggcacatattacatggaggcaggcaagagagtgtgtgcaggggaactcccctttataaaatcatcagatctcataggacttattcagtatcatgagaacagcatgggacaaacctgcccccatgattcaattacctcccaccgggtctctcccatgatatgtggggattattacaatttagggtgagatctgggtggagacacagagccaaaccatatcatataccttcttttgaaaaatgtctattcatgtcctttgcccacttttttggtggggttattttgctgttgttgttgaattgtttgagttccttctaaattctggacattatttccctgtaggatgcatagtttgcaaatattttcacccattctgcagattatctgttcactctattgattatttctcttgctgttcagaagcgttctagtttaattaagtcctgtttgtctatttttgttttggtgcttgtgcttttgatatcttagtcctgagttcttcacctagattaattccagaagcattttccctaggttttcttctagtgtttttgtagttacaggtcttatatgtaagtctttaatctgtcttgagttaacttttgtatttggtgagagatagaggtctagttccattcttctgcatatggcaattcaatttccccagtactgtctattgaaaaggatccatatgactatttcttgtataaatgttgaatgtgaatagagaacatcagatggcaaagctggtatgtggctttaccatctgtaaacagatggtggactgtccatctggtggtctcagagggtggcctcctaggtattcaccttgatgaagttagcagagctgaggccacacttttagacttgtgtgctcacaaacccttggatgcaaattcagagctggatagattcattctattgcaaaccaacatgttgatttattcatctgtgcctagaaatctaaccattctgtaaacttgatgacagcatcctctggccagcatgtttcttcctagttggaggcgtggtgtgtttgatggagcatcaacttagacacagaattagaatcttaactctgcatcttatgaactgggtgtgacattaggtaaattacttaactttccccaagcctcaaatttctcatctgaaatgtggaaataataacgtttctcttataaacttgctgtgaggagtaaataaaatagtgtttatgaattacttagcatagtccctgggcatgtaatttcttagtaagtactaatttttgttggttagatccagttacaggggaagcaaatttacagatatgtggttcatgagcaacagattttctggattattgtcttacacacagtaaccagactgatctttaaaaatcacaaacaagaaacaaatcaaattattcccctgcttaaactctctggaggtttcttattgcacttagaaactcattgtcatgatccctaggccaacacctgtggttcccacccttggctggtgtgcatagaatcttctggagaactttgaaaactactggtgcccaaattgatgcctagagattccgaagagtctggtccatgtggggactgggcactgtgacttttattagctctctagttgtttccagtatgatcttgccctgacccctccctcctgtctgtgtttcttattgggccttctctccttccctgctcctatgactgggacctcccttctaatctttgaatgtgctgagctcttccttcaggaccgaaagcctcttcattactgagccaggtgctaccaccccttctatgtcaagctcacattccatcttcgttatgactctggcctctggtcagaacgtggggtgctctttcccttcaggaagttgggacttggagggctgggacttcaccatcagagtcttttgtgcctggttgtagttggaatctcgtgcattttcatgtagaggttacactgtttgcagggcccatctggtcttcacagtgaagagagaagtcttagctgttcaaaagtcatgttgcttgctattggagcccctgatatgtggcccagattatggtaaggcgagtgagtgaggcattgccttggtcataaattttaaggaggtcccgcaaactcagtagtcaagataaataatattttaatgcaatatttaaacaatcaaaattaatgcaaaaaatccatgatgaaaaaaaaatcagaattcaggtcaattccaggttgatttagtgaataaagagatatcaatagggactgctttatttttttatattttatttacttaatttttttttttttaagatggaagtctcgctctgttgcccaggctggagtgcactggcacaatcttggctcactacaacctccacctcctgggttcaagtgattctcctgcctcagcctcccaagtagctgggattacaactgcctgccacaactcctgaataattttgtatttttaatagggacggggtttcaccatgttggccaggctggtcttgaactcctgagctcaagtaatccacccgccttggcctcccaaagtgctgggattacaggtgtaagccaacacgcccagtcacggactgttttatatttgtggttaagggggatttaagggataatttgagtctgttctgctttcttgggttgtgtttctcaaactggcttatggggatttccagcgatgtaaattttgtgatgaaaatattttatagtaaagcacacatggccatattgtggaaagaaatgccaaaattttatgaaactttaaaataaatcaagctcaactactggagaagctgaggtaggaggatcgcttgagcccgggagttggaggttacagtgagccatgcattcgaaagcagaacagaatcgaattatccctcgaatgcgctacagccacaatataaaacagtcattactgatatctctttattcactagatagatcctgaattgtctcgctctgtctcccaggctggagtgcagtgcgagaccttgtctctaaaacaaataaataaataaatacaaacaaaaacaagctcaagactttgaagaaatgataccccggagctttcagaccagagactcccgagttacacacattttcttctttctgccactaggtggaggcagtggagcaggttgagaatcactgtcataaagcttgtaattaaagaacatcagagtgccagacagtggagctgctataaagtgcagaataactactcctgtcctatacttggtcgcgtatgagcgggaagtgaatggaagggaggctcgaaacaatgggaagagccgtaagaatcaggtctgataaacttacataaacggccttgcacacaacttttctggctgaacctgcacttcccataagtcaaatgcaaatgttggaaggaatatcttgcgaggttctttctagcttgtacagcctgagctattttaaaggagaaaagctgacgagcaatcgtccttggaatttgcagtgcataaacttgaccagcaaagggcagcagtgcacacaccttttaaaaagtaactttccaaattttctactgccatgagagagttctgattctacaaataggagacagtgtttggaccacttaataacaaccaaccataaaagtaaattttctttttattaaaccttttaattttacatttgtaaacagaaaagaaatccttattttgttggctctgggacatcactttcttggttcaactccttcctcctgaccactgcttctaagtctcctgtgctgttttcttctcatctcttcgacctctacttgttgggttacctgccaggtcccagcctgccttcattgatttaactcattgctagtaacctcgccctgtttcccaaatttgcatctccacccggactatttcccgaactccagaatcacgcatattcatccacctgtccaagggatattgccaattagaggtctagcaggcatctcaaatgtctaatatgttcaactctaatccctgattcccgcctgccttccccatctcagaaaatgtccttccaaattctctagttgctcaggttaaacacttgcaaccaccttgatttcacgtttctcccacgcctcacatccaatatgttaacaaattctattttttctacctttgaaacatgaccagaatctgacacttttcaccacagttgccactgagcctcttgactattatcaagaaaggagatgtgttctgttttgtaaagattattaaaagatgttaaattgggactttttttgtatttgttttgtaaggtatctcaaaggccaagaataatataatggatattgtgttctctaatggaacaattcattttctctcctcctccactgcatttttggggatggtggaagtattggaggattttcagaataagaaacaattttattgctgttcaccagatgtcaggagggtatggtgtggtgggcctgggagtggactgtttaaccctagaacttagaaaccagtgtccctgtggagcacaaaccctaataggtcttggtgagtaacagaatagataaaagagagctcagtctggtcataaatcctttggccagttgccattcattgccatgagaaattccccaagaagacacccacctctttttcaggcaattctgtttactagattctggaggattcgttatcatcgaagaaccctgccttctagtcagatggtgcattagtcagaattctttttgcaagtaacataagtcagctgtaacacatacaagtagaaaaggaattagaaaaagaaaagtagttatactaatgtgaaagaaaaaataaacctcaggaccccaaaaatcactaagccaaaagggaaagtcaagctgggaattgcatcaggcaaacctgcctcccattttattcctaaataagatagctacaaagaaaaaaaagctacatacctccctcacaatttgcccacaaggtaattccttgtggacaaagaaaggacagagctcaaagtcatccctctgttcacttcagacaaatgcatatgcaatgcttcttctgccctactgtttcaataagccagactaaggcataaatgactatttctctacctgcctttcacatgtgaaaggctgatcagagactcaaaacaatgcaaccccagcaggaagcccccttccctgccttgagttgtcacacctttccagaccaaagcgatgcacatcttctacatatcgattgatgtttcttgtctccctaaaatgtataacaccaagctgtgccccgacccccttgggcacatatatcaggacctctggagactttatcatgggcttgtccttaatcttgggaaaataaactttctaaattaattgagatctgtctcatactttgagttcacactaggttgttcacaaagacacaaggaaggctatagatccaggatggggctatgcaggtggaaaatgtacctttgatcatgtcaccaaaccagtccagggatacgcccaaaacatgcttggcagcatgaggctgcagtgtgcactgatgacattagtgcttatggacttggtctcactgctagtgagagtcattttcttgattatttttctcaaatttgggtgaggtgaatgtgtagctccacaagatggtgtagagggggcaatgtgaagccatgtaaccttattgaacatctttttggagtgtccattttacttgaatggctcatggaaaaaaattatattaaaatttatacacacataaaaggcacaagttgtagtatttactacgagaagaaaacatgatttaagagataagcttcaaactgcacaaatagcagtaggggagacgaagatagttattcacttccctctgctgcttattgtgaaccatgagaagccccatcttaaagcgtctgaggaagtacatggacttataatagcaaatctatgcatatatcttattttagccttttctgctagactttgggttggagaagtgatgtgagaaggtgtaaagagcacaaaattaggagtcaaaaggcctggttttagcctcagctctgccacgaactaagtgacctgggttaagatatttctatctgtgccctctaagatatttccttacatcaaagaatgcaatagataatttctaaggttctttttggcttttagtctctaggtcattggaatggagacgttaggcgagcattcttctttggagctgtagaacattagtttgatcaccagaaggcacaggatcccatggtgatataggattataggaaatgaacaaaacacagtcttctctcatgcacttctctcacagtcttctctcacttctctctctcttttctgttttgtgtatttatattttccataatagggtaggttataccactgccccaaatctcatggcctagctccaacaaatgcttatatcttgctcatgctacaatcttcaccagggccagaaaggtgctctgctccatgcagccactcaaggatccaggcagacagaggctctaccatcttgtatttgcaccatttggagcacatggcctcttaagttgcttatacagataaaggatagactggaaaattccgtaagatctttttcctgcctcagcctgcaaaggatgtatgtatgcctatttctttggccatagcatttgtaaggagactgggacatataggtgagcaaatggaacatatacaaagtaataatgtctctaagataaatatttacaattcacaaatgtacaaagaattttatagatgcatccataattcacattttgtgtcattatcaccattttctcctaaattacataaaacttattttatttattgacatgtgcttcatatttatcatttatcactgcctgctaattttcatcaggagcatcaatggctattcaatatcctatttatgtaccatagtttataaatgtattgacatttaagtgataatttattatggttttttgctattataacttattgaattgatgaaatgacatacttttattaactgatttttctaatattaatttctagttccatgaggctttccactttggatggtaaaaagggagatagcatttctacttatatgcataaattaattctaggtagtgaattttatttatctgggaataatttttagatatggcaactctcattcattttgacaagaaaaatctaaagctcataaaccctgaatcctatatgcttactctcacaaaaatctctaatgtcctgctgggatttatccacagtttagattagacctggaatacatatggtcatgcaacaatgatcttagaacaggactttaacttggctttaggaactgaggctgagagtaatagaattgatttttttgtgtgtgtgtgaagctcctattataataattagaatactttgattcactcagttaaagttttcccctgatttattgtgtacatacaatgaaggatcaagaaagagaaatttttaaatggaagcattagccagacaagtttgacctcacagttttactaggggatatatcacctagttttggatctatttctaacatcttaacattgtgaaaagagtcttgggaaactggttaaatcccaaagaatgctgcaataggaggttggcccttatgagttatttaatatcttgagctgccttcggaaaatgttgctgagcaggcattgaagagtatcgataaaatttattgagaatttgtttattatgattaacagaggtaaaagccagtatattactgattaatataggtaaaaggcagttaagaaattgggaatgctttctcttctgctttcttctacgatgcacaaggcgtttcacatttatgcccctatgaaaattactaggctgtcctagtcattagatctttcagcagtttgtagttttagagcttctaagttgacttctgtcttttctattcatacaattacacattctgtgatgatatttttggctcttgatttacattgggtactttcacaacccactgctcatgaaatttgcttttgtactcactggttgtttttgcataggcccctccaggccacgaccagctgtttggattttataaacgggccgtttgcattgtgaactgagctacaacaggcaggcaggggcagcaagatggtgttgcagacccaggtcttcatttctctgttgctctggatctctggtgaggaattaaaaagtgccacagtcttttcagagtaatatctgtgtagaaataaaaaaaattaagatatagttggaaataatgactatttccaatatggatccaattatctgctgacttataatactactagaaagcaaatttaaatgacatatttcaattatatctgagacagcgtgtataagtttatgtataatcattgtccattactgactacaggtgcctacggggacatcgtgatgacccagtctccagactccctggctgtgtctctgggcgagagggccaccatcaactgcaagtccagccagagtgttttatacagctccaacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcaatattatagtactcctcccacagtgcttcagcctcgaacacaaacctcctccccatacgctgggccagtaggtctttgctgcagcagctgcttcctctgcacacagcccccaacatgcatgcttcctctgtgtgttggggaggtcactctcttgatttattcgttggagggtttgcagggcccaggattaaattaagagacttgacttttgctggatctctttttgtagaagattattaaagcaaaatgttgtaaagatcccttagagacattgtcaggagtttttgtgttgcaggaacctgcatgtttcacatggacacatcacatgaccgagccaaatagatttatctttactctctagaacagggtccactcagttttacgcacagatgggtcaattctttcctctatgtgcctccttgactctggaaagtttctacttggattcctaattctcttttttctttcttcatctgcaatccttcccaatattaaaccttgatccttcctattcatagcctcccacatagaaggtagtgtccctctgtagctttttccttccagagaccctgtttctttccatcatattaatactttcataggcaattttctaattctttattactctagaaatatgtgacagcatttctcattgccttttacaatagtttgccaactttcttcttatttatcatttttccatttttaattttcatggtatacagtagaaagattatatacacacacacacacacacatatatatatacacatatgtatatatatttatggggtacctgagatgtttagatacaggcatgcaatgtgtaataatcacatcatggagaatggggtctccagccccttaagcatttatcctttgtgttacaaacaatccaattacactcttttagttatttaaaaatgtatagttaagttattattgactaaagtcaccctgttgtactagcaaatagtaggacttattcattctttctaagtattttttgtatggattaactatccccactttccccctactccccacccctgcccactactcttctcagcctctggtcgctatccttctagtctctatgttcataaattctattgttttcatttttagactcttcatatacatgagaataaatgatgtttgtcttcctgtacatggcttatttcactaaacgtaatgacgttcgttagttccatccaaattgttgcaaatgacaggacctcattctattttatggctgaatagtactccattgtgtttatgtactacattttctttttctgttcatctgttgatggacatttaggttgcttccagatcttagctattgcgaacagtgctgcaacaaatatgggagagcagatatctctttgatatactgatttcctttgttttgggtatatacccagcagtggagttgctgaatgatatcgtagctctatttttagctttttgaggaacctccaaactgttctccatagtgggtgtactaatttacattctcaccaacagtgtataagggttcctttttctccacattcttgccagcttttgttatcgcctgtctcttggatataagccattttaactggggcgagatgatatctcattgtagttttgatttgcatttctctaatgatcaatgatgctgagcaccttttaatatgcctgcttgtcatttgtttgtcttcttttgagaaacgtctattcaaatcctgtgcctatttttgattggattattagactttttcctatagagttgttttagctcctcatacatattatggttcttaatctcttgtcagatggatagtttgtaaattttttctcctattctgtggttgcctcttcacttttttgattgcttcctttgctgtatagaagcttttaaacttaatgtgatcccatttgtccatttttgctttgattgcctgtgctagtggggtattactcacgaaatctttgcccagactgatgtcatggagagtttcccaaatgttttcttgtagtagtttcatagtttgaggtcttagatttgtctttaatccattttgatttgctttttctatatggtgagagattgaagtctagtttcattctcttgcatatggatagccaatttccccagcattatttattgaagagattcttttccctagtgtaaattgatgacatctttgttgaaaatgaattgactgcaggtatgtggatttgtattgcagggttctctattctttccattggtctatgtgtctcttttttatgccagtgccaccctgttttggttactatagctctgagtataatttgaagtcaggtaatgcaattctttcagttttgttctttttgcttaagatagctttggctattgtgggtcctttgtggtttaatataaatttaagggttgttttttctatttctgtgagaaatgtcattggcgttttgatagggattgcattgaatctgtagattgctttgggtactatggaaattttaacaatgctgatttttccaatccttaagcatgaaatatctttccattttttggtgtcttcttcaatttctttcattggtattttatagttttcattataaagatctttcacttgtttggttaattcttatgaatttaagtatggttattgtaaatgggattatttttaattttttgtcagagtgttcactgttggcatatagaaatactgttgtttttttgtatgttgattttgtgtcctccaactttactgaactggtttatcagttctaagagttttttagtggagtccttaggtttttcaaaatatgagatcatataatcgcctaacaagaataatttgacttcttccattgaatttttgatctccttaatttctttcttttgtctgattgctctagctaggacttccagtaccatgctgaataagagtggtgaaagtgggcatccttgtcatgttccagatctctcaggaaaggctttcacttttcccccattcagtgtgtctgttatatatagtttttattatgttaagatatgtttcttctacatccagtttattaagtggtttttatttatttatttatttttgtttgtttgttttttacacatcacttcttttggccattcctagctccaagagggtctgtgttgatgttgttattgttttctaataaggaaaaagaggaaaactgaggttaggagacaagtagccacctgtgtacagggtcagacataaagtcaaatgatcactgatggagctctggtgataggcctctcttaaaaatcaccaaacttaatgcaaaatcctaaggactccatacctaaaaccccctaaaatgagatcagtgaaaatgagcagtgggcaaaattgggacccatgagaatgtatccagtaggatcatgatcagtcaagcaaatgggtttaacttggctttcctggtttattattatttatttcctggtttattattattatactttaagttctgggatacatgtgcagaacgtgcaggtttgttacataggtatacacatgccatggtggtttgctgcacccatcaactgatcatctacattaggtatttctcctaatgctatccctcccctagcccccgctctccccccgcaggccctgatgtgtgatgctcccctacctgtgtccatgtgttttcattgttcaactcctacttataagtgagaacatgcagtgtttggttttctgttcctgtgttagtttgctgagaatgatggtttccagcttcatccatgtccctgcaaaggacatgaactcatccctttttatggctgcatagtattccatggtatatatgtgccacattttctttatccagtctatcattgctgggcatttgggttggttctaagtctttgctattgtgaatggtgctgcaataaacatacgtgtgcatgtgttttatagtagaatgacttataattctttgggtatatacccagtaatgggattgctgggtgaaatggtatttcttgttctagatccttgaggaattgccacactgtcttctttggtacgtgtaaattgttgaactaatttacacgtaccaaaacagatatatagaccaatggaacagaacagtggcctcagaaataatgccacacatccacaaccatctgatatttgacaaacttgacaaaaacaagcaatgaagaaaggattccctatttaataaatggtgttgggaaaactggctagccatatgcagaaaactgaaactggatcccttccttacaccttatacaaaaattaactcaaggtagattgaagacttaaatgtttaagatctaaaaccataaaaaccctagaagaaaatgtaggcaataccattcaggacataggcatgagcaaagacttcttaagcatttttttgatagagtagcacagataagtatctgtctgttttttttttccaactgtatttccttctgctctatttttttctgtctctgcaacttcaaatatttgtaaattaattattgagaaaataataatagtaataataataattattattatttgagacagggtctcactcagtcacctaggctggagtgcagtggtgcaatctcagttcactgcaacttctgactcatgggttcaagcaattctcctgcctcatcctcctgagtagctaggtctacaggtgtacaccaccaagcctggctaatttttgtatttttagtagagacagagttttaccatgttggccaggctggtctgaaactcctgacctcaagtgatccgcccaccttggcctcccaaagtgctaggattacaggcatgagccaccgcaccctgctgagataatgattttttaatcaaataactaagttttctttctgttctctatatattgatgtatgttgtatattgtcattgaaattttgattatactcaccatgggatatcttactttggaataggtggcatctcaaatacaatttatttcctttggcagaaggggattattttgttgtgaattcaaaccttcattaacttcagtgtaacataataccataagtgatgtttcctgttattaaatcacaaacagtattaggaatgagaggctgaagcaggagaatggcttgagctcacagatttgaggccagtttgagtgacatagtgagaccccttgtgaaaaaaaagagaaaattttaaatgcggtatatttaaaacacatatttctagacatttattactggtatatggaaatcatgtttattatctaatatcataaactctgacatgatcactatcatttctttagtttttaataaattttcagcatttgtgtatgtcatatgtatttattgattgacatagaccttaatgtcttataatataatacagaagtggacatgagcatattataatttaattaaaaaaatgaaagaatttccacttagaagaccaccatagctgttgctataaatgcagaaataaacacaaacttaactaaaaattcatgtgtatgatgacatcggagagctacagaagacacaaaggttagatgacctaaaattctagagaagaaatagacctctgtaggtgaggtaaatctgagctctcatttagttctttttttgtgtgtgtggtttccatggaatctatttaatcaaaactgcagaaggttctagaaaaacacatttttaaccaaggactgccgatgattctaagttttgagtaaaactgtggttgggggaaacaattttctgctttattgtgtgtccgagtacatacatgataaaagtaaaagccagggaatggaataaaacatagctttatataatatattagtagatacctaaatacaatatggtcttaaaaatgaagtcatatgtatatagttgtattcctaagtatgttagtcccccctcatccacaaatctcctttctgtggcttcagttacttatagtcaaccacagtctaaaacacatgagtactgtaaaagaagatattttgagagcgagagggaccaaccaaattcacataacttttcatattagatcttagtgatgcaaattagatcttactcatacaaatgagacattgaattaagtctttctctcagtctgacccttagaattgtcttttgtaagattttaaaatgcatcaagtaatacttacatatgtaacagctgacccctgagccatcactgacacagatggtaccaggactgctgtgcacagacaggctttcgactctgagtagtagacacaagtttgctgtatttgcagcctccacttgagggcttgggggttccctggcctggctacactgatagcacaactggctttgactctatccccaattccccttcctccctatcccctatgcaaatcccagtaattctccaggtgatatcctggggatttccttgggatattcttggtcttcatcctgccttagagaaaactgatcctcagaggcctcacctgatccagagttttaggtttatcctgacccagactctaattccagggttatcctcttgagttggaggaagaaatggtgatttttaaaagataatcatctataggatcagtagtcagaggcttcatgctgatgagctgtaggaaataagatcaaatggcagcaaaagggtggaatacggaagtttccaaaataataataaggtatagcccatttggttcactggaaattaaagagacccatggccttgaacaatgatgtatgtgtgagttacacacccttcaaagaaacatggtgttatctttgtgtgtctgcactgaatagcttggtcatataacggtaataagaatggcagcaaaatgcccagtcatcgcccaatgggctcatgaacaaagtgatcgcagtggcaggaatggagcttatgcatggcctcagtaaaatggactttcactccctacagctgatctggctgtggccacagctgagtgtccaatctgtcagatgcagagacctacactaattctctaatatggcaccattcccctgggtgacaagcagctacgtggtggcaggttgattacattagaccacttccatcatgtaagaaacagcatttcattcctactaaaatagatgcctactctggatatgaatttaccttccctgaacacagtgcttttgcctgaactatgatccataaacgtacagaaagccaatagtcctaagcaagtttatattctctggacacagtttttagctgctgcaatcaaacatgatttaattaacttaccatgggtaagtggcttctcttccttagctaacaaatgtgccactcaaaaacttagttttgcggcagcctcattttcattttttaattttgtgaataaattctgttatgaacagctattgtgttttaaatttttctaatttttacaaatcatgaataggtattggattttgacaaatgctttttctgcacgtaatgatataatcatatgaaatttctttcctctcaatctgtgtatctttaatttccattatttgtcttattatattggcagaacttgtagtactctgtggaaaaggaagtaagagggaacatcctttccacatcttagcaggaaagcttctaatttctcaccattaaatatggtgttacatgcagatttttgtagatggacttcatgacttgcatctacaagaggaagttctcttctattcttagtttactgagagttttttctttataattaatgagtatgggatttctttaaattctttttctgcgtttattgatatgattatgtatttcttcttaatctgttaatatgatggattacattaattggtttactaatattgaaccagccttgcagatgtggaataaatcccaattgcttatagtatataattctttttagatattgttgggttcgatttactaatattttattgaggaatattgcatctattttcatgagcaatattggtctgtagatttttttagtaatttcttttttttggtttggcattctgattatgccagtctcatagaaacaggaagtattctctcttgcttttctcttctggaatatattgtagagaagtggtataatttcttccttaaatattagatagaattcacccataaatccatctaggcctggtgttttctgttttgaaagcttattaattattgattctacttcttcaatagatacaggtcttttctgattttactatttcttcagtgtgagcttttgtagattgcatttttcaaaaagttggtttatttcatctaggttatcaagtaagtgggcacaaagttatctatagtattcttttactatttttttttagcatacataaaatctataatgatgtcctctttttaattccttgatacttttccttgctctgaagtctggtctgtctgaaattattctggttttcttttgataagtgttagcatggtatatctttctccatccctttacttttaatctatatgtctttatatttacaatggatttcttgtagactacatatagttgggtgttttttataatgtggctgacaatctcttttaattggtgtaacaatccactgatgtctaaagtgattattagtacatttggattgatgaataatgtttgttatttcatatttggtgctctggttctttttgctcatttgtctccacactttttttctgtcttttgtgatttcaattgagcattttgtatgattccattttctttcttttcttagcatatcagtgatggtgatctttttttttgtttttgttttttactttttaagtagttgtactagggattgcaataaatgtacaattaatccaagtcaggttttatttacttttttatgctaatttttttattagaatgaaagctataaataaacacattacatagagaaaacttttaatatatattcctatgtgtagattatacaagtgatgtttgcatacattcttgttattaagaaactacaatgaagtatttagattaaaaagtaaaagtcactcttcatacaccactagtggtctttctactgttccagtgatttaataaaataatttttaattgtttttccaaaatattttattattaaataataatttttcatatttatggggtacctgtgatattttgatatatgtgtgtgtgataaacaaatcaaatgtgtaataaacaaatcaagatatttaagacatccatcacttcaaacattcataatttctatgtgttgagaatattcaaaatcttctcttttagctacttttaaatgtacaatgttattgatagctattgtcaccctatgatgctatcaaaaacttatgccttttctctaactgcatgtctgtacccatcaaccaacctctctttattccccccttcccagcttctggtaactattctactctctagctccataagatccactactttagctcttacatatgagtgagaacatgaaatatttggctttctgtgtctggcttatttctaagtgcacttttaattaacattaaatgtttcatgggtagtgcaaatatgttatgataatagtagctattaatcaaaattctatgtattactgctgttatataattgtgtggcttaataaatcgaaattaaattgaagtataattaattttaactctccagcctgagtattaaaacaggaactactgatgcttaggcagtaagcactgtgagtaaatcattacaaaataaaagcatactcataaacattgtaacaaaacatatcaaggagttattataattctcccaagagtttagaatctccatgtttgaaaattgctgtaataatgcaaagcaattttccacagtattagaagtaaaaactaagtttaaatattgttatatttgatagaaaagaacattattctcatatgaagattcaaattatcaattattattgagaaaaacaatttaaaaattattttttccttgtaatggaggatccagtgatatgatagaatgcataagcagacattttgaattatatgaaagctgatcttgctattcatgttactattatattttcaaagtaataaaatatttttgagaaaattctcttcctgttttaagaagcagccctgcatttttattttgcactggggctcacaaattatgttgttggttctgttttccagtaatacatatcagataccagcaatgctgaagtttggaaactttctagaatgctttttgtttcattaggaagagtcctccacctccatgattccctttgccttctagaagaataaaatgggaaaaacagaattttattattaaaaaaaaaaacccagaagagtaacatcactttccactcaaactgactacactaatctaatttctcattctttatctcttttacactaaggtatacctgtaattttcagagttccattttcaaagactgcttatagtttttaaaaatgtgcatttatggtatagaaagaaaatcattttacgactaccaggttccactgaaaagtaattaatatactgtagtcaaaataaaataaaaattttaatacatgaaaacaactaccgaaatgttatgaaattatagtttagtagaactaacaagtgcattaatgcaaaagaaaagtagggctcagtaatcagggaaccaagtgtgcattgtaaaagtgcagcctctctaacactgggtttcatcacaagtaacagaacaggatgcctgatgcagggaaaaaagaaaggcaattgttggcaatgtcaggaatattgccatggcgtctaccactggtgggttactgagcatcagaaccacagaagaggtaacactgaagcctgcagaataatgagtcttgttgcagaaatgcaaagaaaaagaaagatgataaatgcacacccaggaggttacgttaattttaaccttctgagtgtgcacagctgtgaagataaaactatgcacagctcatgggttaggtttcacacagtctgccatttaaacactccctatgtcaccatcatgtaccatataatttgcatatttgtcctttatataaccctataatatgtttgtggccataaaatctgtgctgtcaaactgattaggaactgactaccacctgcaggtcagggccaaggttatggggtcccaggttcacctcctcagcttcctcctcctttggatctctggtaagagaaacacttcctctcctctgtgccaccaagtcccctgcatatccacaaaaataatatattttcataaggaattgattttcctcattctctgcaaatatgatgcatttgatttatgttttttactttgctccataatcagataccagggcagaaacgacactcacgcagtctccagcattcatgtcagcgactccaggagacaaagtcaacatctcctgcaaagccagccaagacattgatgatgatatgaactggtaccaacagaaaccaggagaagctgctattttcattattcaagaagctactactctcgttcctggaatcccacctcgattcagtggcagcgggtatggaacagattttaccctcacaattaataacatagaatctgaggatgctgcatattacttctgtctacaacatgataatttccctctcacagtgatacaccctgttacaaaaacctccaagttctctcagtgggattgcctcagctgctgctgaaaatgttcagaatgtggaactgggtggccctgtggtgtttataaggcttctccatgcccatgcaactcacttcctttttctttttgtttctgtagtttctgctgcccccatgctgtgcctgacacacttgatatggcaaaaaccaggacagcctttctcacgttgtccagctgtgccaacaatttcacttccaagcagaggtaaattctcatggccaactccctgtcttttgccacactcatcatttccacctccaagaaaaacaaaaccaaaaaccaaaatgcatctagcttagattccaaatagtagcattaaaggaaattgtccctccctataagcattctcaccctcatccacacagtcatcgtgactcttccctaacccactgagtgctcaccagtcctcttcagtcctccctccagtgatggggaaaagcgagtgatagttatgagagcaacatgtaacctgggtgcagactcttactagtcaggtttgcctcagatttcaagtatttatctttcttttattttccattttttttcttaattatatggatcagtaagatgtctcatttcttttttttaagttacttgttcttttaacacaattcaattctataattccaaatttaaagagataccctgtatgtctttggcatgtgttatatctggacaagttttgggttatccccttcatgccactgctcaaatcttacctgaaaccccacatatttttccaaaaacctgaaaactgtgtagcggttgaggaaattaaatttggcaaatcacaatacttgaggaaacatgtatctttttatcttcactctctaatgttcaggtgatgctgtttaattgagcatttgctatttagaatcacccctctgaaacttgtgggaaaacagcaccagcaaggcagtcttcatgttttgacctcattattcctggattatgctagccttcttgctattgttctactacagccactacctgaagaaacctcatgtaggattgtttcctaatgaaatattaagatttatctgcaattatccctaactctgcaaacttaactgacttctcaggttagtatttaatagccatcaaataaggagtggctgaaataatattaccaaggaaggaaataattggatcatagaaatgagggctttgtggttattgcatggtgaagaccaacaaaggccattgcaaccagtaataatatgcacaatgatgagctcgtagttaagagcaatttctgtcttagttttactgtcactgaactgggctggaaccctggagggcagggtagatgaatgataatcaaaaacatgatttcatatgttaagttctttggaaggctcaatttcggagatttctcccactttctataagagcagacatcaaagaatctgattctggaatctcgttttttctcttacagctctctttttttctactctaatctcttttccgcttccaaggacatacattgataaatatggtcaacagaatattaaggtgatgtcaatattagtgactaccctataagagggaacagaaacattcgtgtttgtaagcttttagtcctcacttaagcttctttcttgagtaatgtaatcgctccccttaatgtctggagcagacattagtaagaataataaatagtatgtttagtctcaaagatggtgaatacagaaagtggtcagaatgtgaacaacactattaagtatttagctaaaaataaaactattgagttttgtaaattcttatcaagtcttctctaagattgaagctccaggttttagtgaaaatcctgtccaggaaatattacattataatccctttctctctgttcccatctaccttaggctcatagtgacatgaaagcaaatttccatcctctgggaatatataaacccggattatttctttttatatagatgctctatcccttgcctgtgtgctattttcttactgagtcactaccttgcaccatgtacacaacccccagtggtttatgataggatgaacctattgaagcagctagcagagaaaaggttatttatgtgggtaactgtgtatgcttgttggacattccctgggtctctcacactgttaccacagcagcattataaaaacatcatctatctatctctctatctatcaattgatctatctgtcaatctatctattgtctatctccataaacacacaaacatactcacatttgtgtgtgtgtgtgtgtgtgtgtgtgtatgtatacagaagaaatgataaaagttatatatgtcttatgtcccaaactttagaaaggatatgtaacatgttagcaatctttgaacacacttgctggaatatagagtaaaatactttgttgctggtatatcaaactgtagtagataatccttctgatttccaaacagggtatacaaatgcacctttccaccagcaatgtatgagggtttctattgttctacatgtccaccaatacttggtattgtaaaactttttaatttaagcctttcttctacatgtgtagtagtatcactccataattacgatctgtgtttgtgggattatatatggattatatatgcttgtagggcatttgaccatcctctgggttaaaatttctgtcaaattctgcccattttactaatgcattttctgatttagttgaacagatatgtatgaaaatatatatataacatatgcgtgatatatatcagcgtgtatctgcctatcatccatccatctatctatccatcaatctgaatgtttgtgctctgccaaaattcatatgttgaaatcttaatctcaatatgttgatcaagattgagccttggcaggtaattaggctgttagggtaaagccctcatgaatggaattaatgtctttataagaagaagtgaagagaccagagggctagctagctctctgctcttagccacatgaggatgcaaggagaaggtcctctacaaacctggagtcgggcttcactatacaccagattggctggcaccttgatcttgaacttctcagcttccagaattgaaaaagtttctgctgtttaaccctgtccatcccccagtttatggtagtctgatatagcagcctgaactaacatctgtatctatatttatacaattatagatatagatagaaccagtattttttcgcatttgtctctgtctctggtttacctttttactcacttaagtctgtaaatggaatcattttcttaatttgtttttcagattgtttattgttattgtagaaatgcaacttttttattttctttcctgaaactatatttaatttatttattagttctaatattttttgataagttttttaaaaaaatttattttgttttaagttccaggatatatgtatggatgtacaggatgtgcaggtttgctacataggtaaacgtgtgccacggtggtttgctgcacctatcaacccatcacctaggtattaagccttatgtacataagctatttatcatgatgctcttcccctatcccccagtgtgtgttgtccctccctgtgtccatgcattctcattgtttagctcccacttgtaagtgaggacatgagatgtttggttttctgttcctgtgttagtttgctgaagacaatggcttccagctccatccatttccatgcaaaggacatgatctcattactttttatggctgtataatattccatcgtatatgtaccacgttttctttatccaatctatcattgatgggcatttgggtggattccatgtctttgctattatgaatagtgctgcaatgaatgtacataagcatgtatctttgtaatatgatgatttacattcctttgggtatatacccagtaattggattgctgggccaaatggtatttctggttctaggtctttgaggaattgccacactgtcttccacaatggtggaactaatttatattccaacagtttaaaagtgtttctatttctccacagcgtcaccagtgtctgctgtttcttgactttttaataattgccattctgactatcatgagatggtatctcactggggttttgatttgcatttatctaatgatcagtgatgttgggcttttcttcatatattttttggccacatatattttgagaagtgtctgttcctgtcatttgtccacttttaatggagttgtttgtttttttcttgtaaatttgtttaaattcctggtagattctggatattagacctttgtcagatggatagagtgcaaacattttctcccattctgtagttgtctgttcagtctgatgatagtttcttttgctgtacagaagctctttagtttaattaagtcacatttgtcaatttttgcttttgtttcaattgctttcgatgtttttgtcatgaaatatttttatctgggtatgctgaagaatagttttcctaaaagttatatattaataaacaaagagttagtgagagcactagaatcagagaatatatgtaagagtttgttcaaagcagggtcttaaattttagtctcattgcaaatttggattctattcctcttgaatggactactgaagagatataaagaccatgaggaagcacgaaaatatctgctttgctgcctcaaggatgtttaattgccccattgattctcttgggaaagaattctcccattgttgctcactgattctcaaagattagaagtaaaaataacttaggggatttgtgactaaagttcccatgcctagagatactgacctcctacgtggtgttgagtttaccttaattcttgaaggatgcttaactttgaagggaactctagctatatggctactttttcttatcattttaaggaaattttatggtctctgcttttcctgatttatgtttagaggttagctattaatcttattcttgtttcttcaaaatgagagaattttttctgattaagatttttttgtttgatcagtagatagtaaagtgtgacattatttatacaacgtaacactacacaacaaaaaagattaataaattgcaacaacttgaatttttacagtaaaattaaaatgacacatatctattacctaaaacacatctgagaagctaatttatagaaatagaagtatgcatgtgtaaagatataggtaaaattgtattaacaaatccattgattatattagcaaaacctgaacataatttaattgcccttcagtagaaatgtttgaataaagtataggttttctacacaatccaaaatgtgatgataaagaataggttatatttttcatctcttgatctggagataatctctttagaaatgttaaacataaattcccaaaaatgttaatttatgagccaatatttgaaaacatagaagcagaattatgaaaagtagtaatttgtcttttctatctttacaaatatggaatcattttacatcttgtggggttacaatgaagaaaaaaagcagttatgacaatgggaaaaatgtatgcgtaacatacagcaatgttcacagagatgaatgaagttatagtgacaaatgaaaaatgtaaaaggcaatttgatttatattgaatatatatatgtcaggaatatggaatgagaggagacaggtaaacacaataaaaactctgaccaatgcctgaaataaggatattacagaaataaaacaatgctatttaaacatctaaaaacagcataataatcaccagaattaaaaaagatcctgtagatgtgtgttcattcatagaaagatggaagtccctacattattattaatattttcaccatcagagaaatagggtgctactcagaaaaatattttttaaacaattgacctaaatcatatcaagtaatgagatatttcttgagtccaggcatgatcatgtaaatgcatgttggttaaatccttggacttgtaatgcacattacaactttcagaactcctctctgtttagcatttataggagaccttctgactacatcaaacttcatctaatcacattttacctgcactgagaacttttggtgggaagtgagatggaacgccatagtgtcattgcatattcagaccccaagagggagctgagagatcatgccttgaggaagtgattctgaaagagtccccacagtggaggattccagagctctgtgtgataacattgcctatccactgacccacgccctccccaaatgtgcaaagaaagtccagctgccagaagcccttatcagtgtgcagattccccataatcaacactcctttgcatccaccatatctgtaggggaagtgcagttccaggctcagctcctcaggtgtcttctacccaggtgaaagtccaaggtagatcagtcacaaaatcagtgcaattttaaaattgctttattaaagtacagtgtcaaaccatgaaaagcacctattttaagtgtgcaaatcactgacttatggtaaatttgcaaagttgcagataaccacagtttaatcttacaacattttaatcatcccctgaaggatcccttatgcagaccggcagctatttttatttccactcccagtctcaggcatgtattaatcgactttccctctattgattgcttgatatgaacattctatataaatggaataatgcatgcatggtcgtttctatctggtttctttccattaaacgaagtttaggttcatccctgttttagcatgtatcagtaggccattcctttttatttttggatagtattccgctgtacggatatatcacattttatttatctattcacaggttgaggaacattgaggtcctttgcactttttggttatatgatgatcaacaatgctgctatgaatatttgcctgtaagtctttgtgtggacaccggttttgatttttctcagacagacctctacaagtggaaatgctgagccatatgataaatttctgtttattttttaaaaactgccaaactgttttcaagagtgtgcagcatttaacacttgcaccaacagtgtatgaagccttcttttctgtcacattctcaccaacttttgttattgtctgttttttaaattattaaaatcattatagtgtatatggaatggtgcctattgtgaatttaatttgatttttgttaatgactaataatgttgagcaccttttcatgtgattactgtctgttcatatatcttcttccataacatctatactaaaatattttgttcatttttaaattgggttgtcttatgacttatatattctggaaatatggcgtgtatcagataaatggtttataaataatttctctggtctgtggtttgtcttttcattttcttaatggtatcctttgaaatgcaaatgttttgaacattaatgaaacctaatatattagcattttctttcataagttgagcttttgatgttgtaactaagaaatatttggtgaacccagaaatggaaaagttttaacctaaagtttttataatttcagattttaggaatgggcagaagctggaaacattccccttaaaaactgacacaagacaaggatgtcatctctcaccactccttttcaactgagtattggaagttctggccagggcaatcaggcaagaaaaagaaataaagtgcattcaaataggaagaaaggaagtcaaactatccctgtttgcagatgacatgatcctatatcttgaaaaccccatcatttcagccccaaagctttttaagctggataagcaactacggcaaagtctcaggatacaaaattaatgtgcaaaaatcactagcattcctatacaccattcatacattcctatacaccattcatacattcatacagcattcctatacaccaacaacagttattccgagagccaaatcacgaactcccattcacaattggcacagaaagaataaaatacctagaaatacagctgacaagggaagtgaaagatctctacaaggagaactacaaaccactactcaaagaaatcagaaacaacacagacaaatggaaaaacattccatattcactgataggagtaatcagtaacattaaatggtggctatactgtccaaagcaatttatagattcaatgctattcccattaaagtaccactgacattcttcataaaactagaaaaaaacaattttaaagttcatacggaacaacaacaacaaaaaagtcctgaataaccaaggcaatcgtaagcaaaaagaacaaagctggaggcatcacactacccaatttcaaattatgctacagggctacagttatcaaaaccacatggtactggtacaagaacagacacatagaccaatggaatagaatagagagcccagaaatatgtcctcacacctataaccatctgatctgtaataaagttaacaaaaacaaaaaatggggaaaggacttcctattcaataaatggtgctgggataactggctagccatgtgcagaagattgaaactggacgcctttccttaagccagatacaaaaatcaactcaagatggataaagtatttaaatttaaaacccaaaactataaaaaccctgaaagacaacctaggcaataccattcaggacacaggcacaggcaaagatttcatgacgaagatgccaaaagcaattgcaaccaaagcaaaaattgacaaatgggatctaattaaactaaagagcttctgcacaccaaaagaacctatcaacagaatgaatagatccctacagaatgagagaaaaatttttcaagctatgcatctgacaaaggtctaatatgcagcatctataaggaacttaaacaaatttacaagaaaacaatcaaccccattaaaaagtgggcaaaggatgtgaacagacacttctcaaaagaagacatacaagcagtcaatagtcatatgaaaaaaagctcaacatcactgatcattagagaaatgcaaatgaaaaccacaatgagataccatcgcacactagtcagaatggctgttatcaaaaagacaaaaaataacagatgctgatgaggttgtggagaaaaaggaatgcttatacaccattgatgggagtgtgaattagttcaaccattgtagaagagagtgtggtggttcctcaaagacttaaagtcagaaatacaatttgacccagcaatcccattactgggtatatactcaaaggaatgtaaatcattctattctaaaggctcatgtatgagtactttcattgcagcaccattcgcaatagcaaagacattgaatcaacccaaatgcccatcaatgatagactggataaagaaaatgtggtacatacacaccataggatactatgcaagcataaaaatggacgagatcatgtcctttgcagggacatggatggagctggaggccattatcttctgcaaactaacacaggaacagaaaaacaaacactgcatgttctcacttataaatgagagttaatgatgagaacacatggacacacaagggggaaaaacacacacttgggcctataggagggtggagggtgggagaagggagagaatcaggaaagataactaatggatactaggcttaatacctgggtgatgaaataatctgtacatcaaacccccatgacacatgtatacctatgtaacaaacctgaacatcctgcatatgcacccttgaacttaaaagttaaaaaataaaataagatctctgatctattttgatctagtgtgcatggcaagagatcagggcctaaattcgtcttttcacctatagataccaattgaaaatctatccttcctcccatttaatttcctaggcattattttaaaaaataacttaccaaaaatgtaaaggtttatttctagattctcaattccatcctactgatctataagttcatttttgtgccagcaccatcttgtcctggaaactgtagtttatagttgttctctgctttatagtataggcgatccttggacaacactgatataagctgtgcaggttcactcatacatggattttctgccacatctgaaataacaagaccaatctctcctctccctcctcctcagcctactcaatgtgaatacgataaggatgaagacatttataatgatccattttcacttaatgactagtaaacatatgttctcttctttataattttcttaaaaacattttcttttctctacattacttgattgtaaaatacagtatataatacatataacagtcaaaatatgagctaatcagctgtttatacaattggtaaggcctccagtctacaacaggctatcagtagttagatttttggggattcaaacattatacatacattttctattgtgcacggcgtctgtgcccttaactcccacattgttagagggtcaactgtacattttgaaactggaaattttatgccctccaacttcaattttcttgaaaaattgttttggttatttgaagtcttctgaattttcatataaattttagaatcagttcaccaaattctatagcctactgggattttgactcaaattgtgttgaatctgtagatcacactggagagaattatcatcttaataatactgaatcttccagtccatgaacatgaaatgtctcttcacttatttggatcttctttaatgtctctcagtaatgttttatagttttcagcatatctcttacttttttgttaaatatattcagaagtattttcttcttatcaatgtttgttcattgtctttatgctttattttcaagttagtgatccacagtagtcaatcttatttgtgtattctgtatttgtgaatttgcctgcctgctaaaatttaatacaatcccaaagtcaatacatagagtgcttttattctcatttgtggacatgcacagagtggcaaaaaaattgagccactgaacactcatgttcccaactgaggtttaacaaagccacactcttccatcttgtttcacttctcatactgtaaacaagtgtccttttgctcaattttgctctttatgttggtaattttgtggttataaatgttccccaaatataataatgctgaattgctgtttaatgttcctaagcacaagtctgccatgtgtcttacgaagaaaatatgtgtgttagataagctttgttcaggcacaagtcatagtgcttttggccatgagttcaatgttaataaatcgtgtgtgtatgtgtgtgtgtgtatgtgtgtgtgtataggaaaatgccttgttttattgcacttcactttgttgctctttgaagatactgttttttacaaattgaaggtttgtaacagccttgggttaagcaggtctatcatcaccattttcccaaaagaatatgttcactttgtgtctctgtatcacgttttgctaattttcacaatattttaaatttttcattattatatctgttagggtgatctgtatttagtgatctttgatgttactattataattgctttggggaaccacaaaacacacaaaccacacttactcgataaatgtatgtgtggtgactgctccagtaactggccgttccttgttttcctcttgtcgggcctccctatttcctgagacacgataatatgaagattaggctaattaagaactttataatgatctgtaagtgttaaagtgaaagaaagtcacatgtctctcactatcaatcaaaagctaggaatgattaggcttagtgagcaaagcatgtcaaaagcttagatagaccaaaagctagacctctcgccccagttagccaagttgtgaatgcgaagaaaaagttcttgaagaaagttaacagtgctactccagtgaacacatcacaaatgtctaaaaagcaacatagccttattgctgatatggagacagttttagtgatctggatagaagctcaaaccagccacaacattcccttaatccaaagcctaatccagaggaaggcccaaactcatagaatttatgaaggctgaaagagatgaggaagctgcggaagaaaactttgaagcagcagaagttggttcatgatgtttaaagaaaaaaagccatctccatgacatacaagtggaaggtgaagcagcaaagtgctgatggagaacctgcagcaagttatctagaagatctagctagaagtattaatgaaagtggctacacttaacaacagattttcaatgtagatgaaacagtcttatgttggaagatgatgccatctaagactttcatagctagagaggttcctggcttaaaagtttccaaggacaggcagactctgttattaagataatgcagctgatgacctatgttaagtcgaagccaatgctcatttaccattctgaaaatcctagggcccttaagaattatactaagtctatttttcctgtgctgtatacatggaaccacaaaacctagatgacagcacatccgtttagagcatggtttaccaaatatttgttgagacctactgctcagtaaaaaaagatttctttcaaatattactgctcattgatttacaatgcacctagtcactgaagggctctgaaggagatacacaaggagatgaatgttgttttcatgcctgctaacacaacattaattcttcagctcatgcatcaaagagtaattttgacttccaagctttattgcttaaaaaatacatttcataaggctagaactgctgtagatagtgattcctctgatagatctgggcgaagtaaattaaaaaccttctggaaaggagtcactattttagatgccattaagaaaatttgtgattcatgggagctggccaaaagatcagtattaacagaagtttgaaaaaagttgattccaaccctcatggatgatttcgaggggttcaagacttcagtggagtaagtaaatgaagatgtgtaaaattaaaagagaactagaattagaagtataactatgtaacaaacctgcatgttctgcacatgtgtcccatttttaagaagaaataaagaaaaagaaaagaagcggagcttgaagatgtaactgaattgctgcaatatgacagtaaaacattaatggatgaggagttacttcatacggatgagcaaataaaatagtttcttgagatggaatctactgctgtgaagatgctgtgagcaaggttacaatgacaacaaaggatttataatagtataaaaaaatttagttgataaagcagcagtagggctcgaggattgactccaattttgaaggaagtactactatgggtaaagtgctatcaaaaagtatgtcatgctacagagaaacctttaattaaaggaagattcaatcaatgcggaaaactttattgctgtcttattttaagaaattgccacaatctccccaactatcaacaaccaccaccctaatcagccagtagccaacagcattgagataaaattctcaaccagcaaaaagattactcactgaaggctcagatgattattaccattttttagtaatgaagtattttaaatgatgtacattgtttttaaaacgtaatgctattgcacacttaatagactacagtatagtataaacataacttttatatatatgcagaaacccaaaagtttgtgtgattcactttattgtgatatttgctttattgcagtggtctggaaccaaatctacaggtatgcctatatgtatatgcctatatttaagactttatgagatatatataatctgtttaagatactcatacaaaaagttacctattgatcagttaatgaaaatgtgaccataggctcataggaacataaaccagtactaccactaggaccaatggttcaatatttgttaattcagcgtttgtgactttacagatatctgttgaaacataacaaaatgtaactgtacatggagataaaatttatttctgcatattgcatatcttattgtgtgactttgccaaagttgtttattactagtagattgtatgtgtagtggtgggggacatgtattccttatcatttaatatacatacaggattatattttctgtaattaaaatacttttactcttcttttaaatattgatatactttatttttcatttttttcttgcttgattgcttgacaagaacatccagtgcagtgttgaattgagtagcaagagtgaatatccttgtcttgtttatgacattagaaagaaggcattctgtcaactttaagtagatgttaactgtaagtttttcatatatatcctttataaggtaaaggaagtttccttctattacaagtttgttgagagcttttgtcataaaagagttttgaattttatcaaatatctttctccgtttattgagatgattacattttttatatttactctatgtggcatattactttattgattttcagatgttaatctatcttgcattgtttaataaatcccatttgtattatggtgcataatcatttctatatgctactggattctatttagttatatcttttgataattttttcacatgcattagtaggggatattggtctatggttttctttccttggaatgtctttgcttggctttggtattggggtaacactggcttcatagaatgagttgggaagtattcttttctcctatgtatactgaaagaatttaatgaagattggtaatatttattctttaaattcttgatagaactcaccagtgacgccatgtagtctcagtttttctttattggaaactttttaatttcttcacttgttatggttctattcatattttctatttgtttttgaattagttttgggttatctcatctaaattgcctaatttaatgacttattattgttcatcatattctcttacagtatttttaaagtttctgtaggataggcagttgtaccccttatttcaatcctgattttaataatcttggccttctctttttttcttcaagagtcataaagatttttaattttgccaatctttccagaaacacaacttttgctttcaatgattttcgtcttttacttcattgatttatactctatttttaaaattattttcttccttctgcttgctgtgaatctcgctggttcttctttttctagtctcttaaaatagaaactaccccattggtttttagatattctttctttctttactatacaggtaattacaggccaatatttataaaattatttatttatttcaaatcttccactctatagatgaaaccttcaccacttcgtcactcaggaagcaacaggagaaacatgagaagctgggatgaaaacaccattttgaggaatctgtttgtctgatgctggtcagaacctattaccagaggaagcttccttatttaatccccttaggacaggggccatttgagagaaagagaataaaaacaaacaaaacacttaggcaatatgacagttttagtggacaaccctaggttggccccatgatacagaaccactggtgttcctaactgtgtaattccctcttcttgagtctgggcagaatttttgacttccttctagcatacacaatattgcaaaggtgaaagtattttgcagatgcagtagtcccaaatcagttgggtttgagttaatcataagggagattattgtgagtggatctgacttaagcaggtcaaagccattaaaagaggaactgagctctccttgttaccaagaaattatcctagctggtttgattattagtagcccatgtggcaggaaacttaagatgttctctaggagcttagggtgatctccagccaacagccagcaaaaagccaggaccctcagccttagagttactatgaaaacaattctgtcaacaacttgaatgatcatggaagcagactctttaagtccctggatgagaatgcagcctggtcaacaccttgactgcagcctgtgagaccttgaagagaggacccagataaactctgcccaggctcccgactcatagaaactgcatgtgaattataaacgtgtattattttaagccactaagtgtgtgataatttgcatgggccaacagccaactaataataaaattttatatgtagtgagatagggttacaagggttacaaatttagaaaccaatgtaaatcttattagactgaaatgctgcaaaagcctattttgccagagtttctctgcttgctttgtggaggatgcagaagactgacggaggccaaggtagggatggaggggcacataatcactaatctttccatgattgtgactatgcacacctgcatttctggagtccactctgcctgtagtgttagagcaattagaaaagcaaaaagagaagatgagaaaaaaaaccttaacaatggacatggaaaatatcatagaaaaaggacatgacctgtaatcccagcactttgggaggccaaggcaggtggatcatgaggtcaggagttcgtgaccaggctggccaacatggtgaaaccccatctctactaaaaatacagaaattagctgggcgtggtggcaggcacctgtaatcccagctacttgagacattgaggcaggagaatcacttcaacctgggaggtggagactgccgtgagccaagattgtgccattgccctccagcctgggtgacagagtgagactctgtttaaaaaaaaaaaaaaagaaaagaaaaaggacatgaacactgcatgaagagtaaaggacaatttattaaaactagagctgagaatctaacttttgggaaagtcaccgagatagagacatctaaattaaataagcagagataactacctcacaagtcttaggtttctaaataactagaaaagccttttcatgtgggttcagcaaataaaagtggagaaaagtcaaaattcaggtgagaaggtcacctatatctgaaagatatagagctaataattttgactattcagagcattttttaaaatgactacaaagttttcttaatgtttaaaattcttctattggtaagggtctttgacataaaaaatatacattgagaagtagaaaacttctgagaggtcctgatacagtaaagaaattattaaattataaaactggctgtgacacacatgcatgcacacacacacacacacatcaatttaaggattttctctttgataatttgacccctttgttcaaacaagcctatgacagcaggctgatggacctgcataaaaagccacatctgagggatttgagcctcagggagcagctgcctggggaggtttttgtttagacctaaagcactgtgggaggaaaattcttactctgcagacagtaataatttgcagtatcattagcttccacaggattaattgtgagggtgaaatcggtcccagacccactgccgctgaacctggctgggaccccagtgtctttattggatgcttggtaaatcaggagtttaggaggttgtcctggtttctgctgataccagtgaattaagtttattcccaagaaactgacactctcactggctctgcaggtgatggtggccctctgtcctggagacacggccaaggaggctggagactgggtcagcacaatgtccccattgcagcctgaaatgataaagacagataaattatatcagatatactgagactgtccccatgtaggcccatgcattggtgacacttgtaaccacagtcatatgcaacatcttgagtaaccagaaaacaaaagataactggggaacttacaacctacaatgagtgccctaaatccaacaaccaagaatccagagacacaaaaaacaatgatggccacatgagtttgcccgatgtttccctataccccctcacttggagcccagagcaggaggatccacagcaaaggagccccggaccctatctctgagagctgaactagaggctgctcctcaggggccctgacaagctgtctttaaggatgctctgagaagcttggaccgttgtctaatggcccaacatgcaaatcagctcagaaaagtttgagttgatgctcaaaggggacacctgctcttatttcacccagtgggagttggggctaacaaaacatttcctagggtagctcaagcatgtcccaagggatttggtgaccttttctattggatctttgcctgccagtctacttgagatgccatgtggaggagtgtactggggctgccctgccatttggatataagttatttcagaaatacttttgatttttcaaaattcatattttatatcattatcaataataatgcattttaagttatcattgtcagaaagagaaagcaagttgggtgggttttatgaaactggttcatatgggaaggagaagtttgttccactgagtaagtggtatttaaaacaagtctataaatgttatcatgatctggaaaggatgaagggggtgagcatgaaaccttgatgaagactggtaacctaaactaatcaaggaacttgcctcattgtggataaggcagggtctctccatctgcttagtcctgaaaccaatgctgtatccaccagaggccctcagaggcagaagagtcattgtagtggatcctattcagagtggagaataaccatcccccaactcccactggttccatctgccttgccactggaagctggggctaaggaagtccatcttctcctacagcaagatatggtgtccacaccagtcagctggcactctcacccatccataggtgaaggttttcccccaacaaaaccaacttaaaatgtctggaagaagggactgcatcttcaaatgtgcagacaccaacacaaggctacaaggaacatgaaaagtcagggaacatgatgccaaccatcacttctctatgagctccactccaggactctattctgttacttgtgatggagttcagggccagagaggtcccactatactgcttccaactgtgcgcttgggtccctgattactcagttatatttttcattgatgttaacatgcatattagctctagttaactaaaagttttcttttatcactctgggaattgtttttatgcttttaaatttttattttatttgatttcaactaaaataaactagtggcttcccaaaggatctaggtagaactaaaataatggtctttctacaccttaaatctacatttttataaacagctgaaaatgaacagctgagaattacagctacaccttagggcaaaggagatgaagagcgggaacttagattagtgtggtgagtttgagtggaaagtactataccctcttgtttttcctaaatgattaaattctgcttacctagctctattcccctagaagaaagcaggaataatggaatttgagtattccttgaaaaaacaaagaacattttcaagaaatttaagaagttttcaaactttaacctttcagatgtctagtagatatctctggaaaacagggcaagcatcaatttgtggattgagaagaaagataaaatatttcagaggagccaatatgccatgagaaaagtcctgaaaaactccccctgaacccttggaacttttgtgccatgattagggttgggacaatccctgagctttgccccctcctacaactctgggtggaggaggacagaagtagaggtgggaagtaaaaggggtgaaatttgcatttttttattaggccacctagatgaccgatcattaagaaggctctagaaaatagagacaaacttgaccactttaagttgttcactgtcccatcctctgtcttctactctttctccagcaaccaagtgataactactacacacaacctgcaaggatacagtcctcagactcagatctggggtggaggtagggaaggtaataataaaatgcacccacatgtgtttggagcaatcaagaaatattgaactataccatattttggcaaataaaagacttgggtaaagcaaccccatcaaggataagtaatttgaaatgaaataatactgaaaattacaaatataccatgggagagggctatatgactgacaaaaatacatagcaagtaaataataaattagataactcttctgaaaatgatgtactctagtaaaacaaaagtattttctgcagcaaatgattgtaaatttagaagacacaccaaaaaaaaaaaaaaaaaagaaaaacacttaaatttattttcaaggatgagatagcaagaaaataataggtaaaataaatgtgtctggttacaggtacaggattaaaaaagtaaagcagaactagtaattttaacatagaaaaaatgtaataaggcaaagaaataaatggagtcaaagacacataaggtaagcttagtaaagggataaagttcagaaaaaaaggcaaaaaaaattacagataattatagaaaggatagaaaataggcacccaatatacatggataattgatgtgttttaattatggaatttaataaaatggcatatgaaataaaatgtaataacataatgaccagaatgtcaatatgtttaagtgaagatatgttaaaacaccccaccataacatatatgtgaattacatatttattaaatacagaaatattaaaagataaatctataacaaagaatttatatgaatatatatctgactttgtatttaaagagactatttataagccagaagaaaaaggaattctaaaagaaacaaaaaaatataaaaagaaagcaacagaagcctaatataaagtttctaagtagaagttttaaatcaatgtcaaacacaaaattatacactgaagaaaatcaatacatgtaaaaataaaagtaaactataacaatcaaagacatctcacaaaatgatgaagaaagcaaatttaaattagaaaaataatccataaaatgaaaaattaataaattggacctcatctaaattgaagtttttgatctgaaaaaaaatctctattaaagggatgtaataaattgaaagtggacttgtgtaatttagcaaatgaactcttgagcaattatctcagagaaataaaacattattatacagaaacttgtacacaaatgttcacagaagctttatttatagtagctaaatcaaggaaattacccaaatgtctttcagtaagtaaacagttaaataaactggggtaatccgtattatagaatacattcagaaataaaaagcaataaacaattgatatacccaactttgatgagcctgaagggtattacgccagtgaaataagccaatctcgaaatggtacttattgcatgatgtcttttatgtggtgtttgccaagggttaaggatggggtagagaaggtgagtgcggctataaaagggtaacaccaggagtcgtgtggtgatgatttagctgaatttcttgattacagtggtggttatagaaggtcacataaatgattcattcacatcgagctacacacacataaacacaatcacataaacaaacaaaaattgtgtgcgtgcgtaacttgtgaaaactgaataagttctatggatgacaccaatgttaatttcctgtctttggtattgtactatagtttgaaagatgtcaacactggaggaagttgccaagatgtatgagacttctgtatatttctttgcaacttcctgtgaacctataactatgttatagttaaaaaataaaaagtaaaaaaaatcttaagctttattacttgaaaaccttgaaaaaaatgaattgccctttttctatcaaatgattggcaaaaaaacttaaagccttatgcctccctctgctggtgggaatggagagggattgaaaagccatactttggtggttgcaatgtggatttctactgtttcctaagtaatctctgctcactattggagtgaaatttaaaatacgtacacttgttggcccaaacttactactaagaaaattgcctatagaactaataactccgtgttgtctaaggaaacatctgaatgcctatcagtaagagatggctaaatatattgtgctattttcatattatgaaaaattatggctgcctctgcctctgcccctctgcccctctgcccctctgcccctctgcctctctgcctctgcctctctgcctctgcctctctgcctctctgcctctctgcctctctgcctcactgcctctgcctctgcctctgcctctgcctctgcctctcgctctccctctctgtacggtgtccctctgatgcccagccgaggctggactgtactgccgccatctcggctcactgcaacctccctgcctgattctcctgcctcagcctgcctagtgcctgggattgcaggcgcgcgccgccacgcctgactggttttcgtattttttggtggagacggggtttcaccgtgttggccgggctggtctccagctcctgaccacgagtgatctgccagcctcggcctcctgaggtgccaggattgcagccggagtctcgctcactcagtgctcaatgttgcccaggctggagtgcagtggcatgatctcggctggctacaacctccacctcccagccgcctgccttggcctcccaaagtgccgagattgcagcctctgcccggctgccaccacgtctaggaagtgaggagcgtctctgcctggccgcccatcatctgggatgtgaggagccccctctgcctggccgcccagtctgggaagtgaggagcgcctcttcccggccgtcatcctgtctaggaagtgaggagtctctgctcggccgcccattgtctgggatgtggggagcgcctctgccccgccgccccatctgagatgtaaagagctcctctgcccggccgtgaccccgtctgggaactgaggagtgtctctgccccgccgccaccccgtctgggaggtgaggagcgtctctgaccggccgccccgtctaagtgaggagcccctccgcccggtagccgcccagtctgggaagtgaggagagtctccgccctgcagctgccccgtccgggaggtggggggcagcccccgcccggccagccgccccgtctgggaggtggggggcgcctctgcccggccgccaccccgtctgggaggtgtacccaacagctcattgagaacgggccatgatgatgatggcagttttgtcgaatagagaagggggaaatgtggggaaaagaaagagagatcagattgttactgtgtctgtgtagaaagaagtagacatagaagactccattttgttctgtactaagaaaaattcttctgccttgaaaaaaaaaaaacagaaaaattatgcaatttttgaaagaaagggttaatttcatacaattgatctgtttattatacaatatcaagtgtaaaagcagaaatacaaaaatgtttttataacacgtaatccagtgtttgagaacctacaataataaccacagaactatagcatacacaatatagtaaatttttttcatatattaaatatgattcacgtttcttggggtgactatagttttctcactaatagaagaacagtaagttgattaaaccaaaaatcatgacacaattatatagggaggaagtcagagcactctgttcttaagctctgctctagggagaaactatttaaccagcctaatgtgctatatacagttttattattatctaactgactggggaaagagaaatactcaactccatccagcactagcatccagtcccacctacatgggtggagaaagaagcaaagagacacttgtgatgtttacagtccacagacataagctcactaaagcactgaaccctaagcatagaagtatagaatgtttctcttcccctacaccttacccccatattattaaaggcctatttctagcacttcccttcacccaatatattttatctggctatcaagtaaaaattataaggcataataaaaggcaaaaagacatggtttgaagataacaagcaagcttcggaaccagacatggcagggatgttgtaatttttaatagaggagcaatgtaaactgaaagatgaagatcccaagaaaaagcaaaaaaaagaaaatgctagagattaaaaaacaaaactaaacagaacactgtaacagaaaggactgggtatggctggaaaaacaaagtctgatcttgagagtatattaatagaaatctccaaaactgaagagaaaagagaataaagactgaaaaccaaaggcccaagaactgtgagacatatacaaaaggtgttacattgtttaactctttttctctttagaaaaaaaaaaaagtgcagtttgctgccagcattcatataattttacataaacacactctttgaggctgaagcaaatctgactgattttcaatgtgaaataaaatataaaatccgttcttggaattatttctaaacagaacttgtctctaatcctaatataacagaaatgtatatgataatcagtatttaataattttttgtgtggtaaatttcaaagcacagaacaacataaagcggaatatcacattccacacaaaaatatcacgtttctcttcagattgtcttgctaggctcgtctttgcacaagcagcaaactttgcagtgaccagttggatttcgctcccctgatgttggtgatatctcttggggaaaggtcttccatacaggtgaagaggtatgacatcttcagagcaaggatgacctggaagactttgctgccctggcctgtgatgctttaagagcattttttcaatcaacgtcagtctgaagtttatatggctaattgtgtgctcaggattgtccttcttgaacagggtgtagaggttcattcagcactgtaatgtttagaaggtggtgaaagaatttcttagaccgaatcttgtgccctttgaagaagtgagcatcaaatcagctgagtccactgctcccatcttctcactatagtccacagtggcatatgacttcttagttttctctccatttctgttgtctacttcaatcacagtatcattgtggaatgttgaccacattctcaccttcttctttttgaggtaaacactgtagctgcaagtgctgccagcaagtattcttgggcaaaaggtaaatgggttaatggacatgaagaaaaaggaggaggacggggtggaggcgtggtaaacaaaaccatattgagtgaaaatttttctaaattaatgtcagatatcgaaccacagatccaagaagatcaggaaacaccaagcagtataactgccaaaataagcaaataagcaaaacaaacaaacaaacaaaaacaaaaaacacttgagcatataatttttaaactataggaagtcaaaaacaaagaaaaagtattgaaaaggagacagagagagagagagagcatgaacataagagaaacaaacctttcatgtagaggagcaaatataaatattgcatccaacttcttctgtgaaacaggaagcattcttcacttcaatgcaagcaagaggagagtagagtgaagtatgtcgtgttgagagaagaaaaccaccaacctaggattctgttttctatgaaatcatccttcaaaaggaaatgataaatgatggctttctcagacaaacaaaaattcagaaaaatttgttgccagtaaacatgctttgtaataaatagaaaaagaaaagttcttttgagagaaggaatatagtataggtcagaaatttgaatttacataaaagaagagcatcaagaagaaataagtgagggaaaaattaaggaacatatttttcttattcttaactgatataatttttttcaaaataatagtaatgtgattattatgcatgctgatgtatacatttacatatataaatacacacgtatgcacatatatgcatacttatttatacttacatataagtgaaatgaatgacaataatgcaacaaatggaaaaaattaggaatactttgttattatcaggtactcacatgacctatgaaatggtataggagtatttgaaagtaggcttggattagttgtaaatgtatattgaaaacttcagagcaacactaaaagaggttaaaaaatctaatatgctaataaaggagagaaaatagaagcgcataagatgctaaattaaaaccataaaaaagcagaaacaagtagaagataaacatagaaaaaaaacacaccaaacaataaatcgaaaacagtgaaagtgtggtagacattaatccaaggcattgataattagttggagcatcaagtgtctaaatgtacaaattaaaagatatgttattagagtgtatcaaaaaggaagattcaactatatggtgtctataagaaacctaattaaaatattaaagcacatatagattgaaaagtatatgaatggagaaagatataccatgctaatattaatcaaaagaaagcacaagtagctatattaattttggaaaagaagatctcaaagcaaggaaatttatcatggacagaaagagcattacatatgaaaaaggggccaattcttcaagaagacaaagcagtgcttaacatatgcgagcttaacagcagactgtcaaaataaatgtggcaaaaactgatagaactacaagaaggtacagctgagtccacgattacagttaaagactttaacacttcactatcagaaatgggtagatccagcgggctgaaaacccataaaaacagtcaaactcaacaacactatcaatgaactatgtataattgccatgtgtacactattttgtccaaacacatattttttcaagatcacatggaatattctctgtgataaacttaatgccaggtcataaaacacacagtaacgtattttaaaaaaatagaaatcattcagtgccttctctcaaaccacaatggtattaaaatacaaatcaataccaaaatgtagacaatacccaaatatgtggagattaaacagcacacttccaaataacaaaagagttaaagaagaaatctcaggagaaatttaagaagattttgaactaaatggaaataaaaacatgactcatcaatatttgtggaatacagcgaaagaggtgctgagagggaaatttatattatcaaatgtataaattagaaagaagaaaaatctaaaatcaataatctaagctttcactgtatgaaagtagaaaaagaagataaaattaaatctaaattaggcagaagaaaggaaataaatattagagcagatatcaaaaaaattgaaagcaggaagtcaacagaaaaaaaaacattaaaagctaatactataaaaatacaaataacattgataagcctcaagccaagctaaggaaacacagaaagcacacacattgctaacagcagaactgaaagaggggacatcactacagatcctatgaagcttaaaaggatactgtacgactattataaacaatgctatgatccaaacttgataactttgatgaaatggatgaagtccttgaaagaagcaatctaccaaaactaactaaaagaaatagacagtataaactgccctatatatattttatatatttaataaactgaataaataactaacaacctttttaaaaataaagcaccagattcagatggattcaatggtgaattctaccaaatatatgaggaagaaattcttcaaattctccatctatttcacaagatagaagcaaagggcatacctcctaagtcattctgtgagggaaatactagtctactaacagaaccaggcaaagacattacaagaaaatagaactacaaatatttctcatgaacatagatgcaaaaatcctccaaaaagtattagcaaatcgactatgacaatgtataaaaaaacactatacagtatagtatgccaagttggatttatgctaggtatgaaaggctgattcagtagtcaaaaattaattgatttaatccaatgttaattcttgtgcatccaacacaattgagtatccagagaatgggatattatttatagcctaaataaacaagctatcaaaccacgaaagaacatggaggaaatttaaatgcatattactaagtgaaaaagtcaatctgagaagactgcatattatattatttcaactatatgatgttctgtaaaagacaaaatcatagagacagtgaaaggatcagtggtagttagggatttgggagggtgggggatgaatgggggaggtgaacagagaatttttagggcagtgaaactgttatgtctgatactacaaagatggatatttcctattatacatttttcaaaacctataacatgtatgacatcataagtgaaccctaatgtaaactaagaagccctaatctaaactctgggtgataatgttgtgtcaatgtaggttcactatggtgggggatgttgataactggggaagctttgcctgtgtcagagaaagatacgagaatctgcactttcttctcaattttgctgtgaacccaaaactactctaaaaatgagctctttaaaaacataacttcctcccctgcccggccagccgccccgtccgggaggtggggggcagcccccgcccggcagccacccagtctgggaggtggggggcgcctccgcccggccgccccatctgggaagtgaggagcccctctgcccggctgccaccccgtctgggaggcctaccgaacagctcattgagaaccggccatgatgacgatggcggttttgtcgaatagaaaggggggaaatgtggggagaagagggagagatcggtttgttactgtgtctgtgtggaaggaggtagacattagagactccattttgttctgtactaggaaaaattcttctgccttgggatgctgttaatctataaccttacccccaaccccgtgctctctgaaacatgtgctgtgtccactcagggttaaaatgattaagggcggtgcaagatgtgctttgttaaacagatgcttgaaggcagcatgctcgttaagagtcatcaccactccctaatctcaaatacccagggacacaaacactgtggaaggccgcagggtcctctgcctaggaaaaccagagacctttgttcacatgtttatctgctgaccttccctccactattgtcctatgaccctgccaaatccccctctctgagaaacacccaagaatgatcaataaatactaaaaaaattaaaaaacaaaaaaacaagaaaaacataacttcttaaaaaataattagttatttccactatctaatacagcaacttgaattgtgggagaatgagtaacagtgaaagatttgtcatattttcttttattataaatcaattattaaaaatattattcttacaaaataatcttttttgaatttcagagtattgctattgccagtaaaagttaatgataaacctttaaaaagtctgccttgtaattggttattttgtctcaaaatctgttgcccttaagtatccagaccatgtaaacttttgtaagaattcttctttcatcagaaaaaggctttgaaattttcttatactatctgggagtataatattcttaattctaaatgggaacctcccctttctgtatgttaacataccgtgccaaaatgttgacaacagcagctagagtggatcactccacactggacaaagataagaattgataaagtttgtaagaacagcctatgtttagatctaggtgggaagcaggccactgtgtgtctccaatcttggtcacattcaactgcatgaggacagacttatataggtcagttttcttgtagttcaactttcttgccaaatcctgtttgggggtccataagtgtaaaagcacatgtaatatatatacatatataatatgtatgtgtgtgtgtaataatatatatattacatgtatacatgtatatatacatgtaatatatataccttatatatattctctctctctctctctctctctctctctctctctctatatatatatatatatatatatatatatatatgacttgggaaagaggagtcttggaagtggaattgcttgtgtccattaagctggattcagtgttcgtagggtggagtttgaccctatttgtaggggatttgggggcttatcaaggaaaaagaggtgaccacagagtagcagtagcacacacatttattgggtgaaactttgaggggctcacagggacaagtccttcacagcaggagtctttgcagatgtgaaggtgccaggttgctattcagaaaggaagggaaacaagaaaacacctgaggaaagggacactggagaaaggggcttatgtgtctaggtgatgtcacacagcagcatgatggagagcctctgggttagaaagctcaagaggacagttgcagtttgggggttttattgcctgaatcttactttatttattggcagcaggtgaggtttcctggcatatgcaaagcaagcagtgtctaaatggcaaaataataataataataaaatttgagggctatttttgaaataattagttgtgtaaaatttgaacttgatgatagtagtttaaaaataaacctgcagtttagcaatacacaactttgagggcagtaaacagagctttgattcatttatataacactgttgcacatcctataatgtttgttctgttgactttatcaacccaaactgtccaaacctataatgctttgcactagaatacatacccagatgtgtggttccttcccatacccaaatggaggttccttatggcattgattgtggtgatggattcatgggtgtgtactaattttcaaactcatgaaattgtgtacattaaatatgtacaattttttggtatgtcaattatctcaataaaatggttttaaaaatctcaactagcagagggatattccccaaatgcagattgtctagagtggattcctggcttcaagacacttgtaatgaaagctggttgtctcttctaaataactataaattgtcacccagaagaagtaaaattcatggctaaccattctgttttacaggttcagagcaggctttgtggatgtgtttatcctccgaatttatatattctctctaaacactgggagacgttagtatgtttacatgtctgacttctctgggttgtcaagatcccatttttgatctacctaatatgaatttgtatccaaatgtttaaattcttttctttccttttacttgaagtaaatactaaaaaatcctacagagatactcaacccaaccataaaaatgagtttgagaatcatgtgttggcgatgaaggctttttatctgtaaatgctaaactttctgctgagcccagctcacccatggactaactggataaagtgagacaataattccattgtctacctgagcattccccaccttaaaatttttaactgcctctaacatctctgctctaggcttactcttgaagacagggtcctctatcttgaaaagaagtttttctcaaaagccagagcttgtttaataattttcagtttttttaatgtgagatttgtctattccaccttgtaagaaaatttgatttgccagacaaatgaaaagtggaaaactcaagaagagtttagagatagaatcaaggacaatagcattttaaactgtgggtacatctgtctttgaaataatttgtataaatatacggaaatgacaaagtaaataatttttttgtatttttaatttagataagatagtttacttgcagaaaaatggagactatgaacctggaattctcaaattcaatgttttttcttccggtttaaataatttcaagaatctataaaatacttacataaactttaaatacagaaattttaagagcttcagaaaaaatcgaccaaattaaatcccttacactagtttctgaaatcaaccaaaattgtgttttaactactgtgttttatttccaatgaacaacaatcaaaaacattagataaagtaagatgcaataggtgaatgaattgtttggtggtcactcttagttataatgagataataatgagacaatatcttcatcagaaagtggaaatggtgactttctgccttaagggagcaggggactcacagttgtaaacttcccctccgtcttgatctttcttgtgcaggagccgagggtaatccactgtttcagtggtctttgagcagcaacagtcctcatctttctgtaattctagaaatgctcatactgggctcttctaaaacactttttatgctaaatagaaaaataaagatcagtaataaaataaaaagaaataaaataaaataacttatgaactcctggaagtagttgtgggataaaattataaagtttaacaaaaaactagaacctagaacaacttactaaaaactaatttagtcaaattttactcttattttgtattcttgccctcacaaattaggaattttctcaacccaaagaatgattgcctttcttatattctggaatcttaacagccataggagaaatttgaaactatgagaatttatactaaccagttatcctaggaaatctggttacacaaaaattaactatttagagtaaaataaaaggaaaaatttgttgatcccatggaaataattaactgaatatttgctggtcaataaagctaatcctaagtatgcccctaaataacagcgacatcgttgtttctggattaatgctaagttttcaagatccattaaaagtaatttgccttggattcagactcatagtattggtcataactgtaattcaactaccaccagaacttgtagaagacaacaacaaaaaagaaggggtaatgagaaatatgttatgaaatgtatcccaatgttaacatttatgaaggagagggaggtgttttatgaatatctattctcatagcactgatatcttcaatttgataagcaaatacaaatctttaaaccagaatttggaacagggtaaatatggctctcatgaatttgacttgactgcgtcctggggttgtattgacataaggactagatggaggtacatacagcagaagtaatgaaaattataatgtcaaattttagagcctcctaactaaagcactagctcagatactgtataaagatgaaaaaaaagttatgtgaaaatgccctggaactgtttctggactgcctagtaacatcctggctgtggttggatggctgatttaccccagctggaagtatcagtattgtacagctgaaatttgtgggcactctcctctgcagttgtcaccaaatggcttatacttttattttcaaaatccacttgcaattctaagagctctccttttctctcacaaaaggcagttgaggcaaatcaaagacttttgggataaaatgttatctccactatgaattgacaaagtctatttagatgtttgcaaactaaacattttcactaattgctgtgagtcacactccccctgagtatagcttgtgtagaatgcaatcacaggtatgtaagtggaggtttggtataaccactaatggagaggtaggaagttagaaagtgggaaaataccaatttctgaatattaccaaacgttatcgtgttaaaaatataacaaaacctgctaatcctaacatatacccaacctttgtagccatgagtaggcctcaattttcttgctgttatgctgactaaatctcattgacaaatgcaggaaacacagggaggatcagaatgcactttccaggtagctctctcttctgtcatgtctagttgctcagagagcactttgatcaccttcattcttctgcttgagccatgtgaaataaggctgttacagtgatggggccagaacagtctggatcttcctgcaaattattccctgcagtcatctaacatctacctgtgaagccaactcagaatctgccatgcagacagtccacgtgcaaacacttgtggatggctgggccatcccaagtagggaggtttgtgttcagggttttaccactgtgtgaggaccttgcagaccctgttcacagcaataaaccccaacatcctcagcctccactttgctgaatttaagtgtgaaacctgtccctgacctgctgccactgaacttgtttgggactccatagaatttgttagaaattgtgtagataagaagctgtggagactggcctggcttctgcaggtaccaatccaaataggtgtttccatcactatgcaggaggctctgactagacctgcaggagatggaggccggctctcccagagggatgggcagggagagcagatgctgggtcatcacaatatccccactggatcctaaaataataacagtgagaagtacaaggttacatacaaacaatgtgagacatttttataatttagttttattgtatacgttaggctacttttttgtgtttgattagattcatacactacatttatccaatatccaaaaataatccaataattaaaggcacaaagtggcctctttgtttttgaagttctcgacagtgaagttctttttccttgtggctcgttcttagttcttacaggtctgaatattaaattccctttgctggaggacaagaaatctgcatctgacatgtagacagaacaacaaatgggaggctgcagattccacagagctcaccctccagtcccattctcctctcttctgtccttaccagggacccagagcattagcagccccaggagctgagcagggagcctcactgtgagaaggtgaactgaggagtcctgatcagtcaaggcaaggttagagctgagcttttatctcagactcacaagggaaggtcttccctaggggacaacatgcaaatcccctggtgagtgaagcagtgaagaaatatccagttggggtcgaagagtgggcttcttatgtaagcaaagtgacacagaatatcttttgtgttgatgaaaccaaaataaaatattggtgttgcctggcttagaagggtgacattctgaaataccatgaatcaatgtggaagacactgtgactgcagcctgtcactcttcattgctgatgcaatggagattgtgatgatgaagatgtgtatcaatctttaggtggtgaataggctttcttcttggctccacccagctaattctgaggaggaactagctctcactaactctggtgctcattgatagaatgtctctaagtatcaggatgaacttgaaacagttccagggttatttggctgtggttgcaaggctgatttccctcagcttgtatttcactgtagctggtatttctgggcacttggctctacagctgccattaaatggcactaaatgatgccccagtgaataagctagctgtaatgtgtgcttcgtaaacaaggagaaaattagagttcacgggaagaggaatgcatattccattccattgtatctaatgcatgtcgttgtctttgaagggaggaaggccttggtaggcctctttggattctagaggcaagaaattctgtaccttggaatactgtactggctcactgaccgactgatacacgagtcagccagccttgagtgggacccggggcaaaaaaagggctctgcagcaggttcagcctgtagcacaagcagtcctgcctctcaggccagtgcagatgcagatgaattggacagcacaatcaaccatctggacataattgacacttcgagaacactccaccagcacagcagattgcataatcttttcaaaaaatttactaaaatagaccatattgttaccagaaaaggggattttgattcaaactccaagagaggattcttggatttcatgcaggaagaaattcaaggaaagttggaaagtgcagtgataagagagaatttattgaaaattactccattacagagtaaggcatcctcagaaagcaagcagaggaacataccgtctttaagtttttcttatataggagtgtcgtctatgtaaagactaaactaagctgtgcctacatgcggatgagcagacattacgacaaaatttattattctgttgatttaagggaaactattcttgacattctagtgtgttatcttggaaataaggactgtgtcttgcaaagaaacatattcattggggcaatgtgttatcaaaaaaaagattttatctacttatgatccaataatttagactgacttcaacagatttttttaatgacaaaaagcagaagatggtataagaggaaaatacaatacaacagaaaacacaagctattataactcttgcttcatggatttttacatatctattagacatatgctgggtatatgtgtgcaatgataatctaaaaactggatgctaactagcttaaggaatgcctgcattacactgagtcttgcccacttttccaattataaacagaaagctacagtactatttgtatgagtatcaaaacttttagctgcctgagatagaggtaaagaagatttactgagataaaagccttggaagtagtagagatttgtcctatgatgttatggctgttgctgtggttgccgttgttaggaaatacagtgggagtgaaagcaagattgacaagctctgctcttcctcatactcacaaccccctctagagatggacagatggtggtacaggaatctctgacacctcttagaagtcttttgctctttccagaatgtttcctgacaagtattgttttgagtcacagattaggtgaaactgggtgtagaagaaaggactagagcaagggaagaagttttccatcccagatagttgttgtaggaacagggaaatggaatttttcatagatttatgccacatttctatcatgttggggagagaggcatcaaaccaggctcattcctgaaagaatcattacattattttagagagaaagaactacaaatttcttgtcaaatagatgtttaaaattcaaagctactgatttttttttttttttttttgagatagagtctcgctctgtcatctgggatggagtgcagtggcacgatcttggctcaccacaacctctgtctctctgattgaagcaattctcctgcctcagcctcccaagtagctgggattacaggtgcaggccaacatacctggctaattttcgtatttttagtagagacggggttttgccatattggccaggctggtctgaaactcctgacctcaggtgatctgtctgcctcagcctcccaaagtgttgggattacaggcttgagccactgcaccaggccctgctgatgtattaatattattcatcttcttgaatacaccaaatggtaaagtgcaaatccacactttaaacttgagatttctactcctatgtaaattatactagtgaggaacaaaaaaattctctattggttgggagatgatgtttgacagtggtcagtttgtgaagtggaggcttacgtcacagtactttttacagtattgcatataaacatgaatgtcctcatacccagaagaatcagcatttctcatgagccatattaccaccaagaaagaagtgaattgaagcctgtgactacttgatgaagggtgtatagaagagggaaagaaaaaggacacaaaacacaatattgtaagtggaaaggagaaagtcattacacagcctataagagtaaaaaaataaagagaggatattatgagtaattttatgtcaactgacttgacaaaagtggtgcagggcaggttcttggcttcactaggaaggaatgcagcgtaagctggtggtagaagaaaacagctttactgaggtggcagtgttacacctctgtgactgctcttgtggagcagagctaccccataggcagtgtgccaagagcagtagcatagggcagttttgcagtcatatttatcactgcttttaatgacgtgctaattaaggagtgggttattcagaaataactagaaaatgggcagtaactttcaggttttgccatggcaatggtaaactgatacggcactggtgggcatgtgttatggacaggtgcttccagtgtctcttccttgtgtcacccactcttcaatctggtccagagttgagtcccacctacctcctacctcattgccccttggagattagatactcctccttaatcttaaggggactgcagaagagcagagtcccttttctgtgagtgcttccttctgactttatgggggcaggccttccctagcatttgaagagtaaaaatctttggtatctgaactaaggggcccagtggcaggatgctttcatttgtggggtcagaagacagaatggattgaaagacttatgacggaccgtatcatttttacatgaaatttagaagatataaactttactaggaggttaaacaagaaaattataattggaagagagagaaaaattaatgctcctatgtccacccacagaaccaagttgttaatctatgtgtttgcaaaacaacagccttaagttttctaggttttataaatggaggttgtggtgtccaccttttgtgcctgcaggatctcataagaaacaggtttaatcctggacagctagtggcttcctgaagcctaacagtagttggaataattaagaatatctggtaagggcccctttattctgattattattgattcttgggggatcattttgttgttgttgttttttaagacagagtctcgctctgttgcccaggctggagtgcagtgacacaatctcggctgggctcactgcaacctctgcctcctggtttcaagctattttcatgcctcagccttctgagtggctgggattacaggcatgtacccccatgcctaggtaattttttgtaattttagtagagatatggttttgctatgttggcaaggctggttttgaactcctggcctcaagtgatccacccacctcagtctcccaaagtgctgagattataggcgtgagccactgcacccagccagttccttctttttaagtttttcataagactaagtcttttggttaaacagaggagctattattttgttttgtggaaaagggcactattttattttcataattttaaaagcccttttgaatctggcctacatttcaaacaggggtggagcaaggtgtgtctgactccctgtttcccaccatggcttgagttagattttttttaggtttctttggtagttcctttggccacagagcttggaatgaaaacatttatagccaattaaatattttaggccagacagcatggaggtgggcaggcactcattagcccttaagcaggcagatcatgaggtcaggagatacaggccatcctggctaacatggtgaaaccccatctctactaaaaataaaaaaaattagctgggcatggtggcatgtgtctgtagtcccagctactcgggaggctgaggcaggagaatcccttgaacccaggaggcaggggttgcagtgagccgaggtcgcaccactgcactgcagcttgggtgacagagtgagactccatctcaaagaagaatatatgtatttttaaagctgtataaaaataaaaaagtaaggccccaaataaggttatatatgttaaaaaaccaagtacgtagaataatactatactgggggaaaacattgcttccagagacgcctaagacaaaacactttagcatcaagtccgcaacaacagtcagaaccggaggtgaaaaagccacaggagctgatgaagaagcaaaaggagacagcaatgatctcaggcctttttaaagggagaataagctgaaagcagcaaaacaccacagttgaatctctaagacactaatctcagaagttttaaaagaaactcattattgcatcaaaggcaaaattttctgttttactttttgtttgtttgtttttcgagatagtctcactctgtcactcaggctgcagtgcaatagcacaatcttggctcaccacaagttctgcctcccgggttccagccattctcctgcctcagcctcccaagttgctaggattacaggtacgtaccactgtgcctagctaatttttgtatttttagtagagatggggttttaccatgttggccaggctggtcttgtactcctgacctcaaatggtccacccgcctcagcctcccaaagtgccgggattacaggcatgagccactgcacctggcctgtataattttcaataatgtagcaaattaataacttaagaaaacccagtttcaatatgcagacgattttctagaaagtgactgggccatcattgttctcatctcagatttccacttcctgtatagaaggtgtaagaagaggtagcaagacattatgaaactaaattgtaagcatttgttagtgaacaaaatatgactaaagcgctactttttttaaaaaatttttatttattgttattattttttgatacagggtgtcactcttttaccaggctggagtgtagttgtgccatcttggctcactgcaaccttcgcctcctgggtttaagcaattctcatgcctcagcctcccaagtagctggaattacaggcatgcatcactatgtccagtctatttttagtagagacaacacttcacagtgttggctaggttggtcttgaactcctgacctcaaatgatctacccacctcggcctcccaaagtgttgggattacaggcgtgagccaccatgcccggccttaaagcagtatttttattaaataaagtgtagaagaaaaagtgtaaataaagtgacaaaaagaaaacacaaggccgttatggaaaatgataactttagggaagaaaacaagaaaaggcaaaccaagattcccatagggtgagtctccaatccacaatcctcagacaaatgtcaatgctggaaaccctggagcatccagggagtgaccgaaaataccaaatgctgaaaacccagagtacccgcgtatcagcctatgagtgtcccacaccaaatgccaggaaaccctggagtatccaggggctgaccagtgcagaaaatcctggagcctcagtggggtggccaacagtgagccccaaaggcctggttggggccacagaacaatgtgactctggcttcttagagtcaacagaacaggagaattcttacatccaagtgtcctgccttaaacaattgcacaaacataattagtagggacccaaagaaaaaactgcaaagcaaacacatatatcagggtagaaaataagataaattggctaatggatagataaaatggcattagaggagaaatgactaagagaaggagcaatgaggatgtagtcaggtgtgctatgggggacttcaaatggactatttagccaaaggccttatttcctggatcatctgacatagggcaggtgggtagatgggacacttacaggtgtgcaggagccaaaatggtgccaagcagtgtctaacgtggggcctgtgtgaagatctctccaggccccccagcttgggtgggttgagctcccgtgggtgaactggtgcatgcagcagctggcctgcatgaagcagtggctctgtggccacttacctaactgctcagctccaccgcctgtcaggaaagatgatggctcttaaaacagcctttggctagtgttaacagctctgcaatgttagcaactctgtagctttgctcgctgtagtgctgatccccatcacaccctctctcactgatcactgtcttgccacttctccaatagctgtcttgcccattgctgatcgctatgtccatcttctcacaaaatgccatctcttgctgtctcttgctgtcttgcttctccgctgtttccactgactcactggcacatcaaacgctgcctctcaccatgtcacatttatcctccctcctcattaaacatccatcttcatgtccagcccttgcatcaccaggctgatgtctctgtactgggccaggtactggagagtattgttcctccatcttcaccattaagccatggttctctcaaatcaaaccttctcactgcaccaattttgccaagaaggtttgctgtgcactggttgccaacttacccaaatccggtgacacacagcacccatgcacaaccagttacatgaagtggattactacttacagagagtcagccagagagagcacaaagctgcggggacctgattgacactagactgtgtgtaccccacaaggactgcagctgagggaccctggaatacagcccaccctgggttttatgtcttagaatcacatgacacactgggctagagtgttgaaggaattcctgtttctagtagggacagaaacggaacccaggctgttctggccaatcatgccctatctcagaatgttacatttccagaacattctacagttattccagaaaactacaatcaagaaagggaaggggactgggttgattcaagacaaaatgaaaactattctgcaaataccatagtgaaatcacagctcagtaatctttttgtgactggcttatttcatttagcgtaatgtcctctagtttcatccatgttatagcatgtgtgagaatttccctttttaaagctaaataatatgctattgtatgtatatatcacatttggattaccagttcactcctttgtgaacatttgagttgctctacctgttggctactatgaataattcggttctgaatgtgggtatacaaatatctcctcaagttaatgtcttcaattacttgggtatatgtccaaaagtggaattgctggattatatagtatttccattattaattcttcgaggaattgccatctggtttcccacagcaggtgggccatttacatcaccacgacagtgtccacaggagttccagttccctaagttctcaccatgactggtcattttctgttggaaaaaaaaatcctaataggtgtgaggtgggttttgtttttatttttctaaggattaataatattaagcatcttttcctatgctagttatctaattatctctaaagaatattctccagagaaatgtcgattcatatacttttctcgtttttaatcaggtattttattttaatgttgacatgtaggacttatttttatgtactagatattattaaccccttatcagatatacgatttacaaatattttcttctattccacatgttgcattttcactgtgttggttatgtcttttgatgcccattttacatttttatgtagtccaatttatcttcttttctacttttgcctgtattatggtattaaaggtgttagtattcaaatgtctataaatactgacttactatgctgagaaggtcactctagaccatctctctgatggtggagctaagaattttacactctctcattttgtaccagggcacagtgcagctaggtgagaacacagtggctttctcgagcttatttgtcttgcatttttggcgacaaggattgttgttcacattggcctcctctggcaggtccacctggaaagcattatatttagcaagaaaaaaggaggctgtgaatgatgtcaactgtgtatattccctgttgcaagtgtcaaatccatgaagcataaaaggatttactagaggatattaaattccttgcaaagtgttgaaaaacctgaaggaataggctccaggcaaagcctctagaacaattccaagaatggcactgctggcgcaggctggggaggagctcctgctgcctgagactccacattcaagctgtctcctgcaggaaagagagcagctcttctcactactgccccctgaaggacagcagctctgctatcaactactagagacctgacccctttccctgcagccctgcctgtgttgattatatcttcatgtcagactcatgtagattcatctgttttcaagggtacaggggttatttctgcccaagtccacactgtggctttctatcataaatacacgtttctacacttgaatttccaggaattactagtatcaacagcaaaatgctacaacccaacataaagatttcctttacaaagaacatcatgctccccatgtagcattgtgctccccaaaatgtggggaaactccaatctgttcatcccaacaccatctaggaaaaaatgttcttctctcatgagccattaatctgtctacttattgtttaatttttggcctaaattgtaaaggtggctaaaaatagcactttgaatttttttaaagaaagggtatatagaaaatattaaattatttaaaatacatatatgcatgacacatttagttattgtcaccagcttctttcacatttattttattctgtagtttctggcaatactttctctatggtagagtctggaaatgctactcctcatgtccttggcttcctaagtcccagatgtggtgaagaatgcacatcagctgtgttactacagaatgcttttggattgagatgggggaggggacgtgcttgatctcactcaaatgtgctcaatttcctggtctgggtcacagccaggcagcccagtcctatgggcacaatatcttcactcgccaggtttctatcaaaatgagagtgtccttcttgactgtggaaaacacggggcagggagaggatcaagaaatagcaaaaggagtatttggacttgcctgagctgccactctggtttccccaaatgttttcattccatttcattcatgataataaacacctttctgcctaaccagccataatcacttttcttagatccagctgattcagtgataaaactaaagggaaaaaataaatacagttttcaacgtttaagctgaccaggtggctgtctctggtgtttatacctccatatcccactatgcatttcatcttccctttgcctcactggagatccaagtgcagggaatgcttcacgtgactgtgatccctagaacttcatcttcatgactgttgaaatcttctctgagttttaccagtggaaatggcaataaatagaaagattccagaaggtcccctagggtccatattttctgtacttcttctctaaaataagtaaaatcaattccatttgctcttgctttatattggctacatctatgtgcccaggacacaccctaaagccctgtgttgacaacttatccagtattgtattaagtctaaatggtcacatgcttatcatatcatttcttccaatttcatggaataattgtcatgtcaactctttggattaagaaccatcaaccagataaccacagccctgaataaatagaaacagaatatttcaagctgttcagttggcataacagtgatgagtctatagctcattttcaagatataaatattctatttatgggagtaaaagcacgaatcatggttagtgtttcagagcctccaccacatctgacagcatagcaattcaacagcacaaggtttgtgtgccagctgtgcctgactaataatgtttttttcccctgtctatagggaaatctgcacctgtgcacatgacaagagcatgagctacacttttttcactttttctgaggtaaatacattgcttgatccaaaaccgtattatggaataatttcctgactctgatgaaagcatttggaaaatcctcaaataatatttgtgcagaaatacaaccaaaaagaaaggcaaattcatatataggaaaataaccagtgctctcctcatgttacatgaggtccactagtatcacctgaccccagctgttcatctgatccctgatgtgttgtacaatgttaggggttcaggaggggtcattcttcttggcaaatgaggtgttcagaagagccagtagccctttaagtctcagttagttgaaattcataattgagtccccaaagggacctccataacattggttcatgagactccctggtaaagctgggaaaggtgactgactgaagtccatgtgttgaatcatcctcattattaaaagcccctgctcattaatagcattttgattaatattcactgggaaagcattttttttttattttggctcatctttgaaaagtctagtcatagcttttcaatcactttgtctgcaatcgttttgttgcatttctttgaaggcctgatgatctgtcaaaaccaacagccaatattattacattgccgttatgttgggaaaagctgaatgttgggagaagctgaggcagggcttgcatgtctgacgtaatgtaaaagagtcttggaacacgtccggggtccagggtctaaaaccccttgtggcctttagtacaccaagctctgtgctaaagggtggaaggctaccctgacgcaccataatctaagcccagggcataaaatcccttgtgacttggatagaatccaggactcgtggctctggagtgtgtctacacttgctggctcctttctctttgctctccaaggatcgattgtatcttgagttaaaagaacctgctctccattatctcaagtagtagagcaaatgctaaaccatcacaggtgtaaatcatgtgcttaatgcaatgcatccttttggcctccacattcttaccacgtgtttctttgttggattaccaataaatagcatgggatcccagggctcagggccttcttagcctccatacactacgatggtccctggtgcccacatttctctctcaaactgtctttttctcaatctttgactccaccagactttgtcacccccacgacctggtgttgggtctgatcaccccaaaactgttatcgttgcaatgtgatcatcagatataacccttgcagtttactcattgttatgatttttacatttgcagggcttccttgacaatggcactaatgtgacgccatccagcatccattattgtgagaactctatttggaatatcaccattgtgggcatgaacagaatggagactttcataggatgcaatgtttaatattcaacattagtcaaaatttgttctagtcctacccttggagctccattgagttggaaaaatataaataaatttattttaaatataatataaatgtaaatataaacaaatttaaatataatataaatataatataaatatacataaatttaaacataatataaatataaatataaataaataaataaacaaaaaaattttctgtagcaagagtaagaactacatgtggtccagaataccattattttatggaaggttacaaaaaattttaaatgtatttaattcagataagaattttataaatatgcatatattgcatatatgatagaataaatgtacttaaatatgaatactatatatatttgtagccaacattttatcaaaaacatatatattcacttctatgtatcttatatacatgtatgcatacttttccgtaagataaattttaattttttattgaaatactaattagttttaattttgtctttaattttcttttaataacttcataatttgattactggatattcacatttaaatcaccaatttaagaaaaaatacatgtgtgtacatataggtagaggtgtaaatactgtatcaggaagcttttatgcattactgattggtaactggttaaatacacaactcagtgactgataacagtaaacatttgttttcatgttcacggatgctcatgttcacaatcctctgactgatcaaggaagggctcagctgagtggatcctctgaaggacacagacctcatcttcagcctatagatatcaattgtctgaggactaagctgaacaccagtgactacacatgatacaagattcttgtggcaggtcacaggagtgaacatcccaaaccaaactggacagttgaatttaagtccaataatttctaacatagcttcagatatttaaaatatattcctttatttcagtgagtacaaattttcaagaaaatgtttactccatttaattatagaggtgtttgatcattccatggacaaataattatgttttcatcctttacaatcttgaaaatatttgcaaatgtaaatttgcattaataagaaaataaagctggatgtgttttcaacatgtggctttaaatataattttttaaaatggcctcattgggggaaaatcattttaacttatatgaatatccttttttgcctctcttgtgttctatagagtggcccaataagaggtcctcccatgagatttggaatcaggaaaggatggctcaatattctccattggtacctaggacagacacagggacagagatgaggactggagaaacacctggaaagatgctgtaggaagctgagagcatcagcacccccacccctaagcttccagacaggactgaggaccacatggttagatagcccatacttcaggggaagatgcattcagttttctgagggagcaacagagattcctgcttctaatatcaactttcctgactactatatccttggctttgaaaggttgtagtgggaaagttaatcgtaggaattgggtcattcttgtcatacccaacagagccaagaaaccaggagggaaagacactcagggtgcaaaatattgtctgaagaatgtaattgaaataggccctattatcccatggaactaatgtttatggttttttgaaggaacatagaaattgactcctccagtcttaaaaactcaagatagttatatttttcttatctgaggagttcttttgtcaggaaaccaaccatcaggcctccagatactatcaaaaggagctgaaacttacatatcactgaatcgggacagtgagacatcagactcttcacccattgtgattgcctaactgacctcctgcttcctgttgaccaaatcatcttccttacccctccctaattcctgttttcccacatttcttccctgatatatatacccctcattttagtagttcagggagatacatttgagaatggtgtcccatctcctcggctgcagcacctgattaaagcctgttccttggcaatacttgtcttagtgattgtttttctgtgtggtgagcagcaggatctacactgaatccctggcatttcagtaacaaaattctctgcaagcttcactgcctttggcttattgtaacctgaaatcaaatttatccacaacttctgatataacttgatataactgtaggattcactttgtccaccactgcttcccagtctgagcttgccagctcccaacccttcctagtgcccatgaactttctcaaagagccataggtaacatgttccctttttcgtaaaactctaaccttctctttgttcttccaacatattgaagaccactgagttttcctgtatgccccatttggcaaatatttctttgcacgtaaaacattaaatttagagattcatctctacattttatttagacttcagtagtttagactctaattgtctgtattaagacaattcctgctttgaatatctatagtggcctcttctctgttatataaagtccagctgaagccataaactagactcttcaggtgtcatgatctctgtctttattaaatcaggagaggcattgctagatctgtgcagttggggctgagaaagagaaaagaattagggtgcagaggtgactccatgtccccctctaccaacaccatcagagtgtggctgcatctgaggaccactctcagctgatagaggcatcaggaggagcagctggggcagccctgcctcacacatctgcttccctgggggtttatgttcgggtgtgtaacactgtgggagaataactattatactgttggcagtaataagttgcaaaatcatcaggctgcaggctgctgatggtgagagtgaattctgtcccagatccactgccgctgaaccttgatgggaccccactttctaaactagacgccttatagatcaggagcttaggggctttccctggtttctgctgataccaggccaaccagctactaatactctgactggcccggcaagtgatggtgactctgtctcctacagatgcagacagggtggaaggagactgggtcatctggatgtcacatttggcacctgagattggaaatagaaacacaaatattcatactattgatcatattataggaagacttccctgaataaccaggcagtactgagcacactgggctgagtaaattcctagtgttctccttccttacctgggagccagagcagcaggagccccaggagctgagcggggaccctcatgtccatgctgtgtcctgactgggtctgactcctgcacaaagtgtgaccagcctattaataaggcttcagggcaggaggttgtgctctgggaacatgcaaatgagcaggggatggggcaggctgggcacagctgcagagctggctcatctcagtaactcagcaccagctcagtgtccccaggtgtcccaggtaagaccagggtagcacaaatttgtctgcagagaatgtgtttctactggggactattttattatgagaaacaatttttaggtatttttttgagaattttaaatattcctcaggagccgatagagtaatgtatttcattggtgtatcaggattatttaggagaatattcttgtttgtaggaaacacatagtaaaatgttagatggtaggattctcaagtcttcaaaagactctcataagattccgggtagggaagggggtaattgtgctatacctgcaacatttctgtgagtttaacattgttcctttctaaaaaaaattaaaaataaaatgtatcggcatgatgctatatatttgtaagtattaggtaatggtgttatgcctttgttcttactagtattagatcaagcaatttattacagatatacaaagatgataccgtgttgtctccatgcatgcagcactcacagatccaccactatcaagaactgcaggtctctttaatacccagagactaaatgaggtgcaccttattcttgttttgggtaccttcatagtctaccttcttttctgccattgggtattatttcccaaagttcatctgtcttagtgagggtggccactgcacggagcatgtccctgccatgcaccatcaatgacactttcttcttatactttttatcagtgcatggggacatcatcctgacccagacaccagcctccctgttaacacctttaggaaaaacatactcaatctcttatcaagcaattgtctatgtacatggagaaatcagttggatccagatgaaactggacatggatttgcattcattatatctcatatctctaatgtaccctgaacgtcccagcctgactcagtagcaggggaagtggatgtaaccacatcagcatcagtgggctgcagcctcgggctccacaaaattttactgatgcctgactaggggagcaaaatcacagtgctgcagcccatgcacaaacatttctgctgctttgtaagcagcctgaattttaagggaacttgcttatattggaagaaaggaagaaagttccatttgtcctctaaatgtttgctgaaaatgaaccgacaaaagaataatgaataagagaaaaggcaaacaaaattcacttagagtgcggtgggatatcatagtggggtgattacccagataactcaatgagatccagttgttcatatttcctttctagggaagagggaattgggaagtgtaggcaacctggagagaatagatgaaaaaagaaatgcatcctcaaaagaacaggcaatagcctgcctggataaagcatcaacttgcagtctcttctatttttgattcatgttttgtgttaatcttccctgatataaaatttcccaggaagaatttccttgacaattgtttttcttctggagaatttgcttttaggcagataagggatatttaggaaaagacttcttgtgcatttgctgctttctaaatgcctttggctttacataatcatcataccaatgcagcatagtttgagatgttattttctggattcctttacttgcagccacctgccaagatcctgtttcagagagatgcagctgcagattgagtgagcagttgacccctgaacaacatggaggttggggcactgaccacaggtgcagatgaaaacctgtgtagaagttttgcatttctaacttaagtactaatagcttacttttgactggaagccttagtgataaaataaatagttgattacacttttttacattttatatatattttatactctattcttccaataaagtatggtaaagaaaaaaatgttcttaagaaaaccataaaaatgagaaaatatatttactactgattaagtacttgctttcaggtgacacagaagaaaatataagtgtatctgcaaacttcaaacccaagttattcaagggttaactgtaccatgatgaatgtagcagtccccatctgtagtctagggctttctcctttgctgtacctctgctcacttccaatggccatatatatgtcttatgttctttatgatcttgggcagagaggtctgcctacatgcattgctggccagatgtcctggaatgtgtatctctgaggaaagtgctatggtttgactgtgtcctccaaaatccatctgttgtaaagttcattctcagtgaaatggtttttgccaggtgggccctattgggatgtgtttaggtcatgagggtggagccctctagtggaatacattaatgccagtataaacagggtttatagggctggaatctttctctctcttctgctggtctgtcctgataagacatggccttccttccattgaaggactcaatgccccaggcatcgtcttgaaagcagagaaagctgaccttaacctgcccatgccttgatctcaaactttccgtactccagaagtgtgagaaaatatatttctgttttttatgaattacacagcgacaaggaacctgttatagcagcttgaaagagaacaggagagacagctcacaatcagtgaggataagatgaggtatatacatatcccagctttctcatctctcaggtggaatagcccagaggaatttagtccatgtttccacatgtggttgatcttcagttatcctgagtcaggtgggtggttgatgtgtcttttaccattcatcttctgctcctgcctcactttcttcctttcctcccagtgtaaatttgctgcctaaacaggaatactcattgctggtggacccaaaataagacagaaaaaaaaaatcattgtacttttgtatgagggatatttctcatctgaattcttatcacttctctttctttgacatctaggaatattcagaaaacacttttttttaaccaatctattttagattgaatttattgattttttttcctgtgtgttttgtgaaccaaaaattaagttgtaagccaccaacgagctaaatggactccccttttggcagagagaacttcaaagaaatctgaaaaactaggttaggccatgactggcaggtgggtttggatgtgtctcattatgctctcttccctttggagttcaggcacaactgaccagcattatcattataacagagatctttggactgaggaaacagatgcttgtagcaataagataccatactccaacatgacagataataggccctgaagaaaatctaaaaattttactctaaaaatatttctttttctttttcttttttttgtttttttttgagatggagtcgcgctctgtgcccaggctggagagcagtggcgcaatcttggctcactgcaagctccgcctcctgagttcatgccattctcctgcctcagccttccaagcagctggaactacaggtgcccaccaccatgcccgactaattttttttgtatttttagtagagatggggtttcaccctgttagccaggatggtctcgatctcctgacctcgtgatctacccacctcggcctcccaaagtgctgagattacaggagtgagccaccgcacccaacctatttctctgaaatattctgaagtggccctgcaaagctgcgcgttgtgggagaaatttgcattctgtagagaatctcctatgcttactaatcattttccaaaggtctgactttttttttttaaggtctgacaagcaacgtctactttttctgctacccataggattcatctacacgaaaagaaccttggcttatctaaactcaagcacaccccgttatctaaactcaagcatttctttatggtgaattcaactctttaggcagagcttaactctttcaaccagttgccaatcaggaaaactttgaagccacctgtgacctggaagcccctgcttcaagatatcccacctttccagtacaaactaatgtatatcttatatgtattgatttatgtctttgcctgtaatttctgtgtctccctaaaatgtataaaaccaacgtgtaatccaaccaccttgggcacatgtttacaggaccccctaaggctgtgtcacaggccataatccttatctttggcaaaataaatctataacttgattgagacctgtctcagatactgttttgcttacactgggtcacaaaatttaaaaatcctctaaaactatctacacatccataaatctacattagaggcagtggagtgagcacactccaacagtcaaaactcacaagttagaggaacctgagtctaagattttgtccagctctcttgcttcataaaaataatttgtgatttttttaaattttactctagagaaggacaattttggggaatatgtttatggtcagtggaatgaataatgtccccaccccaaaagatgtccatatcctcgtctctggaacccatgttatacgagttattaagaaactattttaggcatatagagaggaaacagggtccttgggaaggttttgtttcttttaaagcagctccagaaatgtttcttgtttagcaggaaagccctggctcttagagctggtccggcaagcttttttttcttttttagagagggagtctcgctctgtagcccaggctggagtgcagtggcacgatctcggctcactgcaagctccgccctctggtttcctcatgcctcagcctcccaagtagctgggactacaggcgcccgccaccacggccggctaattttttgtatttttcagtagagacggggtttcactgtgttagccaggatggtctcgatctcctcacctcctgatctgcccgcctcggcctcccaaagtgctgggattacaggcggcaagctttgatatacaaatactggccattagaaactgggtccagccaaacatggagattcccacattcttcttctttttttttttttttttttgagatggagtctcgctctgtcgcccaggctggagtgcagtggaacgatctcggctgactgcaacctctgcctcctgggttcaagcgattcttctgcctcagtctcctgagtagctgggattacaggcacatgccaccacgcccagctactttttgtgtttttagtagagacggggtttcaccatattggccaggatggtctccatctcttgacctcatgatccaccttccttggcctcccaaagtgctgagattacaggtgtgagccacggcgtccagctcccacggtcttcttccttgccccgacatttgcctgacaacatggctgcccccacatatccccatgtgtgtagaactttatggcaccctgcatttgcatattaaaacactagggtgggagggccagttttttctcaagctacatgaatgacatgcttggtaaaaccaatcccctaagccctatgcaaatcagacaccacctccttcagcctcctcatataagcagccacttttccaccgcacatggagttttctcttagttctaatctcccctctctctgtctctgtacggtggagctgttttcttcttccttccttcttgcgtattaaacttttcgctccttaaaacaaccccacgcatgtccgtttctttttaaacaaacccgcgtgagactaagaacggtggtggtcctccagtcatcagagccctatcataaggattctaccttacatagcaaaagaagaacttgacaggtgtaagttaacgactttgagaataagcaacctggttatccagatgaaaccaatataatcacaaaggtcattaaaatagaggaggaggcttgcagagaggagctgggacaatatggaaggatgtggtttgaggagggaaggggccatagagccagaaatgtgggagcacctggaagataaaagcagaggattcagttctttcctctggagcctccagaaggaatgcagccctactgacaccttaacattagctcagtgagaatgctgacctccagaactacagggtaatacatttatgttgtgtgaagccaataagactgtggcgatttaaacagcagcattggaaactaatgcaaggggaagaaatgtctttcagctcactgagcgcgtgcttgtcttctgttcttggaaatatttccaccttgttttctggtgtcagttatgacaagagacagagaaaatttttccgagagaagagctaccacgagaattcgtttttagctagaaaatctcctgggtaaaatctcatgattatctgttatacgatctgggtatcacagagtttggggtcagatctcacaacatgtgataggaggaagagggttttgttagtttgttttcatattgcgagggaaaattagattttcaggacacaatctgagaaggacagacagagtcagagatattgtaagagaaagaggagatgtggaaggagtcagggcaatgaaacacgtgtcccagctcccaaatctaaaataaagtcattgattttacaaggtgaagaaaagctcttcaccttccatcttcttaggaaggatcaaattcttcccagagtccctgcccctccttcacccccctgacattgcattgtggagctaatcacatgtgcccttaatccctgctcctgtcccaggctgggagaggctcactgtcctcaccatgcccagcaggctagagctggtgccctaagcaccaaaggagaagaggatgatttctgtgcaggcaataagagctttaccgcattttacatttccctaaaattctaagcaaagttctgtggagagaagagaacatggggcaactttatctggtggggctggaagagaccaggctctgagaatgacaattaattcacatttctacttttccagatgccaaatgctagctttatcaattgtggaaatgtggactttgagtttaagaacaggtttcaggtactgcaataattgaggagacatttggaatagagtccttagtctagggctaaagtcagactggcagtgcctgagagcttccaggcgctggccctgggctgtgagggaagcagcagttctcctgagccacagggctgaggacctgggagcaaccacaggccttggccacagggctgcctggcaggggcttgagggaaggaaactgctcacaaattcacaggagctgcattaagcatatatcccgcagcctggcaagagtgaaagtctcagagacccagaccttagggctggggctgggattctgggctggctgctgtcggctctgccctcccttgtcctgaatgactggcaccctgctggagccaaaaatggagggtcggccaatgtcctcaaagtctttactcagccagaccctgttctgcttggaaagaaaatgaacacatggtatacaaataaacataaaatcatgtgtatctgtaataagaatttctaatataaattttacatattgaatacatatattttagaaataagttgtacttatacatttgcctatactatgtgtctatttatggataaatatgtggtacatgtttatatataaagatatataactttggttgctagtataaggtatagttttaaactttaataaagtaaacacgaacattgaaaatgagcactgggtgcaccacttcatggccctcctcactccagggcctaagggtgataaagctcaggaccctcttccatgtcccccggcatggacagcagtgaactacccattgctgaggatcatgagtgacctgagggggatctgcagaatcacagagcagcagatgcccagaagattgatagtttggaccctgaatggagggacattttgatcacagggctcagcatagacaagtactcttctggtcatttctgtcaaacaaaacagcacatgtagctcagaggctgcatgatcacaggatgaagcacctccatgagtcattgccagcttcccctctgactggggtgatgtgggatctctctgccccactttcatggctcaccagctgctgggactctgttgacagtggtctacatctgtcccacgcacaaacttctcaatagttgtcattttacttactggtctccaataaccacaaattgccagccatgacccttccacaaaaattgatggagtggggttggaactatgggttcagcaatgtgccagggcatgtatataagagaaacaaggtgtggccagcccatgtctgaagtgaggatgaattttcaccatgaattcggagtaggaggtggaagaaaacatcctgacatgctccaggcagtgatgcccacaagatacactagaagcgcccacagaggaggtgggaagggggtgtgagaaaaagagggagtgtgaatttacaggtgtctccagactgttcacctgaaaagagatcagacccttaacaacacctgggaccccaggcagagctgttgctatggaagatttgtgcaggacagggataggaggagggagcacctacctgtgatggcatcttggttgctgttggccagaatgacatcttttcaggcctactgtccctgacccaggcagggatcatgtccaggagggcagcaggagctcagagccaggccctggttctgctagtgccaggctaggatgttcttcatactctggccagctctacaggtgacagtgaccctctcccctgagacacaaggaggaggacaacgatggcatccacataacatgctcactgtcatccaagtgggggaacaaacatgcagatccccaaatattaataccgagtttgtagttcctccaacttggtgcaattctgatcagaaggaaaaacaggctaacaacttcatcagcagggaaagttcatgtttaatacaaactatctgaggctgaagcctgagtttcccttcctcaccaggcagtcaggacagcaggagcaaaaggagaaaagctgggtcccaaagtccacaaggtgcctcctgagactgatcctgcttagagaaggtggtgacagtggatgagtcttctgggactcccacaccaacataccctgagctggatggcttgagccatagacatttattgctaatttattaaacgtttattgtgaatgtattagaaccctggaaagttcaagatcaaagtccagaaggatttgctttctggtgagaaccctgcttcttgttttcagatgtcacccctggatacatcctcacgtgtgttcagcaatgtgccgggcatgtgtaagtaggagaagcaagtacatgctttcttcagtgcatgcttggaggctggtgaggggttaaggaacagatcgatgatgtttatttttactaggacacaaatcctattaaatcagagccccaaggttttcacttcatttcaccctaattaccccttcataacctctatgtctaaatacagtaattttgcaggttggagattcaaaatatgaatttgtgaaacacaattcagttcatagcaggtgtgctttgaggacatgcccaaggcagtaggaagggcaaggcgaggcttccagtctcagagcacagaaggcgttttcccaccactcagcacactggcagctcctcttaggtgatccaggtcacacatgagacgccattcccgccttgggggctgcctgctgataatggaacaatatcacccttaattttcactatttctaagatcagacttctattttatgtttattatggagtttgtccaatggccaggtttgtaacataacctccaatgtttggtttgtgacataacatcttatagaattttagatgctggtttccagtgagacttgatggagttttttcatgggttttcatggagttgatcttattacatccaccattatgctgcattctgtagggaacacaaaatgattcctctcctcaataaaccagtcacctagttgaagataaagggtgttcagaaaagatggtcacaaaacaattaggggctagattctgtgatccatgtgagatgccaatgatgtgattctggaaagcagaaggtgaggttgtgagataccctgcagcacataatgcccaaggctagggtggcgagtagagggcccctggtctggatctgtctacccagcttcattcctcccattcgtgaaacagtggctgcaccagccaggaagcatctgagaccacctgattctctggaataatagctgctgaggtttgtgctgtgagctataacactgtgagtctctaactgtaaccatttagattagcactaatgaaaataatttttaagatggtgaaaatgtctatatctatgctttgcaagtgtagccgttatatgtcatatgtgactcctgaacacttgaaatgtagtgaaaacaactaaggaactatattgttaattttaattaattccaatatacatgtttgtggctgggtactgctaatgttggccatgtgagtcagggaagttttagatggtaataaacagcaatgtcatcaggacaaccaatctgctaaatgttaagcaaagatgatcccaggaccattgcaccaagctggagtggacaaggtggaaagagcacgtaggtggatctttggaacccagattctgcttcctccaggtgaatgatgtaaactctctgtcttgaagacactgacattgaagctagcgactggggagctgagtgtttctcctggaagctgcagtggaaacagaacatagatcttccttagtattactcatgtccctctccataggcttcccagcagagaggtgctgtctgatcaagtgggaggtgaatgctgtgctccctaatcaatagtctttctcagtcccatgggacatatgaaccctgtcacatgcagcccacgcagttgaagccagagccccatgtccagtgtccagtgttgcctctgccttcggtgatcccaccctacaggacccagtgatgaaggcttgagtggcagggaagagctttggggagcctgccaactagcaataagggtgcagacttgggcttccagcttctgagcaagggaacattgtatgtcctaggtgtgatccaggtcaaggtgtttgataaaagatattacaataaattattttcttaagaaaataaaaacacagaaggcatctgattattataggactgtttgggttttataccactaaagtggtaaaaataaatttttcaatgcgcagtggtttatcaggaatctcccagcccctgcccttcccgtgatgattctgtagtctttgcaggttgtatggtcacttggtggcctccttaccgatcagatgcatctacagcacaaccctaagatcttccccgattaacatagatgagcaacttcaacctccagataccacataccattggctgatttttatgcaatttatcaacactgaaagtattctattccatttcattatgtagttattattctgtgcatggctcattcccctactgagtatcagtatttgcgatcaaaaattgttttatttacttacatgcactaaaccttaaatgatagcatttattagttctgaaaactctgacattaagttaaaatcccttaaaagcaactatatgcttctttttttaattagaataaatatggtgcaatcacctcaactaaggatactaaactacttttacagttgaaaatgattaattggacatggggaaacatattgacaaaagtaacaagcattattatgatgttgaataaacacagtttgcatgtaaagtgtacagttatgattaattgtattaaaacacaggaggaagaaaggtggggattgctggattggttggtgattcagtccttagaagcaagggggagctgatgagtgatctcaggcaggcatccaatataaggtccaaatatgattaattacaatgttcttttccttaaggtttgatattttaagctggtcctgctggggaagttttgagcacattcatggaatatgtggaataaagattaaaaacagtatatttcaaaatactcttaaaaagctcagaaacacccaaagaaaactattttataaaatatcatgccttcctcgcccattcttgatatttgtgtttaaccaagcatgactcacaattcaacttttctccacattgttgcctagagtgttgaagaaattcctctaataggacagaaatggagtcaatcttgcaatatctggccaatcgtgttctggccagtcttgctttatctcagaatgttacatttccagaaacttctacagttattcctgaaaactacaagcaagaaagggaaggagactgggatcattcaaggcaaaatggaacctgttctgcaaatactgtagtgaaatcataactcagtaatcgttttgtgactggcttatttcacttagtgtaatgtcctctagtttcatccaagttgtagcatgtgtcagaatttccctttttaaagctaattttgcctttttaaagctacaatatgctactgtatgtatataccacatttggattaccagttccctcctttgtgaacatttgagttgcttctaccttttggctattgtgaataattcggttctgaatgtggatatacaaatatatcctcaagttaatgtcttcagttacttgggtatatgtccaaaagtggaattgctgaattatatagtatttctatttttaattcttcgaggaattgccatctggtttcccacagcaggtgggccatttacatcaccacgacagtgtccacaggagttccagttccctaagttctcaccaagactggtcattttctgttggaaaaaaaatcctaataggtgtgaggtgggttttgtttttatttttctaaggattaataatgttgaccatgttttcctatgctagttttctaattatctctatagaatcttctttagagaaatgtcgattcatgtactttcctcatttttaatcaggtattttattttaaggttcacatataagacttatttttgtatagtagatattattaaccccttatcaaatataagatttacaaatgttttcttctattccacatgttgcattttcactgtgttgattatgtcttttgatgcccattttacatttttatgaagtccaatttatcttcttttctacttttgcctgtattttggtattaaagttgttagtatttaaatgtctataaatactgacttactatgctgagaaggtcacactgcaccatctctctgatggtggagctaagagttttacactctcccattttgtaccgggggacagtgcagctatgtgagaacccagtggctttacccagcttatttgtcttgcatttttggtgacatggattgttattcacattggcttcctctggcaggtccacctggaaagcattatatttagcaagaaaaaaggaggcagtgaatgatgtcactgtggactgtgtatattccctgttgcaaatgtcaaattcgtgaagcataaagggatttactagaggatattaaattccttgcaaattgttgaaaagccttaaggaacaggctccaggcaaagcctctagaacaattccaagaatggcactgctggcacaggctggggaggagctcctcctgcctgagactccacaacattcaagctgtctcctgcagaaaagagagcagctcttctcactactgcccccagaaggacagccgctctgctatcaactacgagagatctgacccctttctctgactgcccatcagatgtgttactacagagtgcttttggattgagatgagggagggaaaatgcctgatctcactcaaatgtgctcattttcctggtctgggtctcagccaggcagcacagtcctgtgggcacagtatcttcacttgccaggttcctataaaatgagagtatctttcttgactgtggaaaatatggggatggtaagggtcaaggaataggaaaaggagtacttggagttgcctgagctgccactctggtttccccaaatgttttcaatccattaaattcatgataataaacacctttctgcctaaccagccataatcgcttttcttagatccaaatgattctgtgataaaactaaagagaaaaaataaatacacttttcaacgtttaagctgaccaggaggctgtctctggtgtttacatgtccatatcccactatgcatttcgtcttccctttgcctcactggagatccaagtgcagggaatgcttcatatgactgtgatccctagaacttcatcctcatgactgttgaaatcttctctgagttttaccagtggaaatggcaataaatagaaagattccagaaggtcccctagggtccatattttctgtacttcctctctaaaatatgtaaaatcaattatatttgctcttgctttatatgggctacatctgtgtccccagcacacaccctaacgccctgcgttgacaacttatccagtattgtattaagtctaaataggcacatgtttatcatattatttcttccaatttaatgagataattgtcatgtcaaatctttggattaagaaccatcagccagaaaaccacagccctgagaaaatagaaatagagtatttcaagctgttcagtttgcacaacaatgatgattctatagctcatttacaagatataaatattctgtttatgggagtaagagcaacattcacggtgagtgttgtagaccctccgccacatctgacagcatagcaattcaatagcacaagggtttgtgtgccagcagtgcttgactaataatgggttttttttctatagggaaagctgcacctgtgcacatgacaggatcatgagctacactttacttcactttttttgaagtcaattaccttcttgatccaaagccacagtatggaagaacttcctgactctgatgaaggcatttggaaaatcctcaaataatattttatgcagtaacataaccaaagacaaaggaaaattcatatataggataataaccactgctctcctcatgttacatgaagtgcacttgaatcacctgacatcagctgttagtatgagccctgatgtgtggtagaatgttaggggctcaggaagggtcaattttcttggcaaattagtgttcaagagagccagtagccctgtacatctcagttagttgaaactcatattattgagtccccacagggacctccgtaacagtggttcatgaggttacctgggaaagtgggcaaaggtgactgactgaagtccatgtgttcaatcatcctcattatgaaaagccccctgctcattaatggcatttggattaatattcactgagaaagcatgtttttcgattatggctcatttttgaaacatctagtcatagctcttccaaaatgactttgtctgcaatcatcctgttgtgtttcttttaaggcctgatgatctgtcaaaaccaacaaccaatattattaaattgctgttctctttgcaatgtggcaatgtgatcatcagatgtaggccttgcagtttacccacggttaggatttttacatttccagggattccttgacaatggcactaatgtgacgccatctagcatccattgttgtgagaactctatttggaatatcatcattgtgggcatgaacataatggagactttcataggatgcaatgattaatattcaacattagtcaaaatctgctgtagtcctacccttggagatctactggtttggaaaaatattttaggtaaggacaacaatttggtaaagttttaaaaataaaggctaaaaagaaattttctttagcaagagtatgaactatctgtggtccagaataccatttttttacagatgcaagaaaaaattatttaaatgtatataatttagataataattttgtaaatttgtatatattgcatatataatagaataaacataattaaatatgaatactatatatacttatagccaacattttatcaaataaatatatattaacttctatgtatcttatatatatgcacatttttccataaataaggtaaattttaattttttaatgaaatactaattagttttaatttcatctttaattttctcttaataacttcataatttgattacttaatgttcacatttataccaccaatttaagaaaaaacacatgtatctatatataggcagaggtgtaaatactgtatcagtaagcttttatgcattaatgattgataatcggttaaatatacaactcagtggctgataactgtaaatatttgttttcatcttcatggatgctcatgttcacaatcatctggctgattaaggaagggctcagctgattgattcctccgcagggcactgagcttgtctttagcctacagataccaattttctgaggacgaggctgaacagcagtgactacacgtgacacaagattcttgtgacaggtcacaggagtgaacaacatcccaaaccgaactgcacagttgaatttaagtccaataatttctaacatagcttcacacattttaaatatattttttgatttcagtgagtacaaattttcaagaaaatgtttactccaattaattatagaggtgtttgatcattccatggacaagtaattatgttttcaacctttacaatcctgaaaatatttgcaaacgtaaatttgcattaataagaaaataaagctggatgtgttttcaacatgtgcttttaaatataatttttgaaatgacctcaaagggggaaaatcattttaacttatgtaactatccctttttacctctcttgtgtcctatagagttgcccaataagaggtcctcccatgagatttggaatcagaaaaggatgactcaatattctccattggtacctaaggcagacacaggaacagaggtgaggactagagaaacacctgaaaagatgctgtaggaagctgagagcatcagcacccccacccctaagcttccagacaggactgaggaccacatggttagaaagcccttacttcagggacagatgcattctgttttctgagggagcaccagagattcctgcttctaatatcagctttcctgactactatatccttggctttgaaaggtcatagtgggaaagttaatcataggaattcggtcattcttgtgatacccgacagagccaagaaaccaggagggaaaggcactcagggtgaaaaatactgtttctagaatgcaattgaaataggccctattatcccatggaactaaagtttatggttttttgaataaacagaaatcgactcctccagtcttaaaactcaagatagcaacatttatcttacctttcttttttttttttttttttttttaaatttcaggaaagcaaccatcaggcctcccagatactatcaatttgctgaaacttatatatcactgaatcgggacagtgagacatcagacccttcacccattatgattgcctaactgacctcctgcttcctgttgacccaattatctttcttaaccctccctaactcctgtttttccacatttcttccttgttatataaacccctaatttcagttggtcagagagatacatttgagaatggcatcccatctcctcagctgcagcacctgattaaagcctggggcttgaaaatacttgtcttagtgattggctttctgtgtgacgagctgcaggatctacaccgaatccctggcatttcagtaacaaaattctctgcaagcttcaccgttttggtttattgtaacctgaaatcaaatttatccaaaacttctgagataacttgatataattctaggattcactttgtccaccactgcttaccagtctgagcttgccagctcccaacccttcctagtgccaatgagctttctcaaaagagccataggtaacattttccctttttcataaaatgctaaatttctctttgttcttccaacatattgaagaccactgagttttcctgtatgccccatttggcaaatatttctttgcaaataaaacattaaatttagagattcatctctacattttatttagacttcagtagtttactctaattctctgtattaagactatatctgcttcaaatatctatagtggcttcttctctgttatacgaattccaactgaagccataaactagactcttcaggtgtcatgatctctgtctttattaaatcaagagaggcattgctagaactgtgcagttggggctgagaaagagaaaagaattagggtgcagaggtgacttcgtgtccccctctaccaacaccatcagagtgtggctgcatctgaggaacaatctcagccaatggaggcatcaggaggagcagctggggcagcccagtctcacacatctgcttccctgggggtttctgttcgggtgtgtaacactgtgggagggtaattgtaatcttgtagacagtaataagttgcaaaatcttcaggctgcaggctgctgatggtgagagtgaaatctgtgccagatccactgccgctgaaccttgatgggaccccactttgtaaactggatgcagcatagatcaggagcttaggggctttccctggtttctgctgataccagcctaaatcatttctaatgccctgacttgcccggcaagtgatggtgactctgtctcctacagatgcagacagggaggatggagactgggtcatctggatggcacatctggcacctgagattggaaacacaaaaacaaatggtccacacaattaatcatgtagtaagagaatttccctgaatagccaggctgtgctgagcaccctgggctgagtaaactgccagtgttctccatccttacctgggagccagagcagcaggagccccaggagctgagcggggaccctcatgtccatgctgtgtcctgagtgggtctgactcctgcacagggtgtgatcagcctgttaataagtcttcaggtcaggagactgtgctctgggaacatgcaaatgagcaggggaaggggcaggctgggcacagctgcagggctggctcatctcagtaactcagcaccggctcagtgtccccaggtgtcccaggtaagaccagggtagcacaaatttgtctgcagagaatgtgtttctactggggactattttgttatgagaaacattttaaagatattttttgacaatattcctcgagagtcaatggggtaatatatttcattggtgtatggggattattttggagaatattcttgtttgtaggaaacacagtacatattagatggtacgattctcaggtcttcaaaagactgttataagattccatttagggaagggggtaattgtgctatacttgaaacatttctgtgagtttaacattgttcctttctaaaaaattaaaaataaaatttattgacatgatgctatatatatttgtaagtattaggtaatggtgttatgccattgttcttaccagtataagatcaaacaatttactacagatacacacccctgatgccgtgcttcttcaatgcatgtggcactaacagccccaccattatcaagagctacaggtctttttaatacccagagactaaatgggctgcacctgtgtagaatttttgcatccctaacttaagtactaatagattgcttttgattggaagccttagcaataaaataaatagttgattaacatgttttttaatgttatatatattatatactctattattccaataaagtatgctaaagaaaaaaatgttattaaggaaaccataaaatagagaaaatatatttactacttattaagcatttgcttacaggtgacacacacagaacaaaatataagtgtatctgcaaatttcaaacccaagttattcaagggttaactgtaccatgatgaacgtagcagtccccatctgtaatctagggctttcccctttgctgtacctctactcatttccaatgaccatatatatgtcttatgttctttatgatcttgggcagagaactctgcctggatgcattgctggccagatggcctggaatgtgtatctcttaggaaagtgctatggtttgactgtgtcctccagaatccatctattgtaaagttaattctcagtgtaatggtttttgccaggtggggcctattgggatgtgtttaggtcatgaggctggagccctctagcggaatacattaatgccactataaacaggaattacagggctgagatctctctcctgctcctctgacatgttaagacatggccttccttcctttgaagaactcaacgctccaggcatcatcttgaaagcggagaaagcagaccatgtggttgatcttcagttatcctgagtcaggtaggttgttgatgtgtcttttaccattcattttctgttccctccctcactttcctcctttcctcccagtataaatttgctacctaacaggaatccttattgctggtggatccaaactgagagagtaaaaaagaaaagtcattaatcttttgtatgaggggtatttctcatctgaaatcttaccatttctctttctttgatatgtacaaatattcaggaagcacctaatttttttttttttaccaatgtatcttagattgaatttacgctgtgattttttttctgtgtgttaaaacaaaaaatcaagttgtaagccaccaacctactcaatgggcttctcttttggcagagagaacgtcaaagaaatctgaaaaactaggttaggccatgactggcaggtgggtttagatgtaactcattatactctcctccctttggagttcagacaaaactgaccagtgttatcattacaacagagatctttagactgacaaatcaaatgctttgtagcaataagataccatactccaacatgacagataataggccctgaagaaaatctaaatattgtaccctaaaaatattttttttgatgtattctgaagtggccctgcaaagctgcctgttatgggggaaatttgcattctgcagagcatctcctcctcttactatgtcttttccaaagagttggacatttctttaaaggtctgataagcaacattcaccatctactttactgttacctgcaaggttcatctaagtgacaagaaccttgacttccacacccccttatctaaactcaaggatttctttatgatgaattcaactctttaggcagagcttaactctttcaaccagttgccaatcaggaaaactttgaagccacctgtgacctggaagcccctgcttcaagatatcccacctttccaggacaaactaatgtatatcttatatgtactgacttaggtctttccctgtaatttttgtgtctccctaaaatgtataaaaccaacgtgtaatccagccaccttgggcacatatttgcagggcctcctaaagctgtgtcacaggccataagccttatctttggcaaaataaacctatacattgattgagacctgtctcagatactgttttgtttacactgggtcacaaaagttaaaaatcctctaaaactctctacacatctataaatctacattagagacagtggagtgagtatacctcaactcaagtcatactttgagtttaagaaccagacagattttcaggtacttcgataaatgaggagacatttggaatagggtccttagcccagagctaaggtcaggctggcagtgcctgagcgcttccaggccctggccctggtctgtggaggaagccactgttctcctgagccacagggctgagaacctgggatgagccacaggccttggccgcagggctgcctggcagggtcttcagggagggaaactgctcacaaattcgcgggagctgcattaagcatatatccccccagcctggcaagagtgaaagtctcaggacacagaccttagggctggggctgggatcctgggctggctgctgtcagctgtgtcctcccttgtcctgaatgactgggaccctgctggagccaaagagggagggtcagcaaatgtcctcaaggtcttcactcagccagactctgttctgcttggaaagaaaaggaacacatgctacaaaaataaacataaaattatgtgtatttgtaatatgaatttctagtataaactttacatattaaatacatacattttagaaataagttatatttatatatttgtatatactatgtatctgtggataaatatgtgatgcatgtttatgtataaagagatgcaagtttcattgctagtataaggtatagttttaaactttaataaattgaacgtgaacattgaaaacaagcactgggtgcaccacctcatggcccctcctcactccagggcctgagggtcataaagctcgggactctcttccatgtgccccctgggccgatagcagtgagctacccattgctgaggatcatgagtgacctgagggggatctgcagaatcacagggcagcagatgcccaggagatggatagtgaatttggaccctgaatggagggacgttttgtccacagggctcagcacagacaagtccttttctggtcatttctgtcaagcaaagcagcacacatggctcagaggctgcatggtcagaggaataagcccctccatggctcattcccagcttcccctctgactggggtgatgtgggatctctctgcccagctttcatgactgaccagctgctgggaccctgttaacaatggcctatgtcagtgccatgcacaagcttcttgatagttaccattttactttctggtctccaataaccacaaattgccaaccatgaccgtttcacaaagattcatggagaggggtcagaattatgggttgagcaacgtgccggggcatgtatgtaagagaaacaaggtgtggccagcccatgtggaagtgaggatgaattttcatcatgaattcagagaaggaggtgggagaaagcatctgacatgcttcaggcagtgatggccacaagatacattagagatgttcatagaagaggtggcaagtgggtttgagatgaaaagggaatgtgaattcagaggtgtcccccagcctgttcccctgagaagatttcagacccttagcaacccctgggcccccaggtagagctgttgctagggaagatttgtacatgataggggacaggaagagggatcacctacctctgaaggcatcttggttggtagtggccagagtgacatctgttcaggcccattattatccctgacccaggcagggatcatgtccaggagggcagtaggagccagcaggagctcagagccatgccccagttctgctggtgccaggctaggatgttcttcatactctggccagccctgcaggtgacagtgaccctctaacctgagagacaaggaagaggatgaagatggcatccacataacatgctcactgtcatccaagtgggggaacaagcatgcagattcccaaatattaataccaagcttttatttcatccaacttgatgaaattctgatcagaaggagaaacagtctaacaaattcatcatcaaggaaagttcatgtttaatacaaactatctgaggctgaaacctgacttccccttcctcaccaggcagtcaggacagcaggagcaaaaggagaaaagctgggtcccaaagtccacaaggtgactcctggggctgatcctgctcagagaacgtggcaacagtggataagtctgccgagaatgccacaccatcatactctgagctggagggcttcaaccacagacatttattgctaatttattagacatttattgcgaatatattagaaccatggaaggttcaagatcaaagtccagaaggatttgctttctggtgagaaccctgtttgtttccagatgtcctctctggatacatcctcatgtgtgttcagcaatgtgccaggcatgtgtaagagaagcaagtgcatgctttactcagtacacgcttggaggctggtgaggggttcagtaacagctcaatgatatttctttttattaggacacaaatcctattaaatcagaaccccgatgttttcacctcatttcaccctaattacctcttcataacctctatgtctaaatgcagtaatattggaggttggagattcaaaatatgaatttgtgaaacaccattcagttcatagcaggtgcactttgaggatatggccaaggcagtaggaagggcaaggcaaggcttccagtctcagagcacagagggcattttcccaccactcagcacactggcagctcctcccaggtgatccaggtcacacatgagaccccattcctgccttgggggctgcctgctgataatgaaacaacatcacccttaatttcactatttctaagatcaggcttctattttgtgtttattatggggtttgtccaatggccaggtttgtgacataccacccaatggcaggtttgtgacataacatcttatagaattttagatgctggtttccagtgagacttgatggagttttttcatgggttttcatggagttgatcttattacatccatcaataggctgcattctgtagggaatacaaaacgattcctctcctcaataaaccagtcacctagttgaagataaagagttgagaaaagatggtcacaaaacaatcaggtgttaaattctgtgatccatgtgagatgccaacaatgtggttctgggaaagagagagtgaggttgtgaggggccctgcagagcacaatgtccagggctagggtcgggagtagagggcccctggtctggatctgtctactcagcttcattcctcccattgttgaaacagtggctgcaccagccagcaagcatctgagaccacctgattctctggactaacagctgctgaggtttgtgctctgagctataacactgtgagggtctaactgtaaccatttagatcagcactaatgaaaataattttttaatatggtgaaaatgtctgcaaatttctaacagaaaaattgatgaaaagatggtttttcttaggcccccacagcagtctctgcctgggacctgactttgtctttgagccagtggaatctatgctgagattgtaagctgggcagggaaatcacagcagggcaggctgtgctctgggtgctgaggaggacaggaggacactccttcagggttagtgatgctgggagttcgaggggagagactgcatggagctgcctgtgaatcgccctagcaatgccctctggacactgctcatctcacaagtgtactcggatgccagtggatggcccaaacatgggctcaggttggacaaggacaaagatttagggatgaatatatggggctcatttgatactctgaagtttcagcacaagcataacgaattatatggggagagaaagaagtcacaaggttgtgatttttcatttggtattaaaatatatcccctctgctcatttttccctgcagaatgtaactactgatacatatttaagcaaagtcactgtttttaattgttttagtaactgacagcctgtgtgcacagttcctaagtaactgggtagccagaccatcattcctatggtaaagccaggaagtgactgtggatgtgaacaaatgtgagtttaatgtacatgtctccaaagccacgggccactgatctagggagaacctgcagtcagtttgctttcccatgcccagatgagaggacaccttgatctgtgttcttctgatgaactctaaaaactctaaaaactgatgaactctaaaaactaatattctgaaggtctagttcatacttcttttctttgctagagggactctctcactcacatgtattgtactctctgcatagaacagtatgtgatacatacaacttgttttctgctaaatacccatcaatcatgtcattcatgagtcttccatagatgttacctgccctatgaatctgggctcttccaaaagaatgggccagaggtggagctgtgctttcacattctcttgtgcttccctcgtggacaacctttgctagttgtcacccttcccacccagcaaaagtaactgtctttctgacatctacacaatcatttaggttttcctgtcttaaacttcatataaatagcattatgtgtatttttatctttttagtcttggtattattccttactacttttgaggccttcatttcttccagtggactcaaggtcctgtctgatgtcatttcctgtgattctgaaggattttctctcaaatgttttataagacatagctgctatgaatgaatgtattttgtttaccaaaatttttttttttgcctttttgttagatttgaaggatattttcactggatagatttcctggctgccttcttttttttccttttcagcatttaaatatgtcattttactgcttctagcctctattggtcccgatgaaaacttagccaatggctacgttgttgtgtctctgtatatagtgtctgcttttattctgatgcaatgaagattttttctttgtctttcaacattttaatatagtgtgttcacttattaatttctattgactatctaaaagggttttattgaattatttcatctaagaatattttttattacttttgaaaagtttttgtcattgtatctccaaatattttttcagccactttctctgtctctccttctttgtgactctcattatacatttgttggtatccttcactctgagctataaatctctgacatttcttcctttttttctaaacattttctttaggctcaaacatttccattcctctattttcaagttaactgattgttctgtcatctcaatttgctattagacctagctaataaatatttaaattgtattatggtacttttcatttctagagttcccatttggtcattttttatactttccatttcttttcttgaggtcctacttgctgaatcttctttttaaaaatattttcgtttttatgtcaatgatcatagttttaaaaataattatttgaacatctgcatattaactgctttgtagtctttgctaaagccaataatgaggacaagttagaatcagctttcattggctattttctgttgtcattattgtagttgctttactttgttccttcaatataaatcatactcctctgtttttttttcaggattttttaaaactgaaagctgcacacttttgataatatattatagtacctctctttagattgtggggtttttattttaattttaatttttttagaaacagggtctcactctgtcacccaggctggagtgtggtggtgtgatcatagctcgctgcagcgtcaacctcttgggctccagtgatcctccagcttcatcctcctgagtagctgggactataggtgcatgccaccactctctgctatttaaaaaaaaaaatttgtagagataagggtgtcactattttggccagcctggtcttgaactcctggcttcatgtaatccttctgcatcaggctctaaagtagtgggattacaggcttgagctaccatgtcaggcctggaactggtttcatttttctgagcattttaaaatttttttcttagttacttgtcagaacttacttctggtacctgacttatgatagttggagttatcattttttgactttcagatggtgtgaaagtgatatgcattcaagtagaaatagtacttctagtatttatacaactattctatcttctctttcaatagagtattcaataaattgcatgagatattcaacactttgttgtaagataaggtttgtgttagataatgttgccctactgtaaactaatgtaagtgtactgagcacatttaggatagaataggctgagctagtggattacatatattaaatgtattttcaatgcatgatattgaaaaatctatatctcatatggtgtttgaccactgatatctctgctttttattcttaatatttagtttgaatttatagaaactgcacatgtatctgcacagcttagtggtcaccaatgatttgagaagaagttttgctcaaatatctggaggttataaatctatcttctgtcaatccatctgtgtgtagtttaaaaagctcctgcaaaatgcagctagttcttacctccctctggttttactttgcaccgggcacttctgggtctcatcactcatatctatagcttctaagtcaccaggaatgtgtgtagagattgtttcagcaatatggctctatcttacccaggaatctgctatttactgttagcaggtgtactacttgccccaaacagggcatcatctttgactaacaaagctgtgggctttttctgttcattccctatggagttctgcatgtttagctggaaacactgaagaattttacttcattccttggctttactcaagttcacccgctttggcagcaagctgctagctttatttgctatcctcatattggtaaaactccagttctgtatttcatgctgactgagctgggggtagaagggtgctgtcacaggcaaaaggctacagactttttctgtccttactcaaagcactagtacttttttttctataaagaatatacatctttaattattttatgcttcaccaattttcagagtgctgaaatagttttgatattttagctttatatgtgtgtttgttatttatttttgcacagaagatttattaaactctttgtgatgccataaacagagatgccttctaaaatgcatttaaatgaacataatagccatgctgaaatggaatgaggttatttactaacataagtaattttggacttgagaacttgaactcttcaccctcagtttaaagagaaaccaaggacttaaaaaatagagaatcctggtccctggatttcacattcatgaagaaatgcacagtcaatttttaagatgccttctttgtattctagaactgagcaaattagtgattacactctacataatgggagctatgattgtctttaatagagataagaattagaaataggaaaaggtagctgggtgcggtggctcatgcctataatcccagcactttgggaggctgagacgggtggatcacgaggtcaggagatcgagaccatcctggctaacatggtgaaaccccgtctctactaaaaaaatacaaaaaaattagtcaggcgtggtggcgggtgcctgtagtcccagccacttgggaggctgaggcaggagaatggcgtgaacctgggaggcagaggttgcagtgagccgagatcatcataccactgcactccagcctgggtgatagagcaagattccatctgaaaaaaaaaaaaaaaagaaagaaagaaataggaaagtgcaaaataggaggaaacttgtggaattgtttaaaaactacctttttcttattttttagttacttgtgtgtgtgttttaagtttatgtggaaatacttttagacctaaaatttgaaaaatatggtaaaaatgattcccatatgcgcctctttcagcttgctctaatgtcagcatcataaataaccacagtataagtatcacaaccatgaaatgaacatagatataatgttatttgttaactcatttaaaataccatatggatttcactgatttttcctgttgatgactttttttatgttacaagataaaattcaggtttctgtattttatttggttatcctgtcctcaatatctttaaatctgtgatagtttttcacttttgtttctctttcatggccttcaaacatttgaagtttactgtccaggtatgttgaagaatgtcctcctagttgggtttgtatatggtgtttactactgattcaattcacaccattaatttttggcaagaataatacagacaggatgtatcctcagtgcttcacatcagatgttacataatgtcaacatgtcttataggtggtaataaacgaatatgatcaatgaaatcccatttggaaggaagttttggacaaaaataatgaaaacaactgcttctatcactctttctactaggtcattgcagacgtcattaggaataatctatttcttccttatcgaatatgtactttattttaacaaactttaatctttttacagtctactgcatcacagagaaaattgaagaaataatttagttaacttttaaatggcaaatgtttccataataaccatttgccactgaaatgttgatagcctgaagaaagaaaaagaatgggatttattcagccatggtagtatcttcacatgaacagcttttaccgagtcaactatttggataaataaatagaattttctactacttagaatgttgcaaaattcaaatggagcagtgtagcatgcactgagctacctctactgggaaagttaagaaccactgaggctatataaggattcatacagtgagtcactatttctggaaacctgggattctggtgcctcagttgaacagagtccaagaatcaaagtccaaattgttcaatgatttttttttagaactgcaaaatgtccaaatagagcagagacgctaaaactgagtggccaccacattagctgtctgtaaaggaagcagctggtaaaatctagtaaacactgatggtcttgttgaggtttttgtttcatgttgaatcactgtgggaggtaagttataatcctgctgacagtaataaactgcaaaatcttcaggctgcaggctgctgatggtgagagtgaagtctgtcccagacccactgccactgaacctggctgggatgctagtggccctggtggatgcaccatagatgaggagcctgggcgcctggccaggtttctgctgataccaggttaagtagctgctgctaacactctgactggccctgcaggagagggtgactctttcccctggagacaaagacagggtgggtggagactgtgtcattacaatttctctggtggtatccaagattggaaataaaacagaaatgcactcatgtaatctagatcaaaccagctgtctttgagtagagccaaaattgttgatctacattgaattttaattatatttcttgctgagcagaggtggcaggagttttcactgatgtgcaaaaccacctcatgttcccctcacctgggagccagagtagcaggaggaagagaagctgagctggggcttccatggttccgtctgggtcctaactgagcagttccttcccagggctctgacccaggcattgatatgggctctggaaggtagggcagctgggagggacatgcaaagcagctgggtgggagctgagcttccagctgcagagaccacctgcttcttcctctctgcactgagcgtcctgtgcctccctggttgtcaggccagaaaagtctgttggctcagtctgagtgtagaactcctcccttgtgctcacataatttcactcctgtgcctttcttctcttcaatcacctaaatacacccgtatgatatttggcacaagtctgttaagaacaatataaaaggctgtgttttcatttctctcttcctgtcctcagtatgcccagtcatctccctaagtgcattattggatctatggaaatgaagagtctgttagaacttaatcttccagatagacattttttttttttttttctgagacggagtctcgctctgtcttccaggctagagggcagtggtgcgatctccactcactgcaagctctgcctcccgggttcatgccattctcctgcctcagcctcccaagtgcctgggattacaagcgcctgccaccacgcccagctaattttttgtatttttagtagagacggggtttcaccatgttagccaggatggtctcgatctcctgacctggtgatccacccgccttggcctcccaaagtgctgggattacaggcatgagccaccgcgcccggcccagatacacctttcatttgcttattagtaatgttttctgagggtcctgaagctttccattaacccagacacataccctctttgagttaaaaacttctgtttacagtcacatgtcctggcagccctgacatagatgctccatggcttgccgattgcttgaaattaatcaagtaacttaacttccctgtgtctcggtttccatatctgtgtaactgtgacaatagtggtacctgccttacagtgctgtagacagtttaaagaaaataagataaaacatttacaatagtattcaggacattatgtatgtggcaattaattttgttttcattgtttaaatattcagcactacagtcatcatcattataaatatacttagcatggaaaatagtcttaaatctaatccaagaatgttttatccacagtcaaattaaattctaaggcattttcttcagtaactgtacacaactcttaaaatcctaatgatttgatcttaatctgtgctaaagtactcagaccttccatcattcccatccatccctgtctaacgcattacttctcatcatccattatttaaatgttaccctataaacggtccccatgtcctgttgctgtccttctttcttatgtaatctttattctaccttgttatcttttatgttattcttgccccaggactgacaataaggaaaagctaccatcatttcttgtagacttgctccagtataattttttcaggcttgttgtcttggaaatgaggattgtgtcttgcaaagaaacatattcattgggtcaatgtgttatgaaataaaagattttatctacttatgatccaataattaatttagactgacttgaacagatttttaatgacaaaaaggagaagacgatataagagaaaaatttaatacaatagaaaacacaagctaatataacgcttgcttcatggatttttacatgtatattagacatatgctgggtatatgtgcgcaacgacaatctaaaaactgaatgataactagcttaaggaatgcctgcattacactgagtcttgcccacttttccagttatgaaaagaaagctacagcactatttgtatgagtatcaaaccttctagatgctgtgatagaggtagagaagatttactgagaccaaagccttggaagtagtagatgcttgttctatgatattatgtggctgtggttgccgttgttaggaaatacagtgggagtgaaagcaaggagaagatttacaagctctgctcttcctcatactcacaaccccctctagagatggacagatgttggtccaggaatctctgacacctcttagaagccttttgctctttccagaatgtttcctgacaagtattgttttgagtcacagattaggtgaaactaggtgtagaagaaaggactagagcaagggaagaagttttccatcccagacagttgttgtaggaacagggaaattgaatttttcatagatttatgtgacacttgtatcatgttggggagagaggcatcaaaccaggctcattactgaaagaattattacgttatttaagagagaaagaactgtgaatttcttgtcaaatagatgtttaaaattcaaaactactattttttttttggagatagaatctcactctgtcacccaggctggagtgcagtggcacaatcttggctcgctgcaacctccctctctccatttaaagcaattctcctgcctcagactcccaagtagctgggattacaggtgtgtgccaacatacccagctaattttcatatttttagtagagacgggattttgccatgttggcccggctggtctcaaactcctgacctcaggtgatctgcctgcctcggcctcccaaagtgctggaattgtaggattgagccactgtgcctggccctactgatgtattaatattattcatcttcttgaatacaccaagtggtaaagtgcaaatccacactttaaacttgagatttctcctcctatgtgaattatactagtgaggaacaaaaaaattctctgttggtggggagatgatgtttgacagcggtcagtttgtgaagcagaggcttatgtcacaggactttttacagtattacatataaacatggtgaatggcctcaaacacagaagaatcagcttttttcatgagccatactaccaccaagaaagaactgaattgaaacctgtgactacttgatgaagggtgtataaagaagagggaaagatttgggaggccaaggcgggtggaccacgaggtcaggagatcaaaaccatcctggctaacatggtgaaaccccatctctattaaaaatacaaaaaaattagctgggcgtggtggagtcccagctactcgggaggctgaggcaggagaatggcatgaactggggagtcggaggttgcagtgagccaagattgcaccactgcactccagcctgggtgacagaacaagaatctgtctcaaaaaaaaagaagagggaaagaaaaatgacacaaaacacaatgtcataaatggaaaggaagaagtcattacacagcctacaggagtaaaaaaataaagagaggatattatgagtaattttatgtcaactaacttgacaaaagtggtgcagggcaggttcttggctacactcaggaaggaatgcagcgtaagctggtggtagaagaaaacagctttactgaggtggcagtgttacagctttgtgtctgttcttgtgaaacagagctaccacataggcattgtgccaagagcagtagcgtaggggcagttttgcagtcatatttatccccacttttaatgacatgctaataaaggagtgggttattcaggaatagctagaaaatgggcagtaactttcaggttttgccatggcaatggtaaactgatatggcactggtgggcatgtgttatggacaggtgcttccagtgtctcttccttgtgtcagccagtcttcaatctggtcctgggttgagtcccacctacctcctatctcattgctccctcagagattagatactcctccttaatcttaaggggactgcagaagagcagagtcccttttctgtaagtgcttcctgctgactttatgggggcaggccttccctagcctttgaggagtaaaaatctttggtacctgaactaaggggcccaatggcacgatgcattcatttgtggggtcagaagacagaatgggttggaagacttatgacagaccgtatcatctttacatgaaatttagaagacataaactttactaggatgttaaacaagaaaattataattggaagagagggaaaaattaatgctcctaggtccacctacggaaccatgttattaatccatgtgtttgcaaaacaacaaccttaagttttctgttttataaatggaggttgtggtgtcccccttttgtggctgtaggaccttgtaagaaacaggtttaatcctgggcagctgtacccaactagtggcttcctgaagcctaacagtaattaagagtaataaagaatatctgataatggctccttattctggttattattgattcttgggggatcattttgttgttgttgttgttgttgttgttgttttttgagatggagtctcgctctgttgcccaggctagagtgcagtggcacaatcttggctgggctcactggaacctctgcctccagttttcaagctattttcatgcctcagcctcctgagtggctgggattacaggcatgtaccaccatgcccagctaattttgtaatattagtaaagatatggttttgctatgttggcaaggctgatttcgaactcctggcctaagtgatccgcccatctcagcctcccaaagtgttgagatgaaaacgtcacaggagctgatgaaaaaggaaaaggagacagcaatgatcccaggcctttttaaagggagaacaagctgaaagcagcaaaatacaacagttaaatctctaagacactaatctcagaagttttaaaagaaactcattatcgtatcacaggcaaaattttttgttttacttgttttttttttttttttttttttttcttttttttgagatagagtctcgctttgtcacccaggctggagtgcaatagcgtgatcttggttcactgcaacctccacctcccaggtttcagccattctcctgcctcagcctcctgagttgctagggttacaggtacatgccactgtgcctggctaatttttgtatttttagtagagacaaggttttactatgtttgccaggctggtcttgaactcctgacctcaaatgatcctcccaccttgggattacaggcatgtaatcccaaagtgctgggattacaggcatgggccaccatgctcagccttaaagctgtatttttattaagtaaagtgtagaagaaaaagtgtaaataaagtgacagaaggaaaacacaaggctgttatggaaaatgataaccttagggcagaaaacaagaaaaggcaaaccaagatttccatagggtgaggctccaatccacaatcctcggatgaatgtcaatgctaaaaaccctggagcctccagggagtggccaacagtactaaatgctgaaaacccagagtacacgagtatcagcctatgaatgtcccacaccaaatgccaggaaaccctggagtatccaggggctgaccagtgcagaaaatcctggagcctcagtggggtggccaacaatgagccccaaaggcctggttggggccatagaacaatgtgactctggcttcttagagtcaacagaacaggagaattccgcggatcncacgtangtantanatgtanatgtanangatgatanangatgatanangatgngtanangatggtangancgttanaatanatgtanatgtanatggtanatgtanatggttangtnatgattagtgaanangtaanangnnntnatanangattnatananggntnanangnangatanangatanangntnccanggncanaaanagatgaangggntnaaangntcgttggtngan

SEQ ID NO: 5 - DNA, 54840 bp, Artificial Sequence
  RP11-344F17
ttaattaagcctgtaattttaatgcagttgaatatgtcaatcgtttattgactatgttttttataaagtttaagaaattcttctctattttgggagtcatgaagatattcttgcattccagattttcctcctgacataatttactttcttcctgaagtgcaccctttagtagtctctttagtgaaggtcagtggctagtagtcagtttgatttactagaaaatgtccttaaatttcccctgacaattattttctctccacacttccaagatatatttccactgtgttgtatattttttcatatgattctgttgtattcttgcttccattgttgccgttgaaaggtcagctgtcagttgaactcttattttgtaggaatctgtcttccttacttggctatatttagtcttcactctgtctttggcattctgcagtttgtgaaacagtgataccatgtgttgagatgtggatttttttttattactcctgcttggtattcattctatattcaatatctgaaaattccattcacttgacctcaatagcttgattctgcaatttgtcacttccattaacttccattcttgttcacttgtttcctcttatgtttagtgaattttgattggaagctcatgtctgtgggggtaactcagttctgaatgatgtattagaaactttctataccaaacaacttcactcacttttttttttttcttgagagagtctctctctgtcactcaggctggagtgcagagagaggttcaatcatggctcactgcagactccaactcctgagatcaaatgatcctcccacctcagcctcctaagtagttaggactacaggcacacactaccacacctggccaatttttgttttattttttgtagagaccaggtcttgctgtgttgcccaggctagtgttaaattcccagcctcaagaaatgttcctgccttggcctcccaaagtgctgagattacaggcattagccactgtgccctgccttcacgcccttctgtatagctcagccaaaagatatacaacttcagttctgctttccaaaatatatccctagctttctggaaccagcagttcttatcttacaactggccaatacatagacatagatatgtcaccctttcccttctgaggcttccacttgctgttgtctggctgttgtctttgaatttatggagtattcatggtctcttaaggagaaaaaagaaaagggagatgagaagccagaagagaacaggaagttgaccacaaggcagagactcctcagcaaggagcacaatcacagctttacagggccagaaaacaactccagcagcgtggctgcctcttaaagcgccagttctggaagcaaattcccccttaacaatcaatatctaagtgaattttggaagtcctaggctggtctgagactgccggagaatgagtcaaggccggcttgtcctagggagggggtggtgagggatggaagccgctgtcctctggctccccgtcaactgtgcatgtcaatcccagtgacaagggctgctgatgcttcagaaaggtaccaggcctcagctttaaggcgcttgccaagaagccatgagaagtgcattaagatgctggcacatgaacagcacccaaacaatgctggttattagtggttcaccaggtgctttacagtttataaaatacattcactcagactgcctggtttagtccacacaacaattctaactcccttggaaagaccagagaactgccatttgataccttccactgcttactgcaagctcacctgcgccaggcatggggacagcaagggaacctcagccccatcttgccagtcagtgcctgcagaggggtcccggtgcccctcttgccatcagaagcttccctggccagacacagccatatgcatgttacttacatttgcacatttaatctttgccacagtccatgagatagtctgtaccagagggaactggggcctgaggtcacacaggcagtgcgtggtgggactcaggcatggtgtaggacacttgtggttcttgccccgaaaccagatttcaaggccaagggcaaggccagatagaggctcctagaatgtgccagagggtggcctgctacagcctcagccaaggtctgcctggggcattaggggccttgatggggatatcacgcctgcagtctcagggagcccatcagcggcctcctctctctggattccagctatggcttagggatccctgtcctacctttcacaacaggccaggggcctctgagtatttgggaatctgctcaaacattgtgggaaccttcctgcaatggcttcagtgttgcagaatcaatgttctgccaaagaaagtcactcacttcttatttctacacccctctacctcctaaacagtaggagggaccagagccaagggctgcaggtggctttacacccagtagacttagtgatctcatttctgtctccagtagtctaggttggatttcttatagttgtgaaaactttgagtatttgtttttactttttcttaaagctcgtatggtggccccaaactgctttcccattttaatgcttatttttgtatctcatcagagctggagatatttttcaatggttgaggctggccctcaaagtggagaaatatttgattacagtgagccatttacagcaagtagatttcaagcacaacactggcaaaatccttttctataagaaacactgtcttatatagattttccaaaaggctgaactgaaactggaaaggatgtcttaaggaaagatggatattaacaataggtttttaaaacctattcttctctagaacatggagaagagctccttcatgtttagaaagttggttaagaactagaatataagaactggggtaacaacacccagattcagcttccaatctggaatctggaagtccaggaagaaagggctggtgccaggtttggagagggaggttgaacctggatgttaccacaccagatagagagaaaacttccaaaggctcctcaggtccagtcaaaaggactcggcaggctcctgttggccaaagatgggaccgcttgggcttcttatagctacaatggattggaatgcaccaactaaggtgaaatccacgagttcaaaatgatacttaaaacaaaaacttctttggtcactcttggaggatgcttattattttgaaactgctttaaaagaaaaagaagccggcaaaaaatgtgttgtgggggcaaagagcttctgaaatacgcacatacctgagcactaccctctgggcagcactccaagtcctgctactcctagaaccctttggggacttcaagaaagccccagggtctgcgtcctgccccagagagtctgcttgaacaggtaagggaggctgcattgttgagagttccccaggcagggtggccagggctgagaaagcctgaggccagctctctgcttctactctcacctccagtccatgcaccatgcagcgccattcctcctgggtttgaatcccagctctgcctggtgggtaggtcatttagcttgtctgtgcctctgtgtgcctgtctatcaaatagaagaggtgggggtctcactggcccctctatcatctggcccttgtgagggtttgatgagtctgtctggcacatggtgaatgttggctgtagtagccataaccatttggaatggcacagagggcaggaagagacgttccatgagaaagatacaggggagggaatgtctaagagaggcctctctaaaggatgggaaattcacttttggaaaggagagatgggagatcaatcagctgggtgggcgagataacatttagagggcacagacccttcttatgagttgatgatggctttggttaccaagaaaaatgtacctatacacacacacaacttttgcctacaaatctaaggactcacagaccccccaatgtccgtctgcaaccccaacagttgaagtccattgccacctccaggttaaataactgtcatcaacgactctattattttgacaatattgatcaaaacattaaatgcccatactcttcaactaaataatttcacttgatggaatttgtcctacaaatgatgcatgtgaggaaaataacaactataaaagttgtttattgcagcctgttgattacagaaaagctaggaaatgatctcttcatccacaggggaccagttaaatcaattgtatctacagagtgaaacactctgcaatcttcaaaaaaaaaaaaaaaaaaaaagagaaaattctatatcccaaaatggaacaagaacaatctccaataatttgtaaaggcacagaccagtgtactcagtgtgctatgatttgtgcagaaaaataagaaaatgcatgtgtgagtgtctgtgtatatgtgcatttgttgaaggtgaacagaatatttccagaatgagaccctatcagccagtcagtgccttggtctcggggaagcagaacctcttgtcttggagacagttttgaatgtaggaccatattcatgtttacattaatccaaaacaaataacaggtacatttaaaaagaaaagaaagccacgtgggcattggaggctcacagagaattctgaatgggaagagataaggaggatggcctttggggagagtggatctgctcacctgaacagagcatctggaagcccctcatgggtgggagaggggctgctgcaggggccgggatcacacgctgaggttctgagacagttgctgcctgagtaatgacgccctgggaaccgtgaaggatatgtcaaaaagatgcatggtctcaggtctgtgtggccagggctccaggccatggctgggaggtgtgggtttggggtggggcagacaagttgctgagaagcaaagaggtgtgccaggggtgggtacccggtggcaggtttttctgcatagctgggcattgcttcagcatggcaggtttcatgtactgccaaccccaaattccttttcttactgctcgtcttaattttcatgacagctttgcctctccttctcttccctggcgcttaggtgaccacaggcttcataaagcctaaaaaacttcagactgagaggaaaagaccccagtcaagatgggtgcggctgttgtcatcagcacacaggtgagccggggtctcctggtcccaccacgggccaggcagtaatgggctctgtaaaggacacacaagggcgttgcccacggcgggaacctggatgtcccaaaggctccctctgccattgtgatgtttcaggatgaaggaaacgattgtccttctcattcaggtgtgcagagtgcacgttgtttaagtccaggctctcttgtctactatatacctctctctctttttaaaaattgtggttaaacatatataacaaaatcaaccatcttaaccatttttcagtatacagttgagtggcattcgtgttcattcacactgttgtgcacccgtcaccaccatccatctccagagtgctttccatcttgcagatctgaaactctgcacccattaaacaacaactccccactcttccctccccgcagtccctggcaaccaccattctactttctgtctacactgggtacctgatatgaatggaatcatgccgtatttgtccttttgtgactgccttttctcgcttagcataatgtcctcaaagttcatctgtgttgtagcatgtgtcagaatttccttctttttcaagtgctgaataatattccattgcatatgtgtgtcacagttggtttatccactcatctgcttatacacactagcgttgcttccaccttttggctattgtgaataatgctgctatgaacacgggtgtccaattagctcttggatgcacactcccgaaaaagaaaaaacagctgggtgcagtggctcacacctgtaatcccagaactctgggaggccaaggtggggatcacttgagcccaagggttcaaaagcagcctgggcaacatggcaaaaccctgtctctaaaaaaatacaaacattacccagacatggtggcacatgcctgtagtccccactactcgggaggctgagatgggaggaccacttgagcccgggaggcagacagccttgattttgccactgcacttcagcatgggtgacagagagagaccctgtctcaaaaaaaagggaaaaaacaagacaaggtttctcctggggctgtgcttcagaccccattaggcagttgctctgcaaaatgcctcatgagtcacagctctgtcaaacagatgtgcacatgttcctaccactgtagcatcccttgggggtttggttctgttcacccaaaatgagtgggagtttggttctgaacacgcagcactaaggggacctcaaaaaggacaccttatagtacgagaactcaaaaaggaaggcagagtgtcaccttgcttgacctcagctgggaatgtgtgttcatgtctggcaactcaagtttttcgctgctctgagcatgtcaatggctgtgaaagtgccaagtgtattaatttgggggttacaaatacatcttagcaagtaggtgaacttgcaaatacagaatccaggagttatgagggtccactgtattttcagtgtcgaaattatcttccatcaagttgataaaacctcatttactcaattaggccctagtcagggtatgtgaagtgttctagctttttcctattacaaatgatgctgcagtgaataccttgctgcaaagagagttctctcattataaactgtttctgtggcgtgagttccccaactgggctctcaccagtaaggggatgtcgctgcccatgccattaggctcaccacattccctactagggacacatatttggctttgtcctggtcaacgagacagagggaaagtctacctggtgcctaagaagggggtacagggcacaatggtccctttcttgctctggccattactgtgcagtggtgaacctggagctgtgaaatggaggaggagaaagaggaaaggagcctgcatcccagatgacacgaccgagctgctgacccagatcgcaggacacgagatagtgcatttcccttctgttaaggtcagtcccagccagcgacagcccctccacagcactgctgaggagcccctggtcacccatacccctcaccctctcttcagacactccactgccccccacgactcccaggccaaactcaggacacccaccctctgccattatgccgggctccccaagcctccaccacttcccccagtcctgggactggcaaactatgagtgagactcattcacagattgtgacttcatttagtggattatcaaccagcattaagaactgaagccaactgggcataatggctcacacttgtaatcccagcactttgggaagctgaggtaggaggattgcttgaggctaggcatttgaggccagcctaggcaacaaaatgagatcctgtccctagaaaacatttcaaaaaattaacagcatggtgacgcacacttgtagccctagctacttgggaggctgagtgggaggatcctttgagcccaggagttcgaggcagcagtgaactatacttgtcagcctgggtgacagggcaagactctttgtctctaaaaacaaaacaaaacaaaaagaacttaagcagactaggatataaagtataggagcgtattgtgtacaggaacgggaaatactgtttcctggatcttttgtttcacttacgcacacacccacacccgccagtagtgtaccaggttgcgatggaaatctctctctttctgtggatgagtttgtggaagcccttgctccagcatgccctccttcctgcccacccctggaccattccttcccttcacagcactgtcccatgggtaggccacagcccagcacaggccccagcctggcggctgcagcaggagccccatcccagggcctgaggggccatgcgggggtctgggtgggagtgggaaccgctgaggaaggtgaagggaaatatggtgagatgacaggcccgctgtcagggagagtgggaggagccctggagtgccctacctctgtggggctggaactccctgtatccgagctagggtcttccacacgcatgctcctaccccaagtgccacagctggaggtcagggacccagccaggctgtgctgggtgctcctgggcagggctcacctgactgcaagtctccctgtgggtggctcagagacccagagcccacctgggtgctgcttacagcccataaggcagctcccacccgcgtgtcactggccctgcagcctcatgaagccttgtgagcagccatccttatctcctttgtgctttgaatacaggaggatgctggctctaaaaggcagaggggcatcctcagttacccagcaggggcgtggcaggcctgtctccagtaccccaagaggaccctgaaaacaagtagcattgcatgaaagttccacactctgcagttcaacctagcacacttacaaaccctgagtcactgcatcctggctcatggagggagaatttcctttttctgtggctttaaggctagcaggaaattgccagcccaggcccctaaggcctccagtgagggccgggtctcatctcccactggataacagtgttgtcgggaacttccatccagcactggcggacactcccgtcgcagctgctcctgactgagcaagtcatttaagggggtccttggcactcataagcactcacagaatggggctggcagtgcgcccggcctccctgggatgggtccagaatggtaggaagcgcagtccgggagggaccctgagttagggccaggcatccccattcctgcttcctcctccccgaggaccacgtctgcccattcctcttttattttcttttggtatatatatatatatatgtatatataatttttcacaccattataattcctctttttaaaaaaatatatatgtatgtataactttcttagtaatttctgtagttaccgaatctggaaggaaaactaagaggccaccaggcaggccgtgtgatggaaggagtgaggggagaaggagcatccatgcagagggaacagcatgtgcaaagatgagggtcagtgaggacgtggtttgtacaggtaaattcgaggagctttgagggctgacaggtaatgctggctctggggaggtgttgggagaagagaagggaagggaggagccgtgtaatgaaaagctgtgctcaccatcactaaggactctggacttaacctgacagtgggggttttaggcagtggagtggcatgatcaaagccattgctggatgcagggaggaggctgggatgaatgaggcagagtttgggctggggcatccgttatgagtctatagaaatggttcagggaggggtctcagcttattgtaaggctttctttaaagttgatggaatgttttcttcccagtttcaaggcacagcaactgtcggttgtgagagatgcttctgctaccacttctattgctcacggcaaggcaaaatgtcagtctagattcaaggaggtggagaaatagattccacttcctgatgagagaagaatgaatgcagagtttgcaactcgtctgttaaagggaatgacaaagatgcaagaagagttaaactaaagttcattcagctggcagtatccaatccagtggtgggtggcagcagtgccaggaatagcattcaggcagcagcattaatagtgacattttttgtttttcagaatgttttagggtagaaccttggccatatttccagcttaccagtttcccttgttttcacctattttctgagcctgatttttcagacttcccattcactttggagttgcatgatatccttttaataaatgccctttctgcttaatttagccagaggctgcttctgttgtttgcctctaagggtgctgactgattctttggtcaataagataatcaccaaggactgtacagtaaaataaacaagataatttactaaagaggaaatgcaggtgggtaataactcctgagaaatgtctcacctcacttacgataaaaacaaaacacatctgaattaaaacagtaacaaccagatgcttttttgtttttgcctttacaatttgcaaattcatctaatcacagctgcagagggtatggtgagacaagctttcttctactgctagtgggagagtaaactgacctaaccttttttcctgtagatttcttggctatatgtactaagatcttaaaatgagttatcctttgtcacttccaggaatttagtctaagcaaatacttagaagtatggaaagaaatttatgcacgaaggtgttcatattttagtaaaaattggaaacttgaatgaaatgaggcaattaagatgtgatataataagataataagcagaagcaaccctttcttagaaaggtttgtaaagaactgaggattggccaggcatggtggctcgcacctgtaatcccagcactttgggaggccaaggcaggcagatcacaaggtcaggagttcaagaccagcttgaccaacatggtgaaaccctgtctctactaaaaatacaaaaagtagccaggtgcggtggcaggtgcctgtaatcccagctaccgggaggctgaggcaggagaattacttgaacccgggaggtggaggttgcagtgagccgagatcatgccactgcactccagcctgggtgacagagcaagactccatctcagaagaaaaaaaaaaaagaaagagctgacaattataggaaaaccttaatggaataatattgagtggtacattgttaaataataaattaaccaaaaattatacatgtgacatttgtcgttcatgatccagtggggaaaataaactaccctggacattttaaacaaagggaatttattgtgggaaatgcttcacaggtgatgaacagcagagacccaatcatcatggaagcagcccagagatgagtcacagcaggaagccactccaccatcagggctgcagaaagtggcattgggagagggcagaggatgggcacttggtggcagctagaatcatggaggagatgcagctactgatgcaaaactgcttcctgaaggagagagatggtcaagtaccctgccttatcccttcttttcactaccctgtctcttgctggtgtctcccaccggccatatccagctggaagccaattgccaatggaaccatggacaggaaatggatctgagtagatggacaatgaccaccacacagcatgatctcgactagataaacatgatgcatgttaaatggtattacttctgctgacagggcgatatatggcttttagtttcctatgtttttctgtattttctaaagaaactgaacaatattattaaaattaaataagtggaaagtgtgtttgtggcagatacaataacgtttttaaaaagataatgtgtacgtagggaaagatgggatgttgttaaacaacagacttttatatgctgtgtctccccgtgctccctccagctttagtcagtggccctaaaagggctagtgtcctggctgcatggggccagcagggggcgatccagtctagcacaaggccttccttgaccggcggactgtggctgggatttccttgcatttcagagcaggaccctagggcaggtgtcatcctgtcagctagctcctgcccccaagaggtttgtctctgtcagcctctaactcagagctgacccttcctcccatttcaggcaggctcttaccaggactcatgagaaagccaagccaagcaccactggcactcgagggtccttccttgtccctttgggtgattggcacggttgtccactgagcccagagcctcactgtgctcattaggtgtagcctaagggcacttgcatggaggtgccagtggtcactgcttagagctctcagccctagatggcgtatcacagttaatgctctataaaacccatcatggcttttccctagtaagcctcaaatcgctgcaagcaaggcttcatatatgagagtttctgctgtctcctggagccatctcacccaaagccactgactctgggagaccagcccaggccacaaaccagcaaagcaccagttatagttagagctgcattataaagtggccagaggacatttctttgcagtgagatgtgtatcgtgaacgtttggggcctgtgctcgcctagtcctcatctttgcttttctaggtacacaaagccatcccatggctgcaaatgttagctgggctgggctccctacttgcctcaagccccttcatagacccttcaggcacatgcttttctctggacgtttacagacaggtcctcagaggtcagagcaggttgtcctagggagcagggaggcttcctagggaggtcagactccaaatagtggatatggcaaaaatgcagctgcagactcatgaggagtcgccctgggctgccactagggctcccacagtgtgcgctgccaacctgctgcccgtgcagaaactctagggtaagagctggctcctggagtcccacccaggctgcgtgtccctcacagtctgctctgtgtctatgtgtgtgtgttggggggatattattggacaattcaagggaggctcagtgaggaggaaggaaaatttcatgtaattctttctggtttgtctttctcaaccccctcctcctgcctactccttaactgagagagtgtactattatttgtgtgaccctttttttcctccaatacacatagaaggttgtataattatgcttttctgttttggaaaatgacttaaaatcatgtaaagaaaaagcttacttaggtgaaatgtagataaagagattgtgtcagcaaaatataattcttaagggtaacaagggccatggacgcaattttaattgtgaaaaataagcaggatttcatcaaagtaaactactgcaggtgagaaaagttgaactgctgtaaataagcattatcctgggctgataatgcttacaaatgttgatcctgaaaattcttcaggtacctttcagagctgagagttgtgctctctggggtgacactcaaaggaaattgggtccttttttaagcataatcttcttgggtttttagtacattcttattttttattgaaatatacaatgaaaattcatcataatacactcttactcctaaaagagattgctgtatcataggacatgtgtgcatatgaaattttatatttatgttgaaaagttttgaggagaaaagaagaatcctttctctaagtaactttatagattttgtttttaattgcacgcatacaacaagttctcattaattataaattcagttcgtgggcaaaatatattttctgtgtgcccctttctataggaaacttgctggattatttctaattctgagtctgtatctgagtaataatgacaataagtaaatgatcccaaatatatttatataagtaagagattgcattctagaacttattttttgaataattttctataattaaaatgacaaacacttttgcaatctgaatttcatagtaaggataattctaaacaaattttgaaagttttggttttagaagaagttcaagaactatttggctctgcacggagagcttacacaagttgtatctctaagccctagcttcttgctatgcctttattaacataccagttttggggttaaaaacctactttagagctaaaatattttattaaaaatttaaaaaacctactttagagataaatattttattaaaaatttatcagcctgggggatatggagtggtagagagaattacttcccatggctgctcccttgcactgtttgaatattttaccaaatgcatgcattgcctttccaaaagaaatggaaatattttcaataatcaaatcagtaaaatttctgatgcttttcagttttttatacctacttttgcctttttgaatattctcaagaatggaactagacaaatgtaagtgataaattagagagaagtgactttaacttaaacatgcatctgtgcccagacatacccttgttaatttattaatattttagacaattgtcagaatctaaagtatttccagttctcaatctagaatggctaagcttatttttatggttctacatgccacttgacaataaaagatcatttatgattctaagaagcatttgtctctcaagtggcattgtaaatcagtacaatcttttgaaaaggaatttagtaacacatttcaaaggccatgaaaattccactccctgtaagtgaatgatttcagtaaatttaaaagtcaaacattagaaggcatgccatgttgcctttcacaaaaataattctgctaccatccctggaagctgttgttagaaggtcatgttcaataagcttacaatgttttcctgattgttgtttgtgtgaccattaaaatttcaccagtattggggaatttttacctttcagatcatttagttccaactgttaggaagcaattagctcttatgttcttctggttcgtgaaagtattttactttgggtgcaggagtagggtctctggggccatggaatgatccacacaggccctggcatgggagggactggttccatctcaatctgaaaatcagacaaaggtttatttcttacttctgttatgcaatgttggcaggttgttctgactcttttccagttcctgaatattacttgttgtataataaaaatgatattctaactaaaaattttaaagaaaaaaatttgcaatcttgcagtttaatgcaaccatagtcttagcatttttgtctgtgttctcttttcaatctttgtttataaacatatatgtttctacatagagctgattgtaagaggtatagaattccacactttataaatgccttgttaatttattgttttccatgttgtcacatagacttcaggggtctcctctcaactgactgcaaattactcactgagttggtgccccattatgtcctcggtcatttcccctatcgttgagcatttacaacttttctaatgattgacttttaaatttcttgaaattattgagttaaagggagcagaattttaacaacttttgttatgtgtcactaaatcccttttcaaaagattgtactgatttacaatgccaattaaatgttttacaagtattattttccaactatgtgaggattatttttgtttatttccatatatctctatctctcctctccaaccagccaaaaaataaaaataaaaataaaaataaaagtactcaagggtgagttaggatatagacatacatatatgcttatgtgtttacatttactacgaatgtctaagcttcaaatattgaattctacagatattctctcactgagagacaagaataactgacttatccaggctgcaagtctggtgcttgttctatttgatagtctgatgctgtaagttttttgtcacaaactctgaagagtaaagtggaaactttgactttttgcttctgattgcagatttctatccaaagagggagttgagggaaatgcttcctgttgtcctaattacacagtactaagtgaacactggatatggagtcagaagggaaagtagacttgtgagcccatcacatatggagaaaacacttttggttcccattgttggcagggacagggaggcaggccatgttgcctttcacaaaaaaaaaaaaaaaaaaaaaaaattctgctaccatccctgggagctattgttagaaggtcatgttcaacaaactcgcaaagtgttttcttgattgttgtttgtgtcaccattactcaacgttgtgtagaatgtagtcaggtgatattatccccaattttataccgagacttattttaggtggattatatgactcagtcagaatcgcatcaaagcagaaccagaaccaagtttgttttcaactccagtgcttctttccgaagttttatttccattgtcagccacttaactattttaaaacgtatcttttggaatagggatctctcaataggaatccacagcaaagatgaagagaaaactagatcagttgccttggcaattttgtccactcagaccaggacattcagggatttctagattgaatttgtgtttccttctgactacattgttgaaatgatctggatcatctcctaatcttgctcttggactctctaggtgtattctcagtgtctgtgagggagggcatgtgttttaagcagtaaattcctaaaggcctgtggaggcccaaggccatgcacactgagggagttgtggatcaagtggcatgatgggcccagtctatttctggcagagctgttattttagctgttattctctttggccagttatctcccttagagtagtgcctctttaaatgctttttcatttggtgaaatctaaaaatttgtctctaaaaggcatgctgccaggcctcttttcatattaaagtggtcatctccacattgtagatagtaaatcatgttcaaagaaaagaccttaaaaattcttcatattgccttgcagaaatcacagtattttagatgtgttggggagcttcacaatcactcagtttaacccattcatgttacagacagggaaactgaggcctggtgactttcccagttattaacaaggtagtgactgagaagggacttcagttcgctgtttttaatgactgtatagtgagcatctgatgtttggtcttctacagaaagggaacagagttgactaaagtgaaaataccctagttcagacatcagaggcaaaaaaattaatcataatcacaacagcaccttacagttgtggagtcctttatagtttttagactcttagacacagagaaatagagaaatataaatatggaaaataaggtttatttgatattttatgaaatggaaccctaattcaccaacatttttacccctttatagtactgcaataatttgttgtgagactctgaaatcgtttctgaattatcagaggaagaaaatcatttaaaaaaggaaaccagagctactggctctatcttacttcggtcatggtcttttaaaatctattcaatttattttaactagactaattcattcttaaagtaagtcagctaacatggaattttctgaggttacttaaaaaattttggaaatttccttagctctgcatgaagtatttttatctcttcttcttcttttttttctaaagaaatagtgtttgtgggtcttgataactgcccacaacagattttatatcatctggttttgatagagcaagggggtctaatgaatgattgaaactaacatttataaaatctttcaaatttgagaggcaggttcttggaagaaggaggatacaacagaatggcctctgtgtcactggtaggactctgaagacaggacttactgcctatgttccgacatgaagaaacagactagtgaagtatgttgtcaaaactttgagaattgtaaagcaatgttcacatgtaggttgataaaaataacagaagaagttatgttaacctaggtccgaccctaggtgctgtcatgttgtcactaccttcataataagcttcaaagaggtgctctgttattatctttaaaaattacagacgaggaaactaaggtttagacagtgttagtaacttgctcagggccagtcactcaatgtgtggcagagctggattccaagtcagtgctgtctggctctaaagcttagattcttttcattgcacttttattattaaaccaaagaacttatgattaaaatattttctgctttccttgacgatttatttcaagatctaaccatttctttttcctggacattctgagcagggagcactagctctcaacttccctgcctctaccctctggctgggctgcaccttctcctgctgcctgttcctcctgcttcatcagcacacagtgggactatacattagccagggtgttagacaggccctccctggaccttgtcttactttcccccttgtgttatgaggacaagctctgtagtaactacattgagaatcttaggagcaaaggctccccacccccatgggggcacgtcagtgacatttggctcctccattttgcttaagaaacctgtgaccagaccctcaccccaggcccatagtgagaaaagcctgttttcatttcttctttcaccaagcccatctggatagagcaggtgcagggctaggctcttaaaatagaagcccttgtttcatgtgacgtggcacggtggaaactcccttgcttccttgcctgttgatcagattaatgaaatgatgaaggtctctcccctcatcgtggtgttttcttgacttcctgtcattgtcagttgacctttctagtttcttcatttgtaaaatacaggacttgttcttcataacctcaagggtccctcctatctttgataatctgtctccatgcttccgattaggggtcagattttggaatttaccatttctatcttgtttatttctcccagcaatattattccagcaggaatagctgggactaaaacttattcttggttaaagcacatcatctcaccatcttgacatcccatttgctctataccatcaaccatctctgaccctgaaccccagtctccttctttgtaatttaggaataataataccttattcatggtgtgaatcatatgagagagaggatttaacattgcttagcaagtgatacacattaggcattcagacaatgcttgttcacttggggtcaaataataaggtccattttctcttcatgacttctagctattgattagctttgaggctgaaaaataagtttaagatgggccctctgacctcaagaggctagcaatattttatcttctttttaacgctatctcctataggaaggaaagctagcaatattttggataagacaaaataaatacatatgaaacagagaatggattaagtctggaaaatccttccagtgctacacctaggacaaggtaccccatgcagagcaggtaaattcttaaaaggatggtctctgagtcaaattttggagagtgaagtgccagcatagctgatcatcctaagaaaaagtcaagaccgcaagttatgggttccaacagtggagaaaaggctaaggaaattatgcactgttagtaagatagaatgatgtgcaccattcaaaatggtcaatatgatgcataagtagaaaaaaagaagtgctgtgaaacaacagcaagtgaaagaatttgaacacaaaattctagtaatagtgtcaatggctatgtatgaagatactcagataaatgttagaaaagaatataatgtgggaaatgaaaataatagatgtgttagggttatgggtttttggatgaatttcaaaaacattccttttattaggctttcacttcttaagtcaaacattttgaaaaatttcacattgtatgacttggattgcataatataccagttcctgggctaaggttccatctttctctggggcaggatttcctctctggttttcatcgtgatctctgcctttgaatggcttgctttttcttttaagagaaaaaagtatgacaaatccagtaggtgatggaatcctctctcttccatttatatttctgtggatcttccttctcaaattgcctataacttcatattgaatctgaagaaagggagagtttctaggagccctgatataagggctcagggatttgtgctgccatttctttagaaaatgcctgattttcccaagaatgggtcagctctaatggaggtacctattccttcaaggaaaagcagtcaacttagcaaacaggtaattccagaggtgatttacgttttactttggcagatggagccttcattttcaatagaactccctgtgaacttcctttaaaagtgttttgacttttctggaacacatggactccatgcagtgacgtgcccggtaggcagtaatgcatacttagggctggccttccacagcttgagtaggtgggttccctttaaatgaaacaatctgaagagatgcaacacaactgtgacccttggtggtcttccagcttttaatctgattcaggccactcatttcaaccctatgcaagccaatttgacgcaaatgagtccaatctaaccagtccaaaaaatacttgggtgtttgtgccaataaatctaacgatcaaatcattcccccttgaattagaagttaacaagacaggatagctcatactgccctctagtcattcctgccaccattaagaagcctggggctctttcttaccccatgtgccaacttctcagggcctccttgtctaattttgcttgagaatgtagagtagaggaaggagaaatggacagacagcctagagaagtgacttacagtctgggttcagctctaactactaatagtgttgaggacgtcagtcagcttctcgaagtctcagtctccatatttgttaaaataaagagggtagtctggtttttctggccccttctctcctgtcctcctagactatgaattcatttttagctttttaatgcaaatttttgattcattagaatctagcttcttcactctgccacttttagttggctcttcttagagcattagtgcccaatttgcactgttagaattttcccttgtttgtacccttcaaaatttttctttttttgggcaaggattgtatttttttctttttaactggctccttgaggatagatgttgtgatatctgtgtgcttgtatgtcctcaactgtgccctgcactgttagggcccttgtcaaaacaacacatttctcagtgattctgagactctttctcttatctatagaagtcataactcaagagtaaaatcataccaatattttacataaaccctagaatttttatagatctattatttctttttagagtacatattggaagtaacttcacaaggaacattttctttacttttttttttggaaaaaagatttatgcttataaccaaatgaggttgtttggcaaatttgtctggagagacacacacactcagggcaaataggcactcctttcctgggcaactcaattacctcttgcctctggtcaaaccactccacaaataaagtggactgatcctcttgactctatgtgtaagtgcccattgtgtgtgcacagagctggtgagaacggccatggtgctaggtgggggtggtgttggtggagttggactagattatctgggatcatgcgaaatggaaattcatttctagctggctggcttcagaaggtgccatctcctatttttatatgaagcgtgctttggaactcagggcaacgaagggtgggtgtgctgcacaaggacagcagaagagtgagctgactggtccctgaaatcgcagttggaaagtggattaccagtgcagtagaactcttcacggaggcctggaccatcaggtctaatggtgttgttccaggtgggtggtcatgtggagcaaaaatatttgaaatcagcgagcacgtacctgagagatgacttttccacttgggctagtctcttgatatttctggtcctgtttcttcatctgtaaactgggttagtaatgtcacactctgtgagttggtgcatccagataacaaacaaacaaacccacacacagaaaaacaatccccataaatgccctataaacttatattaatcatcaacaattcatttatttgttcactcacttatttattcaacaaatactcgtatgaccaaagcactgtgctttgtgctaagctctacaataaatatagaattgtataaagatcaaggagtaaaaatcctagttcaggtcctcaataaatgataggtgaatcatagactgaaacgtggaagtaaagtaaggaggtcttccacgactattgtgatcttcaaatgttcttttgggtgcagagtttccccgggaaactgccagtttctataatggacaaaagactttgcttttcaggagtatatattttgataggaaataaagatagaaatacttggaacttagacaaattaaatacataaatgatggatagtatgtagggaatacagtactgtggggaatcaaagagagggtgaattctgggtgaaatcaggagggtttctcattattcacagatgatctcttacaggaggtgggaatttttaggtcagctggaaatggaaccaggctttcatgttcagatatacttgcagataaacaactcataagaattataagactaacagcttcgttagtttacatttgacaatttatttgtgcctcattattttgggatgtgtcaagaatctgataacatgggtgataatgctatttgccactgtaatatcaggtagtcctagtgaaaatgcaacttttaagaacttgtttaattgtatctaccaactcttactgcagaatgtagacttgaaagaagcacattcctttttcttacataatcattaggggttactacatttctgagcaacaaggctcaagagtttccaatggaaatgtaatttcaattagaaaaccaaattgaggttgagggtggagagagccagctgcagaaggtatctggacagcagcatgtatctgcaggcctgcgtgtgtgccagggtgggggcaaggaggggtagattgtgtcattttccacatatgtttatttagcttctcctgtttcagggactttgggttttattaatagtcaatttaggatattgtgcctccatcctcaagcattgtcaatcttaaaaggatgggtgggagtggtaggcattaagcctcagaatcttctagccctttggctggagtggttctgtctgctattgctgcaacctgaggaaatctttcaaattctgggtgggctgctctggttaatatagtggagactctaacaaaaattatgtcatccagcaatagagctctggtgcagtgagtggcagactaactgatgaacatctcaatgcacagcaattctcagcagccctcagccagggcactcctagggagggcctctggttacaatgctcttcagagcctgcccagtctgtctctgtttctctgtcttttctttcctttctcattattcccatcactattattgtttctctttctctaaggtctgtatattatcctttcccctagttctttgaaaaatttacttcagttgcacacacaatagaattaaatgataaacatcaattttctaaataaaatgctgtgtacacccacactcacacccacagagtattttctatttcttaacaacaacaagaaaaacaacaaaatgcatagtaagaattaaaaaatctggaggaatattgaaggccagggcagattatttgtttagattagtgatccttaacccagaatttcctcacatctagattattgtctggtggatgacaaaggaaaatatatattggaaacccagttgtggatccttgagaatacagtagaaagaacagtgaaaattgaaagggaaaaggtgagaaaaccttcttattcatgtccaggaacagaattgggcttgaatttggtggctgcagctctgaacggactcaaagtgagtgtctgtaaatcctgctcagcaacacgaggacaggggttgccatgtcctcctcttccttatgtaccttccctcatctgcctccctatctctagcacatggaccaggggctcataaatgtctgtaggatggaaaaatctaggaatacatgtggggtcagaagttgtaagagattgggttgaatatattctgattccccaagttgtttttgtctacttattttctttttcttctctgtgatggttctttttttcttgttatttgtatctttgcacaatgaaagacaaaaaaaaaaatagttctagtcactagaggacttcagtaaacatgctatcacttacctgcttatgaaccaagaggttgggaaggcaggtctcagttggcatgtagcccgagaagagtttgtcacatcttagagtctagaacctcctttcccacagagatacaaaacacacagttaactcactggtattttggctgggaagatagctgaatgatagcaccactttaaatcatatagtgatgactgctgctgatgatgcacatttcttttcagtatgaaatattagttttttgggaaatccaatgttcaccctaatcttgcagcattttgtaatttccatcatggcactgagcaggaggcaggatgggctgaagggaaatacactgaactgaactggatccttaggcctgtgggtgagacacagtattggcagatagtgccttcaccttgtggctcagtttcttcaggtttcaaaattgagagacttttttcacttttacatgttaagtaggtaaggatgaacggaaggattgtgatgtattgcatattggaagaaacaaaggtatcaggtcaaaattaagaagggtttatttgtggaattactgcagggagaatatccactgagctcagccattgaactcaagaacctgttagtaattaagaatatgaaaagattgtgaattgagcaccttctctgcaccatgccccgtacaaagtggattatacacaatatttcatttgctgttcacagtgatgttgacatagaggtttattgttattgctttattataaacaagtaaccccaaacaaagaggggataaaaaagtgatagattcccatgtgagagctcactaacccatggtatcccaatcagagggctagagcattggaatgacgtgtgaagacactgttgatgttaggtaattcccaggttggttaatgtttgggcaggaggggtataacttctctggcctccaatatgtgttaggcaccccttctgtgtgcttacgtagagctctgtaggcactcctctcagctccatttctccatgttgcaatttctggttatttgtttatacactactctaggagctccttgaggtagagagttctgtcttgttgactatgttatctgcaaatcttcatagagagccaggtacatggaaatgctaatacatttctatggaattagtgaaggtggacattcatacgtccaggcatatgaacaggtttttctctggagttggtgttgtttggtgtagaagggctgtcaatgagccttatgacttgaggaaggatcaacagatgggtggatagaagtacagatggttatatgcatggatggaaagggaatatggtagaagagaatgcttctgtcatgggctctaggaagtttactgaaatatattctgaaaggttgatatgtatagttcatccttattcttcccagcctctcttttctgagatgaccaaactattcaacataaatggtttcctgctgctcttaaatatttccaggacacttctgggtctcctgaagcacctgcttgctcacagcttcattctcacgtgaagtctgcataggtcctgttaccatatcagaactcttagaggacacttattctgggctgaggttttccaaggtgagaactccaggactggagatggagcagtgcatttaggtgaagtgatatcaaacaaggttggggttggtgttacttcccatcccagtgctggacacagccttggccaggtcctgttgtgaccccaggtgcacggggccttgggaacttctgaaagggtgtggagtgctccacccagccctgttggaggaggatgggagcgaaagcaacagatgtgctcaaggttctgttttcagttccccaaagggtcttctccttgaccaaagcagtgtgacggttgctatgacagttgctatcttggtccctgggactctccctcataaggtagcattactttttttaatcttctcaggcaagtaaccatgaaactctgtaataaccagtctgaggtggggctggttgggggcatgtttgggcctgagtactgggatgtgatggtggaatatgctggggtaccaagaggtacctttgattaatgagttatttttccaaattagaccaacactcctcctagttgtcttaggcttgatgactctccatttctgcagaagttcagaattcttcccttgagatgtctgcaattagttcattgttgcaaattataaaaacataacaggtagaaagaacactgaccttgaatctcaaatctgtctctaccaggtcatgtcattcagtctctgcttgggtcttctcatgtgttaaatgagagctttgatttccaagctccttttcactctgagagtcactgatgttttgcctctgaaaatggcaaccatgaagagtagttactgagaaaccagcactgtgttttagagttagggctcttgatcaggctgcctcattttgaatcctgatttgggaatttctgatgatgtgatcttggacatggtattgactttctctaagtcttagtttttttttttttttttatctgcaaaagagggtaaaacaagctaccccagaggctgctggaagattcagtgacatgttgcttgtcagtgttgagacattgtatccattacaactatcatagaataaaaacctgttacaagttggcatgggccgagctgccagcaatttcatacatctcttttatgcctattttgtttttcattttgatcatcaatattttaatggtgtgtcataaattgggggctctttcttatttgttcttggacccatggtgaaataaaagcttgtatatttttttagaaggattcatagagatgaaaggcccttactgaacattcagtctgaccttattagttttaaaggagctgactgagacctaactgttattattacaaactgatattattggaaaccaacacagaacctaccatgtgcaaaactgtgggaaaggcttggaagtctgggtttgacaacctgagtttaaatagtgattctttgtcttactagctccgtaatcccaaacacgtaatgcaatctttcttagtctgtttcttcatctatgagacagggctaatgagaaacatctcagtgtatggtatgacagcaaagggggtcatacaggtgacagtgctagcaaatgtcagtcccctcctcttctctacctcccaactcccttgaccctctcctctgtcatcccttttctggctgcgtgcagagaatcttgctagctttagggatacaaaaggttccagagttgggagacagactgttctcatacagagatcaataaccacatgatatgggtagtaagggccattcagatcctgagaagagtttggcaggtcaatggagggtggaaaggatgagaggaactggggagagagacagagaagagggaaggaaaaggaagggagaaaagaggacattgtgtatctgagaacaggaaaggagcaagtggaatggaagaaggagagggaaggcagcaggtgagggcatgtctgttggggtgtttatggagggttttttcagggaaagggtctgcaaatggagccaacaagaaaggaactggcaggtggtcaggatgtcctcctgtgagagtcactcttctccccatcctctctcctcttagcttcaccctcgctagaacttttccttgctcatttcaattttcaagattttcccaagcttctaaacctacaaaatctaagcgacacacatttactggagaaatcacaaacagatcccagccctcctgtggacctctctgcatctgtgccctggatacctctttctcctttgtttctgtggatgaaacatctgtgttcctagctgaggatgatacctctacctgtcttcacccacccttctcacctactcaggaacattgctccagcaatttctcttctctcctcttcagcaccagcttttccctttctaccaaatcattcttatcagcacttaaaaatgctgtcgtttctctccatttaaaataaaccctcacctgtgtatcatgtagaactatcaataagaaaaatattaaaaaataagaaaataaagaaaaaagataaaatatatcctctgtagagcccctttgtccttccagtgaccacctcatttctctccttccctcttctaattctctccttgaaagcattgtccatgcatgctctctccaatttcttcgctctcattctcttttgaacccatttggatcagacttttgcccctggcattctatagaaactgcacttgtctagttcaccagtgattcccaatatggctaaatccaatggcccatttccattcctaatcttggttgacttgtcatcagcaattgacacagttgatccattttttcctctttgtaacatttttcctcttggatcctaggataacaacactgtcctgtttttttcatctccttctctagccagtctatttcaatcttcttttctggttcctcctcatcttgctgacttctttacgttggagtgcctcctggctcagtgcttggatttcttttttggtatgtcgttgctaggtactctctcccagtctgatggctttttacaccatgtgtgtggtgatgacatcacgtttgtgtctccagcactgacctcttgcttctgaattctagactcttatagccagttgtccatctgacatctccactttgttgtctaatagacatctcagactcaacgtacccaaaacagagctcctaaagcttcaggaatcgagactgtgtctattgacataaggataataaaattgattaggggaattaaataaaatagaaatagaccaaacttacattgtcatttgatttccaacaaaagcaccaaagcaatctaatgggaaagaaaagtctttacacgaatagtgctggaattttcagcagctcatgaaatgtatatatattttatgaaaaaaagtaaaaataaaagtaaaaaatggtgctggaacagctgcacatccacatggaaaaaatgaaccttgacccttacctcatgctatacacaaaaattaattccaggtgaattaaagttgagctcccaaacctatgcctatgttctatagacttcttcatttcagttaaggcaactctatccttccaattcatcaggctgaaaaccctggattcccccttcagttttctctcttccccacatcaacactagcagtgcttcctggcagggctactttcaaagtagcttcatctcctgcttggattatgtaacaggctcccaactggggtttccacacatcttcctatcccaccctggatgggttattctcatcagatcacccagagaaatcctgtttatgtatgtcagatgatattattattatttttattatttttgagacagggtctcactctgtctctcaggctgcagtacagtagcacgatcacagcttactgcagcctccacctccctgggctccctacctcagcctcccaagtagctaggactacaggcacacaccaccacgcctggctaattgtttgtataatattttttgtagagacagggtttccccatgttgcctagtctggtctcaaactccacccacctcagcctccctaagtgctgggattactggcgtgagccaccgtctccggcctcaatattattattttgctcaaagcctaccagcctcatctcacttaaaagaaatgcttcctgtgacccacaaaacccgacatgacctgccctccctataaccctgtgtcatgagcactccgggcacatgcccacctcagggctttttatttgcagttcctgctgtgctcttacctatttatccacatggtttacttcccacttcatttaaatctttacctgaatgctaccttcttagtgacacctttcctgatgaccctgtcaaaacttataaccctcctccaacaattcctgcccttgctttaatgctctgtttaccccgtcgttatctaaaatactatattttaaaatttatcaatctttatcatttatctccccagctagactataagcttcacaaaggcagggagttttacctgtgtgatagcctcaggatcaaagacagtacctggcacatttcaggcattcaatacatacttactgaatgaaagaataaagtgtggccaggcgcggtggctcacacctgtaatcccagcactttgggagactgaggtgggtggatcatctgtggtcaggagtttgaggccagcctgacgaacatggtgaaaccctgtctccactaaaaatacaaaattaaccgggcatagtggcacatgcttgtaatcccagctactcaggaggctgaggcaggagaatcacttgaacctgggaggcagaggttgcagtgagctgagattgcaccattgcactccagcgtggacaacaagagcaaaactccatctcaaaaaaaaaaaaaaaaaagactaaattgtgattgaggtttacagatgactggtcagtgtttcccatatccccaaactgttttcctgcttgatgctattatttcatggggcaagttcaatttccttatccattgcttgactgtccaattagattggcagagcgttaatggcaaggactgtgtatcttatcttgtactgttctatatcctccactattgctgccattgtgagggggaacaagggagtggcttccctccatccagttccctacatcatatgtcatatcatacaaatatattagtatttataaatatattaggtctacctccttctctgtgcaaaatatgtcatatcaatgtctgagttctagtatgttcatattcttgggcaattatgtaattatggcttatgttgtcataacttctatgcccgtatttataagaaaaaaatattgagagcatttccaggaaaataattgactggaagaagagagagtggtaaaaaggaattaatagtgagctaactatcagtatatacaagcccagccttctaggatctggataacccgaagcaagaatttctctgtcagttttctcatctgtataatggtgagagtgggggtgttgaagtagaaaaatcctttgattaatatttattctaatccttgactaggtgctcagtgttagtccagggaactctatcttatttcttcatgggccagcttaatgtcaagatccaaaactcttgtgtaaagcttgggaccattttcaaggatacatttagtagtttacaataatctagataacactgactgatagaaatatgcaggaaatacagaaaattataatgtgatccacatatataatttagaagttttcactagccatgttataaaagtaaaaagaaatctgtgcaatcaattttaataatatttttgtttgcacacaagatatacagggtaatctcaacatgtaatcatataaaatattaatattttacacgtattttttgtacaaaatgttaaaaattggatgtgtttttacacgtatagcccatcttagtatggactggccttatctccagagctcaataactctgtgtggctagtggcaggatattggatatcaagtctagaacatacgtgaattaattcaaggttcaagcacattaaggctgaaagagttatgactgaagaacaagttcaaggaggaaatcaaacaatagccaaatttcactgagctactccttccattactaatgataacaaatatttatagatcccttagtatatactaggcctgatgcttagaactttatatgaactgtttcatttaatcctcacagcaatcttacaagtaagacctccaccccctttcagatgagaaaactgaagcacaaaagtgcagtaacttgctattatgacttgtgagcatattttcccaggcaattatatgcacagtatgatgtaggtaaagcagcccaataatttattcactatatttctccatgctcatggtaaggactgacttgatccctggtggtcacccacttgtgctccctcagtgagggaagggctgcagagcccctggcccgtgtcctagtgactcaggcttgggatctccagcagctgctatggttgacaatttagtttagtaaaatgttagatcctaccctgataactgttataaaaaatcctccttccccttccccagcacaggtacccagcccaaggggcactttctatggaaagatgaaaagaactgacatggacttgagctcactgggggtgcaggtttcaagaaagaacaaagagagctgttaggttgaagagacgcagttgaagagttaagtcttggaattgttaatacctggaacaaggcacggtgtgaaaagacaaagaaacacacaaacatcaatctgtcctcctcttttctctttctgtttcatttcttatcctccatcagtcagactttgcttcctctttctcctccttcacctcctcctccctgcccttcccaatttctttctatcttccatttattgttcttccaaaattcgtatactcatcctctcttctccctttctcttttctccaaaataatatgttcaacttactgacttgctcagggacttgtgggggcgaatgtattagcaccaaacctaggaaacatggcgaattctaaaaacttgttctcatagaaaaaagagttaaaaatagaaagctacagtccagttttgaagccacagaagacctcactctgatgtatagacattagagtcagaaaaagactttgaaaagaccagtgaagctccttgtcccacagacagtgtgagggagggacaaggggaattgtgtgcccaagcgtacttgggatggtgtaggtggctgataagagtgtcagtggaggtggtggttagcatttggagtgccccaatcttgtgacactaaacatttattgttatactaaccccactgccaactaccaggaagttttcatttttcttactgtgtcttagtctccatggcatctataaactgttttcccccaatgtccaggcatcattcctctcccacagttgatgtctggctctgtgccatgggtgtgggcctgcctcttctctctcagaatgactgctgtttcatgcttggtgagccacgcagtatgccaagctgctgtctctgacctggagaaaggatacccatcctaccacaggtggggcatatcatgggatggccttcctggttttccttggcagacacatttttctcacttttttttttctctcctcccttctctttttccctccctctttgatttcttctcttttccttttctttctcttgcctcacttctgccctagatctaccatgggacccagggagctttggagccatgcaacccacagtgtgctaagctttttactcatgctatttcttttaatcttcacaattctttacctatcaggcattaccatcagatctgcaccttacaggtgagaaagggaggcccacaccgattaagaaatgtgctcagggccacacagcctgtacatgtcagagtaagggcattctcatgccaaggttcattttcagagccaaaagcataccacgtctcaggagaagcaggctagatctcttgtctgcttggcttttaactcatgctgacctgaactttctggatttgagtaactctcagacctgtggagcccgatttctgtgagtggattttgccagccacctggggaggtgaacccttgctggggtatggctcatcagtgtagaagggagttccttcagaggtacgctgtcttctcggccatccccattgtagtagtttcttgggtctgccctaacaaagtaccacaaactaagagccgtaaaacaacagaagtttattctgtcataggtctggagacagaaatctgaattcaaggcacaggcagagttagtgtcttctgcaggttctcggggagaaaccatcccacacctctccagcttctggtggctcccagcaatccttggtgctctttggctctcagctgcatccctctggtctctgcctccttggtcatgtggctttcttcctatgtgtcactgcatctccaatctccttcttcttataaggacaccagtcattggatttagggcccactcggatccagcataaaaaaaaagtttaaaaaaattatttggaaataattatagattcacagaaagtagcaaagacaggatataaagcacagaggtctgatgtgtcctgcacccagtttctcctgttggttacttcttacgtaattacagtacgatattaaaaccaagaatttgacattgataaaataagtgtgtacagttctatgtcattttatcacatgtctagatgcctgcaactaccactgcaatcaagatacagatttatcccatgatcacaaagatctccctttatagtttcgcctactcttctttctccaccaccctaacccctggcaaccagaatctgttctctatccctataattttgtcacttcaacaatgttacataaaaggaatcacatggtatgtgaccctttcagattggcttttttcactcagtagaaagtccttcagaatcactccagttctctgtatcaacacttcgttcctttttattgcctcatagcattctatggcatggatatattacaatttgttaggctagttgcctattgagggatgggttggctctttctagctttggctacaacaaataaagctgctgtgaacaatcatgtatgggttctgtgtggacataagtttttatttcctgggggtaaattcccaaggagtacaattcctgggtcatatggtaggtgtcttttgtttagtttttcaagaaactgacaactattttctagagtagctatacccttttatattcccaccagcaatatatgaatgatccattttcaccgcatcctcacaaacatttcagtatgacctaattttgacttgattacctctgcaaagaccctatttccaaataaagtcacatttatgtgacccatttatgagtaccaagagcaaggagttgagcatacctttttgaaggacacaattccacctgcagcacctgtcttcacttgcttaggttatgggtgggtttcccttcagagtgttatcttctgagaagaaggtttgaattcatagctggattatgcctgcctttgattgttcaatttggcccccagggatgagtgagcaagttcatgtcattggaagggacattactgagtctcacccctactcaaacctccaaagtttgaaagatttgatactcatcaacattctcaagaggcagaagggcaaggtgcttccttatgtagtttctccatgactgtccttccccactttcccagtactgactggaaagaaaaacaaagcaggacaaagggattgtcagtcatttgagggaagggatgctgtgttagttactcctgaaccccttcagagtgtaggcagagagaggtacttagaaaggtgtgttggatggatgagtagctgagaggggcagggccagagtgccccatagaatgaggaagagtcctcatttacatgtgcccttcccccttcccaaacatgtgagtgttcatacatgggtttccagtgtctgggcaaggttaattctgtcctctgtccccttgctgaaggtctgtttcatttaatttctatgtatgtgtgctcctagctagccaaacagggcacagatgccaggaaaatagcaggcctgttgttttgttgagcaccttgagccctggaaggcagactcattcagggctcaagagggcaggattaggcaggtagctatttgatcccaggcccccccacttaccagctgcgtggtcttgacctattacttattcctcttctatctattaactgggtataagatgttctttatgtgaagttattttgaagcataatgtgtatacagaacagtgcacagatcataactgcacaaccccacacgaggaacagaacattaccaagaccccagaagccccttcttgtcttctcccaggcactaactcgcccacccccagctaagagtaatttccatccaaatttctaactttatttttacctggttttgaactttatatggatgaaaacatacagaacatatcttttgcattgagtttctcttatgtaacattatttttatgagattcatctgtgtgagtaggtatagttgtagcttgttaattctcctcattgggtattctaatgtataaacataccacagtttaataactcattctattgttggacaatcgggctatttccaatttttggcttttgtaaataaagctgctttgaacattcttgcatagttttttggtgggtggggacactcagtcatctagaagtgggattgctgagttatagaatatatttgtctctcagctttatagaacctttgcaacattttaatgaatgtttttaatctcacagtatagtgtggattaaattaggttgtggaaagtactcaatacggcccttggcagacaggagtccctcagtacctgtttaaaaatgtaaataaggcatgacattccattaagtctaagtaccatgatgaacttaaacatttccctattgtttgtttatttaattgcttttattgtgttgttattttatatcatgttgcaatgaatgattctctttatagcaggtttcttcttttgaaaaatttgctttggttgattctcagggaattgaatcaaaggatatatgactgtaagacctgtcacccttaaaaaggactatgagggcttgctgaggaggggaaaacaaggaagcaagtctctcctaccatggcccaggggactgtgaggacagaaggcttgtgggtttgagggaggactgtcttgcagaggatgatagggtaaaatagaatgaaggatgatttttataaatggttatgcgccttaggatgactacatatttagtcccttataagagaaattgagtagttggtaaaacaacagataataattattaaatgaggaaagagagaaaccacaggtgcaaagattcactttatttattcattctcctccaacattagcataattaaagccaaggaggaggaggggggtgaggtgaaagatgagctggaggaccgcaataggggtaggtcccctgtggaaaaagggtcagaggccaaaggatgggagggggtcaggctggaactgaggagcaggtgggggcacttctccctctaacactctcccctgttgaagctctttgtgacgggcgagctcaggccctgatgggtgacttcgcaggcgtagactttgtgtttctcgtagtctgctttgctcagcgtcagggtgctgctgaggctgtaggtgctgtccttgctgtcctgctctgtgacactctcctgggagttacccgattggagggcgttatccaccttccactgtactttggcctctctgggatagaagttattcagcaggcacacaacagaggcagttccagatttcaactgctcatcagatggcgggaagatgaagacagatggtgcagccacagttcctgaggaaagaagcaaacaggatggtgtttaagtaacaaagttctgcccttgggtgtgttgtttgcggataatcacagggcatgttagggacagacagaaaacagcatgcttatcccagataattatagcaaggagaccaagaagcgtatttaaaatcttgatgttttgagtttcttcctagcttccccctattccttaataaagttctaaattgttttgttggagctctttgcagccattctgagggctttgcatgcttttctgaccttgcagtaaactcaatgctttaggcaaagaatggccacgtcatccgaccccctcagagtttagaattcagaacaggtctgaagaagaccaggcagcggctgagtcaaggaaagcctccgtccgcttttatttcccctgtgcctcttccaggactgtgctgggataacaggctcccgggggttactttggctgggctgggctaaaacctccctgcagagcaggccctgagccctgcctctgcgcctgggtggtgtcagcccctccaccttctgactgttccagcaactctctaagccctcccaaaggcctcaaggcctgtaaccatatgcagcaattttcagccataccaggagaggtcaactgtaatcttggccacctgcctaagaggaagtggctagcttcacttctgaccctcagcaactgccaggtggcctcttggaaatccccctctgggggattccacccgttgggtgggagagcagtagttaaaatgtaaaataagaatcttttgctgggagaagtcaacagatagggagaagtcagctgataacagaaatagttttttttttttttaaaactaacttcactgttaaccaagcagttcaacatgaaagactgaatctcttatgtttaatattttcttctcttttaatcttcataactaatttttttcagataattgtataaaataaccatggtagcaaaataatgtgatcactggaaaataagcagggaaaaacatgctatgaagatactcctatctgggtgaattcttgatagctttacatttttcatctggcatttaaacattaaacagttaatgtatttgacatgaaaattatttcaagttatcttattagttttaatagagtttaaaaagtgtttaaaagagttttcaaaaggctctaaaatcattttgaaatagtttaaaacagttttgaatcgttgtaagttagttttaatagagctttaaaaaggccctaaaatagtcctatcaagttgttgcagaccaaaataatctccttaaatatcacttttgagatcagctggggtaaacgacagcaacacaatgacaaatcattaaactattttagagattatgaaattaaaatactcagattaaaattttcctatcacagaattaaggtactggaaaatatgtttaagtttttattaatcacattgctataggtttagatattttgtacaactgaaataaaatcacacactggcagctacatttttgaaagttaaaaacatggtcacgaatatatcttattttaaaatcagttaatataccttaatggtatttaatgccaaattcaaagtgaattgatcaagccctcagtggccaggtcatgggtgtgatttttactctgaaagaattacatatttctttctttttggttgagcttttgttatttaaatacatttgatgagaggatattgaaataattaaatagcactgaaaaaaaaaaaagctttaaattatttacaatcccctaatggaaattttcactaatgagatatcataatgaatgtgaattttatttctgaaatctctaataaatcagtcttctccctggttttcccagctcagcgcccattacgtttctgttctctttcccttagtggcattatttgtatcactgtgcatcaggaaagctggctacggcagcatcaatcgggcagacacagggtggccacggccactagcggcaaggcggctgccccaagagcgcggtggcatggccaccaaagccactcaatcgagaaagaccgcggctctgtctacagctcgcggtgccacggccttcttggcagaataaaaatgtagacaagtaataacagaggataatgaaagaacatactctttaaaatatttcctatttttttcacagacccacggtcattaaaaaatgcaattatttactttttttcatttaaacacatttctttgagattgagcttttgggaataaccacctttccaccattacaataagagataatttcacgtttagtctaatgtacaaattggatttttaaaaaatgagctctatctgtgaagcccttattcctatagaatgtgtctttttgagtttattacttattacagactctaaaaacaacattgctgctgattttcaagtaagctgcctcttctacatagcaaataggtacacttcacttttccctgatttttcttagggcgtgctattgatttttattgttgtctgacaaaataatttatcaaacaaaagggagaaagactaaaaaatgtatttttccacttttctgtatcatgcataatcagcaacaaccaatacaatatttggcaagagtgaacaaaaataaatttacttttgctccttagaaatacaagggttcctttttagttacactttttttttttactttgtgtcattcagtttagagcaatttaatctttttttctccaaatccatttttgaagctgagtttaacttttgcaacccatggcaaatcttaaatgccctcatttaccaatctttaccaaactcctatttaagcctctaaaagtcaatactggccatcagacccaaatttcagaagacaatagtgaaaaattacttacgtttaatctccagtcgtgtcccttggccgaaggtgatccacagtgttaacttaattactttccccttaacaaaaatctcttttcgctgttaatatcactaacctgaccgatgcagagaaaatcttgcaattgagatgcctcacttaactggctagcgcttggctgttccttaagatgaactaattttctatcccttactcatctgactttttgaaagaatctggtactctttggaattgacctgagctaatatctcaaacacaaaaacgctccaaatttaaaaccttataagaaaaagcattaggaaagtgcacttacgtttgatctccaccttggtccctccgccgaaagtgagccacagtgagggatctcaccctttcccctcaacaaaaacctctcttgaagccaatcatatgagataggctgcttgttcagagaaaaatctagctatttcttccccatttcccccatgaatcctattctcctctcaaacccaatgattcgtctatttgctcagctttttaagttcattttctggtgtcctgctatttacttctgggtcaccaggtttattcaaccaaaatatcacaaaacttgcacaaatgatacaatggcactaaaatctcacgaataattgagacagatgtacttacgtttgatatccactttggtcccagggccgaaagtgaatcacagtgattcgtcttaacttttccctttacaaaaacctccctgaaagctcagcaagcctctttcccccaatgaagttattttgatttagaaatcttaaaaattagccacaagctagcgtcctgtggaacaatttcccctcctctgtacctaacctgggaatgaagtttgttagatccctggcatccgactaatgaaaatccacacaaaggaacacaaagtaaactaattagcaacagtgaagaatcagtggaaaaaagtacttacgtttgatctccagcttggtcccctggccaaaactgcacacacaatggttcctcttaacttccctcctatacaaaaactccctttctgacaattgaccaaggctctgtccagaacatgttatgttccccaggacatttctgaagctattacttagacaagttattctcacccaatgactgaatcttgcttgctcttcaaagaaaatgtgcaatcaattctcgagtttgactacagacttatctttatcttttccctgaaggatatcagaggctgattgcagagtcaccttatagatcacttcatagacacagggaacagaagacacagacaactgaggaagcaaagtttaaattctactcacgtttgatttccaccttggtcccttggccgaacgtccaccacagtgagagctctccattgtcttgctgaacaaaaacccttctcaccaaaggggaacagagtcctgggtcagctgctgaagctcaactcccttttcgagcaggtgtggaaaccctgaggcttctctgacatagcatgtgtttattttcttaggtgagacctaaaatccaagaagagaatatatttacgtctatggcctgatggttcctttctttagcaacttgccacatctggactgcttattatttatttattttttagaaagtagactgaatgttaattacaaagaaaaacaagcaattaaaaaaaatggccagtttttttgtactttcttttggggtgggctgggggggcttttgcaaaggataaacttcatttagtgtaattatggaaatcatcagcttctcaatgagtaataattacaggttgtcttactattttatcttctcctttgctgcaatgttatttaaaaaaaggtagactaaatatatatcaacttaaggctcataactttgaaatgcattttgaaatgtagctccagatggtatacgaaaccaaagtgaagactaatagagtagaaaagtagactttacttggttggtttgtctgttttcacagcacaggaagagctcagctcttactgagctggaccaggcgcatgccatctttggagctgccatggagtcccagtgttccatagtgtttccatagtaatctcatcaacaacactgaagaccttttcagtattttcttttgagtccagctccatttttgcagccttgtatctctcttaaccttccatctccaccccttccatacattactcccacctccctacactccttagagtttttctatggcctccagctttcacaagcactccctctgcttgggaacatctttgtccacctgggttagcttgtgaactgctaattgtctttcaaaattcaactgaagagagaccttctctcagattagccctgagcaggtgacctgaatttacagagtacagagacaggtcactgggcctagagtacctaattattttttattttatttatttattttttttgagacggagtctcgctctgtcgcccaggctggagtgcagtggtgcgatcttggctcactgcaagctccgcctcccgggttcacaccattctcctgcctcagcctcccgactagctgggactaaaggcgcccgccaccacgcctcgctaattttttgtatttttagtagagacggggtttcaccgtgttagccaggatggtctcgatctcctgacctcgtgatccgcccacctcggcctcccaaagtgctgggattacaggcgtgagccaccgcgcccagccgagtgcctgtttatttttacctgctttcagattctcttctacccttctaaattataagctgtttgatgttttatttgccctgtatttgggaggctccgtccagtatctttacttagcaaatgcttaacaaacattttcagaataaataaaaaaaaatacctaattgaaagtcaataatagatcagagatgctatcatagaccaaagactaatactgactgccacaacagtaacttttacaacagaaatcataactacaattctaaagattaggggtaggtttatttgattctgtcactggcagctttgctagttgccttgaatagcagaattagcatttggtctcaccagaagatgaggaaggagagggatcaagttagaggtggagagttaacattggcaagtgaaatttaatgtgcaaaatagctgaccaagggcatagtccttttttaaaggggacacaaagtgattttctctgcagacatacacgcaataccaatcataaagggtgacatttattgagcacttactaagtgccagacattgtacatggatcatcacatttaattattcccaagactctatgaactaggaactaatattatcccctactttgtaggtgcaaaaacttgagggcagagaggtcaaggaactggcttatggcagtaagtggcagagctgtgacctaaactcagatcccatgtttttaactgaactatatgcagattatactccaggagtaaagtcactcaacggaagcaacaagcgtgacagggaatgctgggatgggggaaggtaaaaggaactccttagactgggataagtgtgtacagacgtatgtataagactacacatggaaatattgtttaaagagtgaaaaataactaaaatcctcattaataggagtttggttaaactgtgctagagctttacaatgtagcacaaagcagacattaaggggaagacgtagacttctatatagttacgtggaaggtgtttgtgaaaatgcaggtcactgaagagtatgtgtggtgagatatcatgatcccatctacattgaatatatatgtatataaatacgggctgaattttaaaagacataaattgtgcttggtagttatctcctgggattgcagaggaggaacaatgacactttatgccatctcctcctactcttctgtatggtgatgtgaatatattcattttatagtttttagaaataataaaactgtactaattttgaaaaacagtaaactctgacattgcctattagcattctcgatattcctgtgcaatgcataaacataactttttaaaagatatgtacacacatgtgtgagttttctttgtcaaatacttttctataatctttaaatcaagcatgccaaaaaggtaaaagctttcctgtttcagtgtaggagatagtcgtctgcaaaggaaagagatgtaggggatagaaacaggaatgaaaaagatgactgagctgttcgagggacttatgttcctaagtgagctaattggaaatctaatatgaacagtgcaaccgaataactattgtaaagcagtatttgtaaacaataaaagatgattatcataagtaccattgttgcaaaaactattttattgatcacatgcagtggtgatctgtaggaatgattgttgtgatgtttgctgtaacataaaatgaaacatgggaagtggctgagatctttaggatgtgtgtggttcattttttgaaagcaaatgttgtctcagaagcatctgtgagactctgccaggatccaccgttctacaaaatatctgtgatggacattgataagattgatctgttgaggaaaggcaaggtgtcagtaagatagtctgagagcttcttggatttcatgtaaaagagtgctggaaatagaatttcttggggaacattccaactaactcatcactgaaggtgctttacattgaaccctcagcaaagttagattatcagaaaaaaaatataaactgctgtggaggggacaggaaggaaagtcagggagggaggggggcaaggagagaaagagcgagagagaggagagaaagagagagagagaggagagagagagcacaagtacacacttcaatgcacatctataaatcatcctgaaaactactgataaattattttagcaatgttcctcagatgtaacatttcaagaaatatcatttttgctttttatttggcataatttactagccaatttaggaagttcccctcacatcagtaacatacagtacatcacccagtatgtcagaggacacaatggcataagtttgccttttgcaaggtttgagggatggccatttccctacctgactcaggaaagtctgtagctgatatccatcttcaagtttgtggttctttctctctatatatatatttgagctcagcagtcatgctggagtccagagtaggtgattctttctgctttagcttgactcctccttaagattgtaactctctcagttttacattttttgtcagacgtaagctgacattccacaaggagaggaggaaattctgtggttcacatccagtggtgcttggaacctgattggttgtcattcttccagctagtttgtcacgagtggatatctgtcctggattcccaaggatcaaggctgccccattagccaggaagtagggagatagaggaggtcacttgagaaagagctgcttctttgccgcctccaggttgtgtctgtttcctctcatatctgaagacagatgtgctggcagaagcaaagtcctttgtccggccacgtgcaaatgcatgggacataaatatgaacagagattcttgtcccactctagaaaatgtagatgttcatcttgtttccaaggggacagtaaggctgcaggtgttttttgacttccttgagagaaagagaagatagcagcaattgtatcagggcttactatcctaggaggggttcagccaccgagatttacatattcagtgctgtggtttttgtttcattttgcaagaggaacgagcccctcaagctctgtcttagagttccctgccctccctgtctacctacttggcacccagcccctatgttctcttctcgtattaaggcatagaaatcatgggcaactactgttcaggctggctctggatgaagttgtgaaatcgatgagttggggcttagttttgcagacccccaaatgccctgataatcctggctcgaaggggtgtccagcccctccacacctgtgggtatttctcgtcaggtgggacgagagactgagaaaagaaataagacacagagacaaagtatagagaaggaacagtgggcccaagggaccgtcactcagcatacggaggacccgcgctggcaccggtctctgagttccctcagtatttattgattactattttcactacctcagcaaggggaatgcggcaggagaacagggtgatagtagggagaaggtcagcaagaaaacatgtgagcaaaggaatctgtgtcacaagtaaattcaagggaaggtactatgcctggatgtgcacgtaggccagatttatgcttctctcacccaaacatctcagtgtagtaaagaacaacagagcagcattgccgccagcatatctcgcctccagccacagagcggttttctcctatctcagaatagaacgaatgtacaatcaggttttacactgagacatgccgttcccaggggcatgcaggagacagagggcttcctcttatctcaaccgcaagaggccttcctcttttactaatcctcctcagcgcagacccttcacgggtgtcaggctgggggacggtcagatctttcccatcccgcaaggccatatctcaggctgtctcagtggggagaaaccttggacaatacccagttttcctgggcagaggtccctgcggctttccgcagtgcactgtgcccctagttaatcgagaatggagaatggcgatgacttttaccaagcatactgcctgtaaacatgttgttaacaaggcacattctgcacagccctagatcccttaaatcttgattccatacaacacatgtttctgtgagcacaaggttggggctaaagttacagattaacagcatctcaaggcaaaacaattgttcaggatacagatcaaaatggagtttcttatgtcttccttttctacatagacaaagtaacagtctgatctctcttttccctatcctggctgaggctagagctccaagtctaagaaggaggataggaggcggacaggccaatggaaacaatgaatgaacaacagatggaaacaaggaatagtgtggatttttgagttcattagcgcgtcctccactctttcaaaacctcctttgcaatgacagaagaaatataaaaatgataatgaatttatttcgtggttggagaatcatgagaggtcctattagaagaaaaaactttgaagaacaccacagagatttaaaccatgtcattgaattcatagagaaactggaatttagaaacattttttccattgcaaaaacaggaggcgtccttgaagcagccagttctagttttccccacagagccccagaaaagccgtacttcagagctatcgggctgggaatggtgataggtggacagtggagagtggaataacacctgggtcatctctctgctggttacagacagcttggccctcatgcttcaggccgtgggaatagagattgaaagaaaaagggggcaagttaataggcattcaatagtaatgggatttaaaaaaccctcccaaaccactagaaggaaaagaaatagacaaaaataataaaccaatccagcaaagtttaggaaaagtgaataaaaaattgaggtaagcacgatacataaaagtacaaattaagtttgaaggaccaagtcaaaatatacagtcacaaactattgtgaatgttaaattatttaaaactttaaataatttatctaaaaataaaaataaaccaaaaagatgactatgtatgttttcaaggatatttgattcactagagaaacagttcatttgcttcctatttatgatgattaaaaactagattgcaaaagttagatgttaatgtaaagaaaactttatgaaaatgataatggatttttatctagtagaaaagataaccccaatgcttatggttttattgctctgtaggacattaacaagttgtgcatcttatttagcaaacttattctaacattagtagatgtgagtgtgtgtgtgtgcgtgtgtgtgtgtgtacgtatacatataggtgtgtgcaggtatgtgtatatgtatgtatgtaggtatatatgtatatactagcaaatgataaagttggttcaaaggacgatgtacagtagtacctccttatccacaattttgctttctggggtttcagttacctgtaggcaactgtagtctgaaaatattaaaaagaaatttctagaaataagaatttactcattttaaattgtgtgccttagtagcgtgatgacatatcatgcccttccgctccataccagcctgggactgaatcatccctttgtccagcgtctccatgctgtctacacttaccctcctgtttagatgcttagtagccctcttggtcatcagattgactgtcatgatatcctagtgtttgtgctcaagtaactcttattttactgaattgttctattttattactagttattgttgttaacctcttactgtgactaattaatgcattttatcataggtaagtgtgtataggaaaaaacatagcatatgtagggttgtgcaatagcatccactggggggagaattttgctgaagttagaacagagaagactgtccagaagaaagaattttctatacttgccaccttttttctgtttggtgtcctcatgtaagtctcagtgttacgatctgtctccccacctcaatcactgccctctgtctctggaaggaaattccccttgggctgaggccagcatggtgccagacaggagagatccagtacccactctggaaaatttcataagataactggttctccaccttcttcagggaccttttatcatatctcatgtgcccatggcatttgtcactgccatctgcacaacactgaactccagcaacatcaactgagaagaaagagagagagagggagaaagagaaagagagagagagaaaagtcgtttgttgattgagccacacaaaattttttttctaattaaattatatatccaggtagctgcaatatgctacaatcccaaatacacatatttattaaatatgattcaaagagcattcattgagtactctgtatcaaggcacaatgtaaaataagtgcaaaattactggtgattgttacgcctttctgtgggactcgactctctctggttggaggtactgtgtgggagcacgtgagctccaatcaggtggtctggagggagcaaaatgcagctgttggaggttaaatatgaagggaaatagcagtaggcatcggatagcatagaatgaaaataaaagtgcatatacttccagtgcctgttttacagattccttgtctttttttttttttttgaagacggagtctccctctgtcgcccaggctggagtgcaatgctgtgatcttggctcactgcaacctccgccttctgggttcaagcgattctcctgcctcagcctgctgagtagctgagattacaggtgcgcaccatcacgcccggctaatttttgtatttttagtagaggcggtgtttcactatgttggtaaggctggtctcgagctcctgacctcgtgatccacctgcctcagcctcccaaagtgctgggattacaggcatgagccagtgcgcctggcctccttgttttttaaaactagttcaaaccctcaactcataatttgggaaattcaggtcataggatgccctgttatttataaggtatccagcaatgcatggaacagaatatttaacttttaaaaaacttatattaggttgttgcaaaagtaattgctgtcattttctcctttctttttctttttctttctttctttctttctttttctttctttctctttcttcttttctttctttttctttctttctctttctttcctttctttcttttctttctctttcttttctttcctttttctttcttgtctttctctttctttctctttctttttctttctttctctttctttcctttctttcttttctttctttctctttctttcctctttcttttctttcccctttctttctttctttctttcttgtctttctttctttcttctttctttctttttttctttccttcttctttccttcctttcctttccttccttcctccctctctccctcccttccttccttttccttccttccttcccttccattcccttcccttccccttccttccttccctccctccctcccttccttccttctctctctctttctttctttcttcctttctttctttctctttcctttcttctttcgttgttgtgttccagaacgatttagtgttacctacagttcccagagaaagaatcctgtcttgaggggtggctggggcagggctactactctccctgctctgtgctctagtggccaggtggatcagctccagctgccaggtcaaatttcctagggaatggaattctgtctttttaacaagaacaaaataggtgcttagtaaatataagatgccttcagcttttagtatatgcataatcataaatataaatttgtttaaaacctgaactattctgatgttctcactggctagccaaacttaaaatgtgtatttggacttgaatttcccaccaagggtgttactagcttctttactgttgcagctgccttttgttttgtttttgaaagtttaaaaaaatacacaagggggcttttgcttcctgaaagatggagtagaattacttttacctatttctctcaagtaaagtaaaaaccccggacattgtacgtaaagcaaacttatgaagactctggaagctggagagaagaaggcagaccagttaggaacattgggacccaaggagcgacccagcagtgcattccacggggtttctttttgcctcatccattccagacttggttctggagaagtttgtcaacccagaaacaccaacaggcccagaaaaacataaagccctaataaaaagctggctctctctagtcaaaggagaaagaaaggggaagcccagtaaaacaattcttaggcagtaacggctctgctccattcaaacacccaacttctccttcctgagtggcaagagaggaaattcgctgagatgagtttaaatgagatccaaagcctcataacacaatactccaaagtccagatttcaaatgaaaaccacacatcccaacaggaaccaggggaaccaggaaaatctcagctttgatgagacagttaagaggcgctaatactgacatgacagagacgttagaattacctgacaagaatgttaaagctgccatcgtaagaacacatcaaactcaacaccaccatcaatgagtaagatcataaatcaacatttctggaaaactccaaccagcaccagcagaattcgcattcttttcaagtgctcatggaacatataccaaaattgccatatactgggccatgtaacaaacctcaacaaatttaatagaactgaaatcacatgaagtgtgttctctgaccacctggaatcaaactggaaatcgataatagaaaaataatgggaaaaatgccaaacccttggaaacaaaacaacacacttctaaacaatccatgggagatttcaaggaaaataaaagattatatattgaatagaataaaactgaagatgtaacatattataatatcaaggatacagtaaaagcccaaagaaatgaaaacttatcccagaaaaatgaaaacttagcacaaaaacgtatacaatacacaactattcatagtggttttatttgtattaaaaaaaaactggaatcagtcaaaatgtcctacaatagattaatggtaaaacaaactgcggtacatccatcccatggaataattagtaataaaaagtagtgagttgggcacggtggttcatacctacaatccatacctacatacctacagcactttgtgaagtagaggtgggagaatcgcttgacctaggagtttgagaccagcgtaggcaacatagtgagaccatgtctctaaaaaaaatttaaaaaaattagctgtgtgttgtgtcccatgcctgtagtcctagctacttgggaggctgaggcaggaggaagcttgagcccaggagttcgaggctgctagagagagttatgatctcgccactgcactccaccctgtgtgacagagtgagactctgtctctaaaaaaaattaaaaaaaaaatagtgagctgttgatacacatgacttgaatggatctgaggggcattatgctgagtataaaggtcacatattgcatgattccatttacataacgtttttgtcttttcaaaaatattgcaaggggtacttggttgcagggtgtgcgcatttttcaatttacaaattggcctcaaattcgtgtattaagtttcattcccacatttgcaatgataagtcctccatggagtttcctcactctacatcctctccaatacttgatattatcaggctttttaatttttttccactcaaatggtcaatacgttgtattttatttttggtttaaaatacatatttgtgttttctgatcactcatgaggttgaccatttaaaaatgtttattggctattggggtctcatctgttgtgaattgcctgtttttaaggtatgcccacttttttattgagtttcttatttttttcactattgcataggagttttcaatctttcttccctcctcttattctttaataacagaatcccaatttttttacagggcaacagtgtcccagccaaaaatctaattcctcagcttctttgcagttaggactgttgagacatcatctgaaatctattgtgcatttctggaaaaattttgcttgatggacagaggcaccactgcttatttctcctttgtgttctatcttcttctatctggaacttggcagaagcacccatcttgcaggatgaaagtcacaagctagagtggaggagcaggcagggaaaggacctgggtcctgcagcagctgtctagctctgaaccacctgcctccagagtccgccttggtgagaaaaatgtatctctttatctgatcaagctcctctagttagatttcaactacatatagctgagtgaatactgatgaatactgaataatgaatgctggtacaactttctaatatcttctcttagagttctgcattgaagtttttaaataagtttagtctatacctttcttttccattttcagtcttcaattttgacttcaagataattctagtcctatgatgtgatttatgtttctaaataatggcatttaccctctttcactattccctggaattggaaaaaataggttatttatttatttatttatttatttatttgggtttgggtaaaacttaaccatatgtttaacaggacctggactttgatttaagcaaacttagggtaaaaacagtttaaagacaatcaaggaaattggaatagaaaatgggtattggatattagggaattactctcaattatgctgggaatcataatggaatggtggttgttttttaaaagtccttatcagttggcaacgtattaatgattggctgaaaaatactgccagtgtctgtgtgtgaggaggtgagagaacagagtaattggatgaggggggaggcggtagttgaaacaagattagcaaaatgttaatttgtgaagcttagggttcattatactatttgtgtatattcatatttctataaacactaaaaatgaaaataaagtggtctcgtgttgctgactgtgactgtcacactctgtcagcagatggcagtgttgtataaaccatgagcctacataggcctaatggatcattgtgcttgctaagtaacaaaatcaatgatacgatataaaccaggtcagattttattgcttttagacaaaagggcaaggtaagatttgcagagtaaagaacaggtacagagtaataataaattattttaaaaattctaagtgattcattaaagtcttatagacaagttgggtagaaaagtacgtaaaaaccccataaacctataaacttactagaattataaaatcatttggtctctctctctctctcaaactctccccttatttgcattttaaatcagtattttcatacatatatatttgcaaaaccttattgatttcattgatgaaaatgacttggagtttgctttaaaaccttacacgataaacataaatattattctgtagttctttttacccaacttttaactggcatagtttaatctatgaaaacagctccatattttaaaagattctctaactatgacaacaggcaacatttcatagatgataaaatgtcttatcaactaatacctaatattttaacttaggttatgtacagtagctttaagaaccagttgtagaatttgatatatagaaaataatatagaccctgtcactgggcaaacttatggtggaatcattttttgtgttgttgtggacaaattagttattctttctgaacccctgtttggatatatattttttaaagcccataatttgggcatcctcataaagtagtgacgtctgaaattaaacaatcaatgtaagagagctagtttcctttctcggcaagagaatatgactctaaaatttatgcccaagttagactatttttatcttgcctctttcccctagaatatttgggt

SEQ ID NO: 6 - DNA, 299890 bp, Artificial Sequence
  D9-E24-F17 (Fig. 1b after integration)
ttaattaagcctgtaattttaatgcagttgaatatgtcaatcgtttattgactatgttttttataaagtttaagaaattcttctctattttgggagtcatgaagatattcttgcattccagattttcctcctgacataatttactttcttcctgaagtgcaccctttagtagtctctttagtgaaggtcagtggctagtagtcagtttgatttactagaaaatgtccttaaatttcccctgacaattattttctctccacacttccaagatatatttccactgtgttgtatattttttcatatgattctgttgtattcttgcttccattgttgccgttgaaaggtcagctgtcagttgaactcttattttgtaggaatctgtcttccttacttggctatatttagtcttcactctgtctttggcattctgcagtttgtgaaacagtgataccatgtgttgagatgtggatttttttttattactcctgcttggtattcattctatattcaatatctgaaaattccattcacttgacctcaatagcttgattctgcaatttgtcacttccattaacttccattcttgttcacttgtttcctcttatgtttagtgaattttgattggaagctcatgtctgtgggggtaactcagttctgaatgatgtattagaaactttctataccaaacaacttcactcacttttttttttttcttgagagagtctctctctgtcactcaggctggagtgcagagagaggttcaatcatggctcactgcagactccaactcctgagatcaaatgatcctcccacctcagcctcctaagtagttaggactacaggcacacactaccacacctggccaatttttgttttattttttgtagagaccaggtcttgctgtgttgcccaggctagtgttaaattcccagcctcaagaaatgttcctgccttggcctcccaaagtgctgagattacaggcattagccactgtgccctgccttcacgcccttctgtatagctcagccaaaagatatacaacttcagttctgctttccaaaatatatccctagctttctggaaccagcagttcttatcttacaactggccaatacatagacatagatatgtcaccctttcccttctgaggcttccacttgctgttgtctggctgttgtctttgaatttatggagtattcatggtctcttaaggagaaaaaagaaaagggagatgagaagccagaagagaacaggaagttgaccacaaggcagagactcctcagcaaggagcacaatcacagctttacagggccagaaaacaactccagcagcgtggctgcctcttaaagcgccagttctggaagcaaattcccccttaacaatcaatatctaagtgaattttggaagtcctaggctggtctgagactgccggagaatgagtcaaggccggcttgtcctagggagggggtggtgagggatggaagccgctgtcctctggctccccgtcaactgtgcatgtcaatcccagtgacaagggctgctgatgcttcagaaaggtaccaggcctcagctttaaggcgcttgccaagaagccatgagaagtgcattaagatgctggcacatgaacagcacccaaacaatgctggttattagtggttcaccaggtgctttacagtttataaaatacattcactcagactgcctggtttagtccacacaacaattctaactcccttggaaagaccagagaactgccatttgataccttccactgcttactgcaagctcacctgcgccaggcatggggacagcaagggaacctcagccccatcttgccagtcagtgcctgcagaggggtcccggtgcccctcttgccatcagaagcttccctggccagacacagccatatgcatgttacttacatttgcacatttaatctttgccacagtccatgagatagtctgtaccagagggaactggggcctgaggtcacacaggcagtgcgtggtgggactcaggcatggtgtaggacacttgtggttcttgccccgaaaccagatttcaaggccaagggcaaggccagatagaggctcctagaatgtgccagagggtggcctgctacagcctcagccaaggtctgcctggggcattaggggccttgatggggatatcacgcctgcagtctcagggagcccatcagcggcctcctctctctggattccagctatggcttagggatccctgtcctacctttcacaacaggccaggggcctctgagtatttgggaatctgctcaaacattgtgggaaccttcctgcaatggcttcagtgttgcagaatcaatgttctgccaaagaaagtcactcacttcttatttctacacccctctacctcctaaacagtaggagggaccagagccaagggctgcaggtggctttacacccagtagacttagtgatctcatttctgtctccagtagtctaggttggatttcttatagttgtgaaaactttgagtatttgtttttactttttcttaaagctcgtatggtggccccaaactgctttcccattttaatgcttatttttgtatctcatcagagctggagatatttttcaatggttgaggctggccctcaaagtggagaaatatttgattacagtgagccatttacagcaagtagatttcaagcacaacactggcaaaatccttttctataagaaacactgtcttatatagattttccaaaaggctgaactgaaactggaaaggatgtcttaaggaaagatggatattaacaataggtttttaaaacctattcttctctagaacatggagaagagctccttcatgtttagaaagttggttaagaactagaatataagaactggggtaacaacacccagattcagcttccaatctggaatctggaagtccaggaagaaagggctggtgccaggtttggagagggaggttgaacctggatgttaccacaccagatagagagaaaacttccaaaggctcctcaggtccagtcaaaaggactcggcaggctcctgttggccaaagatgggaccgcttgggcttcttatagctacaatggattggaatgcaccaactaaggtgaaatccacgagttcaaaatgatacttaaaacaaaaacttctttggtcactcttggaggatgcttattattttgaaactgctttaaaagaaaaagaagccggcaaaaaatgtgttgtgggggcaaagagcttctgaaatacgcacatacctgagcactaccctctgggcagcactccaagtcctgctactcctagaaccctttggggacttcaagaaagccccagggtctgcgtcctgccccagagagtctgcttgaacaggtaagggaggctgcattgttgagagttccccaggcagggtggccagggctgagaaagcctgaggccagctctctgcttctactctcacctccagtccatgcaccatgcagcgccattcctcctgggtttgaatcccagctctgcctggtgggtaggtcatttagcttgtctgtgcctctgtgtgcctgtctatcaaatagaagaggtgggggtctcactggcccctctatcatctggcccttgtgagggtttgatgagtctgtctggcacatggtgaatgttggctgtagtagccataaccatttggaatggcacagagggcaggaagagacgttccatgagaaagatacaggggagggaatgtctaagagaggcctctctaaaggatgggaaattcacttttggaaaggagagatgggagatcaatcagctgggtgggcgagataacatttagagggcacagacccttcttatgagttgatgatggctttggttaccaagaaaaatgtacctatacacacacacaacttttgcctacaaatctaaggactcacagaccccccaatgtccgtctgcaaccccaacagttgaagtccattgccacctccaggttaaataactgtcatcaacgactctattattttgacaatattgatcaaaacattaaatgcccatactcttcaactaaataatttcacttgatggaatttgtcctacaaatgatgcatgtgaggaaaataacaactataaaagttgtttattgcagcctgttgattacagaaaagctaggaaatgatctcttcatccacaggggaccagttaaatcaattgtatctacagagtgaaacactctgcaatcttcaaaaaaaaaaaaaaaaaaaaagagaaaattctatatcccaaaatggaacaagaacaatctccaataatttgtaaaggcacagaccagtgtactcagtgtgctatgatttgtgcagaaaaataagaaaatgcatgtgtgagtgtctgtgtatatgtgcatttgttgaaggtgaacagaatatttccagaatgagaccctatcagccagtcagtgccttggtctcggggaagcagaacctcttgtcttggagacagttttgaatgtaggaccatattcatgtttacattaatccaaaacaaataacaggtacatttaaaaagaaaagaaagccacgtgggcattggaggctcacagagaattctgaatgggaagagataaggaggatggcctttggggagagtggatctgctcacctgaacagagcatctggaagcccctcatgggtgggagaggggctgctgcaggggccgggatcacacgctgaggttctgagacagttgctgcctgagtaatgacgccctgggaaccgtgaaggatatgtcaaaaagatgcatggtctcaggtctgtgtggccagggctccaggccatggctgggaggtgtgggtttggggtggggcagacaagttgctgagaagcaaagaggtgtgccaggggtgggtacccggtggcaggtttttctgcatagctgggcattgcttcagcatggcaggtttcatgtactgccaaccccaaattccttttcttactgctcgtcttaattttcatgacagctttgcctctccttctcttccctggcgcttaggtgaccacaggcttcataaagcctaaaaaacttcagactgagaggaaaagaccccagtcaagatgggtgcggctgttgtcatcagcacacaggtgagccggggtctcctggtcccaccacgggccaggcagtaatgggctctgtaaaggacacacaagggcgttgcccacggcgggaacctggatgtcccaaaggctccctctgccattgtgatgtttcaggatgaaggaaacgattgtccttctcattcaggtgtgcagagtgcacgttgtttaagtccaggctctcttgtctactatatacctctctctctttttaaaaattgtggttaaacatatataacaaaatcaaccatcttaaccatttttcagtatacagttgagtggcattcgtgttcattcacactgttgtgcacccgtcaccaccatccatctccagagtgctttccatcttgcagatctgaaactctgcacccattaaacaacaactccccactcttccctccccgcagtccctggcaaccaccattctactttctgtctacactgggtacctgatatgaatggaatcatgccgtatttgtccttttgtgactgccttttctcgcttagcataatgtcctcaaagttcatctgtgttgtagcatgtgtcagaatttccttctttttcaagtgctgaataatattccattgcatatgtgtgtcacagttggtttatccactcatctgcttatacacactagcgttgcttccaccttttggctattgtgaataatgctgctatgaacacgggtgtccaattagctcttggatgcacactcccgaaaaagaaaaaacagctgggtgcagtggctcacacctgtaatcccagaactctgggaggccaaggtggggatcacttgagcccaagggttcaaaagcagcctgggcaacatggcaaaaccctgtctctaaaaaaatacaaacattacccagacatggtggcacatgcctgtagtccccactactcgggaggctgagatgggaggaccacttgagcccgggaggcagacagccttgattttgccactgcacttcagcatgggtgacagagagagaccctgtctcaaaaaaaagggaaaaaacaagacaaggtttctcctggggctgtgcttcagaccccattaggcagttgctctgcaaaatgcctcatgagtcacagctctgtcaaacagatgtgcacatgttcctaccactgtagcatcccttgggggtttggttctgttcacccaaaatgagtgggagtttggttctgaacacgcagcactaaggggacctcaaaaaggacaccttatagtacgagaactcaaaaaggaaggcagagtgtcaccttgcttgacctcagctgggaatgtgtgttcatgtctggcaactcaagtttttcgctgctctgagcatgtcaatggctgtgaaagtgccaagtgtattaatttgggggttacaaatacatcttagcaagtaggtgaacttgcaaatacagaatccaggagttatgagggtccactgtattttcagtgtcgaaattatcttccatcaagttgataaaacctcatttactcaattaggccctagtcagggtatgtgaagtgttctagctttttcctattacaaatgatgctgcagtgaataccttgctgcaaagagagttctctcattataaactgtttctgtggcgtgagttccccaactgggctctcaccagtaaggggatgtcgctgcccatgccattaggctcaccacattccctactagggacacatatttggctttgtcctggtcaacgagacagagggaaagtctacctggtgcctaagaagggggtacagggcacaatggtccctttcttgctctggccattactgtgcagtggtgaacctggagctgtgaaatggaggaggagaaagaggaaaggagcctgcatcccagatgacacgaccgagctgctgacccagatcgcaggacacgagatagtgcatttcccttctgttaaggtcagtcccagccagcgacagcccctccacagcactgctgaggagcccctggtcacccatacccctcaccctctcttcagacactccactgccccccacgactcccaggccaaactcaggacacccaccctctgccattatgccgggctccccaagcctccaccacttcccccagtcctgggactggcaaactatgagtgagactcattcacagattgtgacttcatttagtggattatcaaccagcattaagaactgaagccaactgggcataatggctcacacttgtaatcccagcactttgggaagctgaggtaggaggattgcttgaggctaggcatttgaggccagcctaggcaacaaaatgagatcctgtccctagaaaacatttcaaaaaattaacagcatggtgacgcacacttgtagccctagctacttgggaggctgagtgggaggatcctttgagcccaggagttcgaggcagcagtgaactatacttgtcagcctgggtgacagggcaagactctttgtctctaaaaacaaaacaaaacaaaaagaacttaagcagactaggatataaagtataggagcgtattgtgtacaggaacgggaaatactgtttcctggatcttttgtttcacttacgcacacacccacacccgccagtagtgtaccaggttgcgatggaaatctctctctttctgtggatgagtttgtggaagcccttgctccagcatgccctccttcctgcccacccctggaccattccttcccttcacagcactgtcccatgggtaggccacagcccagcacaggccccagcctggcggctgcagcaggagccccatcccagggcctgaggggccatgcgggggtctgggtgggagtgggaaccgctgaggaaggtgaagggaaatatggtgagatgacaggcccgctgtcagggagagtgggaggagccctggagtgccctacctctgtggggctggaactccctgtatccgagctagggtcttccacacgcatgctcctaccccaagtgccacagctggaggtcagggacccagccaggctgtgctgggtgctcctgggcagggctcacctgactgcaagtctccctgtgggtggctcagagacccagagcccacctgggtgctgcttacagcccataaggcagctcccacccgcgtgtcactggccctgcagcctcatgaagccttgtgagcagccatccttatctcctttgtgctttgaatacaggaggatgctggctctaaaaggcagaggggcatcctcagttacccagcaggggcgtggcaggcctgtctccagtaccccaagaggaccctgaaaacaagtagcattgcatgaaagttccacactctgcagttcaacctagcacacttacaaaccctgagtcactgcatcctggctcatggagggagaatttcctttttctgtggctttaaggctagcaggaaattgccagcccaggcccctaaggcctccagtgagggccgggtctcatctcccactggataacagtgttgtcgggaacttccatccagcactggcggacactcccgtcgcagctgctcctgactgagcaagtcatttaagggggtccttggcactcataagcactcacagaatggggctggcagtgcgcccggcctccctgggatgggtccagaatggtaggaagcgcagtccgggagggaccctgagttagggccaggcatccccattcctgcttcctcctccccgaggaccacgtctgcccattcctcttttattttcttttggtatatatatatatatatgtatatataatttttcacaccattataattcctctttttaaaaaaatatatatgtatgtataactttcttagtaatttctgtagttaccgaatctggaaggaaaactaagaggccaccaggcaggccgtgtgatggaaggagtgaggggagaaggagcatccatgcagagggaacagcatgtgcaaagatgagggtcagtgaggacgtggtttgtacaggtaaattcgaggagctttgagggctgacaggtaatgctggctctggggaggtgttgggagaagagaagggaagggaggagccgtgtaatgaaaagctgtgctcaccatcactaaggactctggacttaacctgacagtgggggttttaggcagtggagtggcatgatcaaagccattgctggatgcagggaggaggctgggatgaatgaggcagagtttgggctggggcatccgttatgagtctatagaaatggttcagggaggggtctcagcttattgtaaggctttctttaaagttgatggaatgttttcttcccagtttcaaggcacagcaactgtcggttgtgagagatgcttctgctaccacttctattgctcacggcaaggcaaaatgtcagtctagattcaaggaggtggagaaatagattccacttcctgatgagagaagaatgaatgcagagtttgcaactcgtctgttaaagggaatgacaaagatgcaagaagagttaaactaaagttcattcagctggcagtatccaatccagtggtgggtggcagcagtgccaggaatagcattcaggcagcagcattaatagtgacattttttgtttttcagaatgttttagggtagaaccttggccatatttccagcttaccagtttcccttgttttcacctattttctgagcctgatttttcagacttcccattcactttggagttgcatgatatccttttaataaatgccctttctgcttaatttagccagaggctgcttctgttgtttgcctctaagggtgctgactgattctttggtcaataagataatcaccaaggactgtacagtaaaataaacaagataatttactaaagaggaaatgcaggtgggtaataactcctgagaaatgtctcacctcacttacgataaaaacaaaacacatctgaattaaaacagtaacaaccagatgcttttttgtttttgcctttacaatttgcaaattcatctaatcacagctgcagagggtatggtgagacaagctttcttctactgctagtgggagagtaaactgacctaaccttttttcctgtagatttcttggctatatgtactaagatcttaaaatgagttatcctttgtcacttccaggaatttagtctaagcaaatacttagaagtatggaaagaaatttatgcacgaaggtgttcatattttagtaaaaattggaaacttgaatgaaatgaggcaattaagatgtgatataataagataataagcagaagcaaccctttcttagaaaggtttgtaaagaactgaggattggccaggcatggtggctcgcacctgtaatcccagcactttgggaggccaaggcaggcagatcacaaggtcaggagttcaagaccagcttgaccaacatggtgaaaccctgtctctactaaaaatacaaaaagtagccaggtgcggtggcaggtgcctgtaatcccagctaccgggaggctgaggcaggagaattacttgaacccgggaggtggaggttgcagtgagccgagatcatgccactgcactccagcctgggtgacagagcaagactccatctcagaagaaaaaaaaaaaagaaagagctgacaattataggaaaaccttaatggaataatattgagtggtacattgttaaataataaattaaccaaaaattatacatgtgacatttgtcgttcatgatccagtggggaaaataaactaccctggacattttaaacaaagggaatttattgtgggaaatgcttcacaggtgatgaacagcagagacccaatcatcatggaagcagcccagagatgagtcacagcaggaagccactccaccatcagggctgcagaaagtggcattgggagagggcagaggatgggcacttggtggcagctagaatcatggaggagatgcagctactgatgcaaaactgcttcctgaaggagagagatggtcaagtaccctgccttatcccttcttttcactaccctgtctcttgctggtgtctcccaccggccatatccagctggaagccaattgccaatggaaccatggacaggaaatggatctgagtagatggacaatgaccaccacacagcatgatctcgactagataaacatgatgcatgttaaatggtattacttctgctgacagggcgatatatggcttttagtttcctatgtttttctgtattttctaaagaaactgaacaatattattaaaattaaataagtggaaagtgtgtttgtggcagatacaataacgtttttaaaaagataatgtgtacgtagggaaagatgggatgttgttaaacaacagacttttatatgctgtgtctccccgtgctccctccagctttagtcagtggccctaaaagggctagtgtcctggctgcatggggccagcagggggcgatccagtctagcacaaggccttccttgaccggcggactgtggctgggatttccttgcatttcagagcaggaccctagggcaggtgtcatcctgtcagctagctcctgcccccaagaggtttgtctctgtcagcctctaactcagagctgacccttcctcccatttcaggcaggctcttaccaggactcatgagaaagccaagccaagcaccactggcactcgagggtccttccttgtccctttgggtgattggcacggttgtccactgagcccagagcctcactgtgctcattaggtgtagcctaagggcacttgcatggaggtgccagtggtcactgcttagagctctcagccctagatggcgtatcacagttaatgctctataaaacccatcatggcttttccctagtaagcctcaaatcgctgcaagcaaggcttcatatatgagagtttctgctgtctcctggagccatctcacccaaagccactgactctgggagaccagcccaggccacaaaccagcaaagcaccagttatagttagagctgcattataaagtggccagaggacatttctttgcagtgagatgtgtatcgtgaacgtttggggcctgtgctcgcctagtcctcatctttgcttttctaggtacacaaagccatcccatggctgcaaatgttagctgggctgggctccctacttgcctcaagccccttcatagacccttcaggcacatgcttttctctggacgtttacagacaggtcctcagaggtcagagcaggttgtcctagggagcagggaggcttcctagggaggtcagactccaaatagtggatatggcaaaaatgcagctgcagactcatgaggagtcgccctgggctgccactagggctcccacagtgtgcgctgccaacctgctgcccgtgcagaaactctagggtaagagctggctcctggagtcccacccaggctgcgtgtccctcacagtctgctctgtgtctatgtgtgtgtgttggggggatattattggacaattcaagggaggctcagtgaggaggaaggaaaatttcatgtaattctttctggtttgtctttctcaaccccctcctcctgcctactccttaactgagagagtgtactattatttgtgtgaccctttttttcctccaatacacatagaaggttgtataattatgcttttctgttttggaaaatgacttaaaatcatgtaaagaaaaagcttacttaggtgaaatgtagataaagagattgtgtcagcaaaatataattcttaagggtaacaagggccatggacgcaattttaattgtgaaaaataagcaggatttcatcaaagtaaactactgcaggtgagaaaagttgaactgctgtaaataagcattatcctgggctgataatgcttacaaatgttgatcctgaaaattcttcaggtacctttcagagctgagagttgtgctctctggggtgacactcaaaggaaattgggtccttttttaagcataatcttcttgggtttttagtacattcttattttttattgaaatatacaatgaaaattcatcataatacactcttactcctaaaagagattgctgtatcataggacatgtgtgcatatgaaattttatatttatgttgaaaagttttgaggagaaaagaagaatcctttctctaagtaactttatagattttgtttttaattgcacgcatacaacaagttctcattaattataaattcagttcgtgggcaaaatatattttctgtgtgcccctttctataggaaacttgctggattatttctaattctgagtctgtatctgagtaataatgacaataagtaaatgatcccaaatatatttatataagtaagagattgcattctagaacttattttttgaataattttctataattaaaatgacaaacacttttgcaatctgaatttcatagtaaggataattctaaacaaattttgaaagttttggttttagaagaagttcaagaactatttggctctgcacggagagcttacacaagttgtatctctaagccctagcttcttgctatgcctttattaacataccagttttggggttaaaaacctactttagagctaaaatattttattaaaaatttaaaaaacctactttagagataaatattttattaaaaatttatcagcctgggggatatggagtggtagagagaattacttcccatggctgctcccttgcactgtttgaatattttaccaaatgcatgcattgcctttccaaaagaaatggaaatattttcaataatcaaatcagtaaaatttctgatgcttttcagttttttatacctacttttgcctttttgaatattctcaagaatggaactagacaaatgtaagtgataaattagagagaagtgactttaacttaaacatgcatctgtgcccagacatacccttgttaatttattaatattttagacaattgtcagaatctaaagtatttccagttctcaatctagaatggctaagcttatttttatggttctacatgccacttgacaataaaagatcatttatgattctaagaagcatttgtctctcaagtggcattgtaaatcagtacaatcttttgaaaaggaatttagtaacacatttcaaaggccatgaaaattccactccctgtaagtgaatgatttcagtaaatttaaaagtcaaacattagaaggcatgccatgttgcctttcacaaaaataattctgctaccatccctggaagctgttgttagaaggtcatgttcaataagcttacaatgttttcctgattgttgtttgtgtgaccattaaaatttcaccagtattggggaatttttacctttcagatcatttagttccaactgttaggaagcaattagctcttatgttcttctggttcgtgaaagtattttactttgggtgcaggagtagggtctctggggccatggaatgatccacacaggccctggcatgggagggactggttccatctcaatctgaaaatcagacaaaggtttatttcttacttctgttatgcaatgttggcaggttgttctgactcttttccagttcctgaatattacttgttgtataataaaaatgatattctaactaaaaattttaaagaaaaaaatttgcaatcttgcagtttaatgcaaccatagtcttagcatttttgtctgtgttctcttttcaatctttgtttataaacatatatgtttctacatagagctgattgtaagaggtatagaattccacactttataaatgccttgttaatttattgttttccatgttgtcacatagacttcaggggtctcctctcaactgactgcaaattactcactgagttggtgccccattatgtcctcggtcatttcccctatcgttgagcatttacaacttttctaatgattgacttttaaatttcttgaaattattgagttaaagggagcagaattttaacaacttttgttatgtgtcactaaatcccttttcaaaagattgtactgatttacaatgccaattaaatgttttacaagtattattttccaactatgtgaggattatttttgtttatttccatatatctctatctctcctctccaaccagccaaaaaataaaaataaaaataaaaataaaagtactcaagggtgagttaggatatagacatacatatatgcttatgtgtttacatttaggtgacactatagaaggatccgcggaattctacagatattctctcactgagagacaagaataactgacttatccaggctgcaagtctggtgcttgttctatttgatagtctgatgctgtaagttttttgtcacaaactctgaagagtaaagtggaaactttgactttttgcttctgattgcagatttctatccaaagagggagttgagggaaatgcttcctgttgtcctaattacacagtactaagtgaacactggatatggagtcagaagggaaagtagacttgtgagcccatcacatatggagaaaacacttttggttcccattgttggcagggacagggaggcaggccatgttgcctttcacaaaaaaaaaaaaaaaaaaaaaaaattctgctaccatccctgggagctattgttagaaggtcatgttcaacaaactcgcaaagtgttttcttgattgttgtttgtgtcaccattactcaacgttgtgtagaatgtagtcaggtgatattatccccaattttataccgagacttattttaggtggattatatgactcagtcagaatcgcatcaaagcagaaccagaaccaagtttgttttcaactccagtgcttctttccgaagttttatttccattgtcagccacttaactattttaaaacgtatcttttggaatagggatctctcaataggaatccacagcaaagatgaagagaaaactagatcagttgccttggcaattttgtccactcagaccaggacattcagggatttctagattgaatttgtgtttccttctgactacattgttgaaatgatctggatcatctcctaatcttgctcttggactctctaggtgtattctcagtgtctgtgagggagggcatgtgttttaagcagtaaattcctaaaggcctgtggaggcccaaggccatgcacactgagggagttgtggatcaagtggcatgatgggcccagtctatttctggcagagctgttattttagctgttattctctttggccagttatctcccttagagtagtgcctctttaaatgctttttcatttggtgaaatctaaaaatttgtctctaaaaggcatgctgccaggcctcttttcatattaaagtggtcatctccacattgtagatagtaaatcatgttcaaagaaaagaccttaaaaattcttcatattgccttgcagaaatcacagtattttagatgtgttggggagcttcacaatcactcagtttaacccattcatgttacagacagggaaactgaggcctggtgactttcccagttattaacaaggtagtgactgagaagggacttcagttcgctgtttttaatgactgtatagtgagcatctgatgtttggtcttctacagaaagggaacagagttgactaaagtgaaaataccctagttcagacatcagaggcaaaaaaattaatcataatcacaacagcaccttacagttgtggagtcctttatagtttttagactcttagacacagagaaatagagaaatataaatatggaaaataaggtttatttgatattttatgaaatggaaccctaattcaccaacatttttacccctttatagtactgcaataatttgttgtgagactctgaaatcgtttctgaattatcagaggaagaaaatcatttaaaaaaggaaaccagagctactggctctatcttacttcggtcatggtcttttaaaatctattcaatttattttaactagactaattcattcttaaagtaagtcagctaacatggaattttctgaggttacttaaaaaattttggaaatttccttagctctgcatgaagtatttttatctcttcttcttcttttttttctaaagaaatagtgtttgtgggtcttgataactgcccacaacagattttatatcatctggttttgatagagcaagggggtctaatgaatgattgaaactaacatttataaaatctttcaaatttgagaggcaggttcttggaagaaggaggatacaacagaatggcctctgtgtcactggtaggactctgaagacaggacttactgcctatgttccgacatgaagaaacagactagtgaagtatgttgtcaaaactttgagaattgtaaagcaatgttcacatgtaggttgataaaaataacagaagaagttatgttaacctaggtccgaccctaggtgctgtcatgttgtcactaccttcataataagcttcaaagaggtgctctgttattatctttaaaaattacagacgaggaaactaaggtttagacagtgttagtaacttgctcagggccagtcactcaatgtgtggcagagctggattccaagtcagtgctgtctggctctaaagcttagattcttttcattgcacttttattattaaaccaaagaacttatgattaaaatattttctgctttccttgacgatttatttcaagatctaaccatttctttttcctggacattctgagcagggagcactagctctcaacttccctgcctctaccctctggctgggctgcaccttctcctgctgcctgttcctcctgcttcatcagcacacagtgggactatacattagccagggtgttagacaggccctccctggaccttgtcttactttcccccttgtgttatgaggacaagctctgtagtaactacattgagaatcttaggagcaaaggctccccacccccatgggggcacgtcagtgacatttggctcctccattttgcttaagaaacctgtgaccagaccctcaccccaggcccatagtgagaaaagcctgttttcatttcttctttcaccaagcccatctggatagagcaggtgcagggctaggctcttaaaatagaagcccttgtttcatgtgacgtggcacggtggaaactcccttgcttccttgcctgttgatcagattaatgaaatgatgaaggtctctcccctcatcgtggtgttttcttgacttcctgtcattgtcagttgacctttctagtttcttcatttgtaaaatacaggacttgttcttcataacctcaagggtccctcctatctttgataatctgtctccatgcttccgattaggggtcagattttggaatttaccatttctatcttgtttatttctcccagcaatattattccagcaggaatagctgggactaaaacttattcttggttaaagcacatcatctcaccatcttgacatcccatttgctctataccatcaaccatctctgaccctgaaccccagtctccttctttgtaatttaggaataataataccttattcatggtgtgaatcatatgagagagaggatttaacattgcttagcaagtgatacacattaggcattcagacaatgcttgttcacttggggtcaaataataaggtccattttctcttcatgacttctagctattgattagctttgaggctgaaaaataagtttaagatgggccctctgacctcaagaggctagcaatattttatcttctttttaacgctatctcctataggaaggaaagctagcaatattttggataagacaaaataaatacatatgaaacagagaatggattaagtctggaaaatccttccagtgctacacctaggacaaggtaccccatgcagagcaggtaaattcttaaaaggatggtctctgagtcaaattttggagagtgaagtgccagcatagctgatcatcctaagaaaaagtcaagaccgcaagttatgggttccaacagtggagaaaaggctaaggaaattatgcactgttagtaagatagaatgatgtgcaccattcaaaatggtcaatatgatgcataagtagaaaaaaagaagtgctgtgaaacaacagcaagtgaaagaatttgaacacaaaattctagtaatagtgtcaatggctatgtatgaagatactcagataaatgttagaaaagaatataatgtgggaaatgaaaataatagatgtgttagggttatgggtttttggatgaatttcaaaaacattccttttattaggctttcacttcttaagtcaaacattttgaaaaatttcacattgtatgacttggattgcataatataccagttcctgggctaaggttccatctttctctggggcaggatttcctctctggttttcatcgtgatctctgcctttgaatggcttgctttttcttttaagagaaaaaagtatgacaaatccagtaggtgatggaatcctctctcttccatttatatttctgtggatcttccttctcaaattgcctataacttcatattgaatctgaagaaagggagagtttctaggagccctgatataagggctcagggatttgtgctgccatttctttagaaaatgcctgattttcccaagaatgggtcagctctaatggaggtacctattccttcaaggaaaagcagtcaacttagcaaacaggtaattccagaggtgatttacgttttactttggcagatggagccttcattttcaatagaactccctgtgaacttcctttaaaagtgttttgacttttctggaacacatggactccatgcagtgacgtgcccggtaggcagtaatgcatacttagggctggccttccacagcttgagtaggtgggttccctttaaatgaaacaatctgaagagatgcaacacaactgtgacccttggtggtcttccagcttttaatctgattcaggccactcatttcaaccctatgcaagccaatttgacgcaaatgagtccaatctaaccagtccaaaaaatacttgggtgtttgtgccaataaatctaacgatcaaatcattcccccttgaattagaagttaacaagacaggatagctcatactgccctctagtcattcctgccaccattaagaagcctggggctctttcttaccccatgtgccaacttctcagggcctccttgtctaattttgcttgagaatgtagagtagaggaaggagaaatggacagacagcctagagaagtgacttacagtctgggttcagctctaactactaatagtgttgaggacgtcagtcagcttctcgaagtctcagtctccatatttgttaaaataaagagggtagtctggtttttctggccccttctctcctgtcctcctagactatgaattcatttttagctttttaatgcaaatttttgattcattagaatctagcttcttcactctgccacttttagttggctcttcttagagcattagtgcccaatttgcactgttagaattttcccttgtttgtacccttcaaaatttttctttttttgggcaaggattgtatttttttctttttaactggctccttgaggatagatgttgtgatatctgtgtgcttgtatgtcctcaactgtgccctgcactgttagggcccttgtcaaaacaacacatttctcagtgattctgagactctttctcttatctatagaagtcataactcaagagtaaaatcataccaatattttacataaaccctagaatttttatagatctattatttctttttagagtacatattggaagtaacttcacaaggaacattttctttacttttttttttggaaaaaagatttatgcttataaccaaatgaggttgtttggcaaatttgtctggagagacacacacactcagggcaaataggcactcctttcctgggcaactcaattacctcttgcctctggtcaaaccactccacaaataaagtggactgatcctcttgactctatgtgtaagtgcccattgtgtgtgcacagagctggtgagaacggccatggtgctaggtgggggtggtgttggtggagttggactagattatctgggatcatgcgaaatggaaattcatttctagctggctggcttcagaaggtgccatctcctatttttatatgaagcgtgctttggaactcagggcaacgaagggtgggtgtgctgcacaaggacagcagaagagtgagctgactggtccctgaaatcgcagttggaaagtggattaccagtgcagtagaactcttcacggaggcctggaccatcaggtctaatggtgttgttccaggtgggtggtcatgtggagcaaaaatatttgaaatcagcgagcacgtacctgagagatgacttttccacttgggctagtctcttgatatttctggtcctgtttcttcatctgtaaactgggttagtaatgtcacactctgtgagttggtgcatccagataacaaacaaacaaacccacacacagaaaaacaatccccataaatgccctataaacttatattaatcatcaacaattcatttatttgttcactcacttatttattcaacaaatactcgtatgaccaaagcactgtgctttgtgctaagctctacaataaatatagaattgtataaagatcaaggagtaaaaatcctagttcaggtcctcaataaatgataggtgaatcatagactgaaacgtggaagtaaagtaaggaggtcttccacgactattgtgatcttcaaatgttcttttgggtgcagagtttccccgggaaactgccagtttctataatggacaaaagactttgcttttcaggagtatatattttgataggaaataaagatagaaatacttggaacttagacaaattaaatacataaatgatggatagtatgtagggaatacagtactgtggggaatcaaagagagggtgaattctgggtgaaatcaggagggtttctcattattcacagatgatctcttacaggaggtgggaatttttaggtcagctggaaatggaaccaggctttcatgttcagatatacttgcagataaacaactcataagaattataagactaacagcttcgttagtttacatttgacaatttatttgtgcctcattattttgggatgtgtcaagaatctgataacatgggtgataatgctatttgccactgtaatatcaggtagtcctagtgaaaatgcaacttttaagaacttgtttaattgtatctaccaactcttactgcagaatgtagacttgaaagaagcacattcctttttcttacataatcattaggggttactacatttctgagcaacaaggctcaagagtttccaatggaaatgtaatttcaattagaaaaccaaattgaggttgagggtggagagagccagctgcagaaggtatctggacagcagcatgtatctgcaggcctgcgtgtgtgccagggtgggggcaaggaggggtagattgtgtcattttccacatatgtttatttagcttctcctgtttcagggactttgggttttattaatagtcaatttaggatattgtgcctccatcctcaagcattgtcaatcttaaaaggatgggtgggagtggtaggcattaagcctcagaatcttctagccctttggctggagtggttctgtctgctattgctgcaacctgaggaaatctttcaaattctgggtgggctgctctggttaatatagtggagactctaacaaaaattatgtcatccagcaatagagctctggtgcagtgagtggcagactaactgatgaacatctcaatgcacagcaattctcagcagccctcagccagggcactcctagggagggcctctggttacaatgctcttcagagcctgcccagtctgtctctgtttctctgtcttttctttcctttctcattattcccatcactattattgtttctctttctctaaggtctgtatattatcctttcccctagttctttgaaaaatttacttcagttgcacacacaatagaattaaatgataaacatcaattttctaaataaaatgctgtgtacacccacactcacacccacagagtattttctatttcttaacaacaacaagaaaaacaacaaaatgcatagtaagaattaaaaaatctggaggaatattgaaggccagggcagattatttgtttagattagtgatccttaacccagaatttcctcacatctagattattgtctggtggatgacaaaggaaaatatatattggaaacccagttgtggatccttgagaatacagtagaaagaacagtgaaaattgaaagggaaaaggtgagaaaaccttcttattcatgtccaggaacagaattgggcttgaatttggtggctgcagctctgaacggactcaaagtgagtgtctgtaaatcctgctcagcaacacgaggacaggggttgccatgtcctcctcttccttatgtaccttccctcatctgcctccctatctctagcacatggaccaggggctcataaatgtctgtaggatggaaaaatctaggaatacatgtggggtcagaagttgtaagagattgggttgaatatattctgattccccaagttgtttttgtctacttattttctttttcttctctgtgatggttctttttttcttgttatttgtatctttgcacaatgaaagacaaaaaaaaaaatagttctagtcactagaggacttcagtaaacatgctatcacttacctgcttatgaaccaagaggttgggaaggcaggtctcagttggcatgtagcccgagaagagtttgtcacatcttagagtctagaacctcctttcccacagagatacaaaacacacagttaactcactggtattttggctgggaagatagctgaatgatagcaccactttaaatcatatagtgatgactgctgctgatgatgcacatttcttttcagtatgaaatattagttttttgggaaatccaatgttcaccctaatcttgcagcattttgtaatttccatcatggcactgagcaggaggcaggatgggctgaagggaaatacactgaactgaactggatccttaggcctgtgggtgagacacagtattggcagatagtgccttcaccttgtggctcagtttcttcaggtttcaaaattgagagacttttttcacttttacatgttaagtaggtaaggatgaacggaaggattgtgatgtattgcatattggaagaaacaaaggtatcaggtcaaaattaagaagggtttatttgtggaattactgcagggagaatatccactgagctcagccattgaactcaagaacctgttagtaattaagaatatgaaaagattgtgaattgagcaccttctctgcaccatgccccgtacaaagtggattatacacaatatttcatttgctgttcacagtgatgttgacatagaggtttattgttattgctttattataaacaagtaaccccaaacaaagaggggataaaaaagtgatagattcccatgtgagagctcactaacccatggtatcccaatcagagggctagagcattggaatgacgtgtgaagacactgttgatgttaggtaattcccaggttggttaatgtttgggcaggaggggtataacttctctggcctccaatatgtgttaggcaccccttctgtgtgcttacgtagagctctgtaggcactcctctcagctccatttctccatgttgcaatttctggttatttgtttatacactactctaggagctccttgaggtagagagttctgtcttgttgactatgttatctgcaaatcttcatagagagccaggtacatggaaatgctaatacatttctatggaattagtgaaggtggacattcatacgtccaggcatatgaacaggtttttctctggagttggtgttgtttggtgtagaagggctgtcaatgagccttatgacttgaggaaggatcaacagatgggtggatagaagtacagatggttatatgcatggatggaaagggaatatggtagaagagaatgcttctgtcatgggctctaggaagtttactgaaatatattctgaaaggttgatatgtatagttcatccttattcttcccagcctctcttttctgagatgaccaaactattcaacataaatggtttcctgctgctcttaaatatttccaggacacttctgggtctcctgaagcacctgcttgctcacagcttcattctcacgtgaagtctgcataggtcctgttaccatatcagaactcttagaggacacttattctgggctgaggttttccaaggtgagaactccaggactggagatggagcagtgcatttaggtgaagtgatatcaaacaaggttggggttggtgttacttcccatcccagtgctggacacagccttggccaggtcctgttgtgaccccaggtgcacggggccttgggaacttctgaaagggtgtggagtgctccacccagccctgttggaggaggatgggagcgaaagcaacagatgtgctcaaggttctgttttcagttccccaaagggtcttctccttgaccaaagcagtgtgacggttgctatgacagttgctatcttggtccctgggactctccctcataaggtagcattactttttttaatcttctcaggcaagtaaccatgaaactctgtaataaccagtctgaggtggggctggttgggggcatgtttgggcctgagtactgggatgtgatggtggaatatgctggggtaccaagaggtacctttgattaatgagttatttttccaaattagaccaacactcctcctagttgtcttaggcttgatgactctccatttctgcagaagttcagaattcttcccttgagatgtctgcaattagttcattgttgcaaattataaaaacataacaggtagaaagaacactgaccttgaatctcaaatctgtctctaccaggtcatgtcattcagtctctgcttgggtcttctcatgtgttaaatgagagctttgatttccaagctccttttcactctgagagtcactgatgttttgcctctgaaaatggcaaccatgaagagtagttactgagaaaccagcactgtgttttagagttagggctcttgatcaggctgcctcattttgaatcctgatttgggaatttctgatgatgtgatcttggacatggtattgactttctctaagtcttagtttttttttttttttttatctgcaaaagagggtaaaacaagctaccccagaggctgctggaagattcagtgacatgttgcttgtcagtgttgagacattgtatccattacaactatcatagaataaaaacctgttacaagttggcatgggccgagctgccagcaatttcatacatctcttttatgcctattttgtttttcattttgatcatcaatattttaatggtgtgtcataaattgggggctctttcttatttgttcttggacccatggtgaaataaaagcttgtatatttttttagaaggattcatagagatgaaaggcccttactgaacattcagtctgaccttattagttttaaaggagctgactgagacctaactgttattattacaaactgatattattggaaaccaacacagaacctaccatgtgcaaaactgtgggaaaggcttggaagtctgggtttgacaacctgagtttaaatagtgattctttgtcttactagctccgtaatcccaaacacgtaatgcaatctttcttagtctgtttcttcatctatgagacagggctaatgagaaacatctcagtgtatggtatgacagcaaagggggtcatacaggtgacagtgctagcaaatgtcagtcccctcctcttctctacctcccaactcccttgaccctctcctctgtcatcccttttctggctgcgtgcagagaatcttgctagctttagggatacaaaaggttccagagttgggagacagactgttctcatacagagatcaataaccacatgatatgggtagtaagggccattcagatcctgagaagagtttggcaggtcaatggagggtggaaaggatgagaggaactggggagagagacagagaagagggaaggaaaaggaagggagaaaagaggacattgtgtatctgagaacaggaaaggagcaagtggaatggaagaaggagagggaaggcagcaggtgagggcatgtctgttggggtgtttatggagggttttttcagggaaagggtctgcaaatggagccaacaagaaaggaactggcaggtggtcaggatgtcctcctgtgagagtcactcttctccccatcctctctcctcttagcttcaccctcgctagaacttttccttgctcatttcaattttcaagattttcccaagcttctaaacctacaaaatctaagcgacacacatttactggagaaatcacaaacagatcccagccctcctgtggacctctctgcatctgtgccctggatacctctttctcctttgtttctgtggatgaaacatctgtgttcctagctgaggatgatacctctacctgtcttcacccacccttctcacctactcaggaacattgctccagcaatttctcttctctcctcttcagcaccagcttttccctttctaccaaatcattcttatcagcacttaaaaatgctgtcgtttctctccatttaaaataaaccctcacctgtgtatcatgtagaactatcaataagaaaaatattaaaaaataagaaaataaagaaaaaagataaaatatatcctctgtagagcccctttgtccttccagtgaccacctcatttctctccttccctcttctaattctctccttgaaagcattgtccatgcatgctctctccaatttcttcgctctcattctcttttgaacccatttggatcagacttttgcccctggcattctatagaaactgcacttgtctagttcaccagtgattcccaatatggctaaatccaatggcccatttccattcctaatcttggttgacttgtcatcagcaattgacacagttgatccattttttcctctttgtaacatttttcctcttggatcctaggataacaacactgtcctgtttttttcatctccttctctagccagtctatttcaatcttcttttctggttcctcctcatcttgctgacttctttacgttggagtgcctcctggctcagtgcttggatttcttttttggtatgtcgttgctaggtactctctcccagtctgatggctttttacaccatgtgtgtggtgatgacatcacgtttgtgtctccagcactgacctcttgcttctgaattctagactcttatagccagttgtccatctgacatctccactttgttgtctaatagacatctcagactcaacgtacccaaaacagagctcctaaagcttcaggaatcgagactgtgtctattgacataaggataataaaattgattaggggaattaaataaaatagaaatagaccaaacttacattgtcatttgatttccaacaaaagcaccaaagcaatctaatgggaaagaaaagtctttacacgaatagtgctggaattttcagcagctcatgaaatgtatatatattttatgaaaaaaagtaaaaataaaagtaaaaaatggtgctggaacagctgcacatccacatggaaaaaatgaaccttgacccttacctcatgctatacacaaaaattaattccaggtgaattaaagttgagctcccaaacctatgcctatgttctatagacttcttcatttcagttaaggcaactctatccttccaattcatcaggctgaaaaccctggattcccccttcagttttctctcttccccacatcaacactagcagtgcttcctggcagggctactttcaaagtagcttcatctcctgcttggattatgtaacaggctcccaactggggtttccacacatcttcctatcccaccctggatgggttattctcatcagatcacccagagaaatcctgtttatgtatgtcagatgatattattattatttttattatttttgagacagggtctcactctgtctctcaggctgcagtacagtagcacgatcacagcttactgcagcctccacctccctgggctccctacctcagcctcccaagtagctaggactacaggcacacaccaccacgcctggctaattgtttgtataatattttttgtagagacagggtttccccatgttgcctagtctggtctcaaactccacccacctcagcctccctaagtgctgggattactggcgtgagccaccgtctccggcctcaatattattattttgctcaaagcctaccagcctcatctcacttaaaagaaatgcttcctgtgacccacaaaacccgacatgacctgccctccctataaccctgtgtcatgagcactccgggcacatgcccacctcagggctttttatttgcagttcctgctgtgctcttacctatttatccacatggtttacttcccacttcatttaaatctttacctgaatgctaccttcttagtgacacctttcctgatgaccctgtcaaaacttataaccctcctccaacaattcctgcccttgctttaatgctctgtttaccccgtcgttatctaaaatactatattttaaaatttatcaatctttatcatttatctccccagctagactataagcttcacaaaggcagggagttttacctgtgtgatagcctcaggatcaaagacagtacctggcacatttcaggcattcaatacatacttactgaatgaaagaataaagtgtggccaggcgcggtggctcacacctgtaatcccagcactttgggagactgaggtgggtggatcatctgtggtcaggagtttgaggccagcctgacgaacatggtgaaaccctgtctccactaaaaatacaaaattaaccgggcatagtggcacatgcttgtaatcccagctactcaggaggctgaggcaggagaatcacttgaacctgggaggcagaggttgcagtgagctgagattgcaccattgcactccagcgtggacaacaagagcaaaactccatctcaaaaaaaaaaaaaaaaaagactaaattgtgattgaggtttacagatgactggtcagtgtttcccatatccccaaactgttttcctgcttgatgctattatttcatggggcaagttcaatttccttatccattgcttgactgtccaattagattggcagagcgttaatggcaaggactgtgtatcttatcttgtactgttctatatcctccactattgctgccattgtgagggggaacaagggagtggcttccctccatccagttccctacatcatatgtcatatcatacaaatatattagtatttataaatatattaggtctacctccttctctgtgcaaaatatgtcatatcaatgtctgagttctagtatgttcatattcttgggcaattatgtaattatggcttatgttgtcataacttctatgcccgtatttataagaaaaaaatattgagagcatttccaggaaaataattgactggaagaagagagagtggtaaaaaggaattaatagtgagctaactatcagtatatacaagcccagccttctaggatctggataacccgaagcaagaatttctctgtcagttttctcatctgtataatggtgagagtgggggtgttgaagtagaaaaatcctttgattaatatttattctaatccttgactaggtgctcagtgttagtccagggaactctatcttatttcttcatgggccagcttaatgtcaagatccaaaactcttgtgtaaagcttgggaccattttcaaggatacatttagtagtttacaataatctagataacactgactgatagaaatatgcaggaaatacagaaaattataatgtgatccacatatataatttagaagttttcactagccatgttataaaagtaaaaagaaatctgtgcaatcaattttaataatatttttgtttgcacacaagatatacagggtaatctcaacatgtaatcatataaaatattaatattttacacgtattttttgtacaaaatgttaaaaattggatgtgtttttacacgtatagcccatcttagtatggactggccttatctccagagctcaataactctgtgtggctagtggcaggatattggatatcaagtctagaacatacgtgaattaattcaaggttcaagcacattaaggctgaaagagttatgactgaagaacaagttcaaggaggaaatcaaacaatagccaaatttcactgagctactccttccattactaatgataacaaatatttatagatcccttagtatatactaggcctgatgcttagaactttatatgaactgtttcatttaatcctcacagcaatcttacaagtaagacctccaccccctttcagatgagaaaactgaagcacaaaagtgcagtaacttgctattatgacttgtgagcatattttcccaggcaattatatgcacagtatgatgtaggtaaagcagcccaataatttattcactatatttctccatgctcatggtaaggactgacttgatccctggtggtcacccacttgtgctccctcagtgagggaagggctgcagagcccctggcccgtgtcctagtgactcaggcttgggatctccagcagctgctatggttgacaatttagtttagtaaaatgttagatcctaccctgataactgttataaaaaatcctccttccccttccccagcacaggtacccagcccaaggggcactttctatggaaagatgaaaagaactgacatggacttgagctcactgggggtgcaggtttcaagaaagaacaaagagagctgttaggttgaagagacgcagttgaagagttaagtcttggaattgttaatacctggaacaaggcacggtgtgaaaagacaaagaaacacacaaacatcaatctgtcctcctcttttctctttctgtttcatttcttatcctccatcagtcagactttgcttcctctttctcctccttcacctcctcctccctgcccttcccaatttctttctatcttccatttattgttcttccaaaattcgtatactcatcctctcttctccctttctcttttctccaaaataatatgttcaacttactgacttgctcagggacttgtgggggcgaatgtattagcaccaaacctaggaaacatggcgaattctaaaaacttgttctcatagaaaaaagagttaaaaatagaaagctacagtccagttttgaagccacagaagacctcactctgatgtatagacattagagtcagaaaaagactttgaaaagaccagtgaagctccttgtcccacagacagtgtgagggagggacaaggggaattgtgtgcccaagcgtacttgggatggtgtaggtggctgataagagtgtcagtggaggtggtggttagcatttggagtgccccaatcttgtgacactaaacatttattgttatactaaccccactgccaactaccaggaagttttcatttttcttactgtgtcttagtctccatggcatctataaactgttttcccccaatgtccaggcatcattcctctcccacagttgatgtctggctctgtgccatgggtgtgggcctgcctcttctctctcagaatgactgctgtttcatgcttggtgagccacgcagtatgccaagctgctgtctctgacctggagaaaggatacccatcctaccacaggtggggcatatcatgggatggccttcctggttttccttggcagacacatttttctcacttttttttttctctcctcccttctctttttccctccctctttgatttcttctcttttccttttctttctcttgcctcacttctgccctagatctaccatgggacccagggagctttggagccatgcaacccacagtgtgctaagctttttactcatgctatttcttttaatcttcacaattctttacctatcaggcattaccatcagatctgcaccttacaggtgagaaagggaggcccacaccgattaagaaatgtgctcagggccacacagcctgtacatgtcagagtaagggcattctcatgccaaggttcattttcagagccaaaagcataccacgtctcaggagaagcaggctagatctcttgtctgcttggcttttaactcatgctgacctgaactttctggatttgagtaactctcagacctgtggagcccgatttctgtgagtggattttgccagccacctggggaggtgaacccttgctggggtatggctcatcagtgtagaagggagttccttcagaggtacgctgtcttctcggccatccccattgtagtagtttcttgggtctgccctaacaaagtaccacaaactaagagccgtaaaacaacagaagtttattctgtcataggtctggagacagaaatctgaattcaaggcacaggcagagttagtgtcttctgcaggttctcggggagaaaccatcccacacctctccagcttctggtggctcccagcaatccttggtgctctttggctctcagctgcatccctctggtctctgcctccttggtcatgtggctttcttcctatgtgtcactgcatctccaatctccttcttcttataaggacaccagtcattggatttagggcccactcggatccagcataaaaaaaaagtttaaaaaaattatttggaaataattatagattcacagaaagtagcaaagacaggatataaagcacagaggtctgatgtgtcctgcacccagtttctcctgttggttacttcttacgtaattacagtacgatattaaaaccaagaatttgacattgataaaataagtgtgtacagttctatgtcattttatcacatgtctagatgcctgcaactaccactgcaatcaagatacagatttatcccatgatcacaaagatctccctttatagtttcgcctactcttctttctccaccaccctaacccctggcaaccagaatctgttctctatccctataattttgtcacttcaacaatgttacataaaaggaatcacatggtatgtgaccctttcagattggcttttttcactcagtagaaagtccttcagaatcactccagttctctgtatcaacacttcgttcctttttattgcctcatagcattctatggcatggatatattacaatttgttaggctagttgcctattgagggatgggttggctctttctagctttggctacaacaaataaagctgctgtgaacaatcatgtatgggttctgtgtggacataagtttttatttcctgggggtaaattcccaaggagtacaattcctgggtcatatggtaggtgtcttttgtttagtttttcaagaaactgacaactattttctagagtagctatacccttttatattcccaccagcaatatatgaatgatccattttcaccgcatcctcacaaacatttcagtatgacctaattttgacttgattacctctgcaaagaccctatttccaaataaagtcacatttatgtgacccatttatgagtaccaagagcaaggagttgagcatacctttttgaaggacacaattccacctgcagcacctgtcttcacttgcttaggttatgggtgggtttcccttcagagtgttatcttctgagaagaaggtttgaattcatagctggattatgcctgcctttgattgttcaatttggcccccagggatgagtgagcaagttcatgtcattggaagggacattactgagtctcacccctactcaaacctccaaagtttgaaagatttgatactcatcaacattctcaagaggcagaagggcaaggtgcttccttatgtagtttctccatgactgtccttccccactttcccagtactgactggaaagaaaaacaaagcaggacaaagggattgtcagtcatttgagggaagggatgctgtgttagttactcctgaaccccttcagagtgtaggcagagagaggtacttagaaaggtgtgttggatggatgagtagctgagaggggcagggccagagtgccccatagaatgaggaagagtcctcatttacatgtgcccttcccccttcccaaacatgtgagtgttcatacatgggtttccagtgtctgggcaaggttaattctgtcctctgtccccttgctgaaggtctgtttcatttaatttctatgtatgtgtgctcctagctagccaaacagggcacagatgccaggaaaatagcaggcctgttgttttgttgagcaccttgagccctggaaggcagactcattcagggctcaagagggcaggattaggcaggtagctatttgatcccaggcccccccacttaccagctgcgtggtcttgacctattacttattcctcttctatctattaactgggtataagatgttctttatgtgaagttattttgaagcataatgtgtatacagaacagtgcacagatcataactgcacaaccccacacgaggaacagaacattaccaagaccccagaagccccttcttgtcttctcccaggcactaactcgcccacccccagctaagagtaatttccatccaaatttctaactttatttttacctggttttgaactttatatggatgaaaacatacagaacatatcttttgcattgagtttctcttatgtaacattatttttatgagattcatctgtgtgagtaggtatagttgtagcttgttaattctcctcattgggtattctaatgtataaacataccacagtttaataactcattctattgttggacaatcgggctatttccaatttttggcttttgtaaataaagctgctttgaacattcttgcatagttttttggtgggtggggacactcagtcatctagaagtgggattgctgagttatagaatatatttgtctctcagctttatagaacctttgcaacattttaatgaatgtttttaatctcacagtatagtgtggattaaattaggttgtggaaagtactcaatacggcccttggcagacaggagtccctcagtacctgtttaaaaatgtaaataaggcatgacattccattaagtctaagtaccatgatgaacttaaacatttccctattgtttgtttatttaattgcttttattgtgttgttattttatatcatgttgcaatgaatgattctctttatagcaggtttcttcttttgaaaaatttgctttggttgattctcagggaattgaatcaaaggatatatgactgtaagacctgtcacccttaaaaaggactatgagggcttgctgaggaggggaaaacaaggaagcaagtctctcctaccatggcccaggggactgtgaggacagaaggcttgtgggtttgagggaggactgtcttgcagaggatgatagggtaaaatagaatgaaggatgatttttataaatggttatgcgccttaggatgactacatatttagtcccttataagagaaattgagtagttggtaaaacaacagataataattattaaatgaggaaagagagaaaccacaggtgcaaagattcactttatttattcattctcctccaacattagcataattaaagccaaggaggaggaggggggtgaggtgaaagatgagctggaggaccgcaataggggtaggtcccctgtggaaaaagggtcagaggccaaaggatgggagggggtcaggctggaactgaggagcaggtgggggcacttctccctctaacactctcccctgttgaagctctttgtgacgggcgagctcaggccctgatgggtgacttcgcaggcgtagactttgtgtttctcgtagtctgctttgctcagcgtcagggtgctgctgaggctgtaggtgctgtccttgctgtcctgctctgtgacactctcctgggagttacccgattggagggcgttatccaccttccactgtactttggcctctctgggatagaagttattcagcaggcacacaacagaggcagttccagatttcaactgctcatcagatggcgggaagatgaagacagatggtgcagccacagttcctgaggaaagaagcaaacaggatggtgtttaagtaacaaagttctgcccttgggtgtgttgtttgcggataatcacagggcatgttagggacagacagaaaacagcatgcttatcccagataattatagcaaggagaccaagaagcgtatttaaaatcttgatgttttgagtttcttcctagcttccccctattccttaataaagttctaaattgttttgttggagctctttgcagccattctgagggctttgcatgcttttctgaccttgcagtaaactcaatgctttaggcaaagaatggccacgtcatccgaccccctcagagtttagaattcagaacaggtctgaagaagaccaggcagcggctgagtcaaggaaagcctccgtccgcttttatttcccctgtgcctcttccaggactgtgctgggataacaggctcccgggggttactttggctgggctgggctaaaacctccctgcagagcaggccctgagccctgcctctgcgcctgggtggtgtcagcccctccaccttctgactgttccagcaactctctaagccctcccaaaggcctcaaggcctgtaaccatatgcagcaattttcagccataccaggagaggtcaactgtaatcttggccacctgcctaagaggaagtggctagcttcacttctgaccctcagcaactgccaggtggcctcttggaaatccccctctgggggattccacccgttgggtgggagagcagtagttaaaatgtaaaataagaatcttttgctgggagaagtcaacagatagggagaagtcagctgataacagaaatagttttttttttttttaaaactaacttcactgttaaccaagcagttcaacatgaaagactgaatctcttatgtttaatattttcttctcttttaatcttcataactaatttttttcagataattgtataaaataaccatggtagcaaaataatgtgatcactggaaaataagcagggaaaaacatgctatgaagatactcctatctgggtgaattcttgatagctttacatttttcatctggcatttaaacattaaacagttaatgtatttgacatgaaaattatttcaagttatcttattagttttaatagagtttaaaaagtgtttaaaagagttttcaaaaggctctaaaatcattttgaaatagtttaaaacagttttgaatcgttgtaagttagttttaatagagctttaaaaaggccctaaaatagtcctatcaagttgttgcagaccaaaataatctccttaaatatcacttttgagatcagctggggtaaacgacagcaacacaatgacaaatcattaaactattttagagattatgaaattaaaatactcagattaaaattttcctatcacagaattaaggtactggaaaatatgtttaagtttttattaatcacattgctataggtttagatattttgtacaactgaaataaaatcacacactggcagctacatttttgaaagttaaaaacatggtcacgaatatatcttattttaaaatcagttaatataccttaatggtatttaatgccaaattcaaagtgaattgatcaagccctcagtggccaggtcatgggtgtgatttttactctgaaagaattacatatttctttctttttggttgagcttttgttatttaaatacatttgatgagaggatattgaaataattaaatagcactgaaaaaaaaaaaagctttaaattatttacaatcccctaatggaaattttcactaatgagatatcataatgaatgtgaattttatttctgaaatctctaataaatcagtcttctccctggttttcccagctcagcgcccattacgtttctgttctctttcccttagtggcattatttgtatcactgtgcatcaggaaagctggctacggcagcatcaatcgggcagacacagggtggccacggccactagcggcaaggcggctgccccaagagcgcggtggcatggccaccaaagccactcaatcgagaaagaccgcggctctgtctacagctcgcggtgccacggccttcttggcagaataaaaatgtagacaagtaataacagaggataatgaaagaacatactctttaaaatatttcctatttttttcacagacccacggtcattaaaaaatgcaattatttactttttttcatttaaacacatttctttgagattgagcttttgggaataaccacctttccaccattacaataagagataatttcacgtttagtctaatgtacaaattggatttttaaaaaatgagctctatctgtgaagcccttattcctatagaatgtgtctttttgagtttattacttattacagactctaaaaacaacattgctgctgattttcaagtaagctgcctcttctacatagcaaataggtacacttcacttttccctgatttttcttagggcgtgctattgatttttattgttgtctgacaaaataatttatcaaacaaaagggagaaagactaaaaaatgtatttttccacttttctgtatcatgcataatcagcaacaaccaatacaatatttggcaagagtgaacaaaaataaatttacttttgctccttagaaatacaagggttcctttttagttacactttttttttttactttgtgtcattcagtttagagcaatttaatctttttttctccaaatccatttttgaagctgagtttaacttttgcaacccatggcaaatcttaaatgccctcatttaccaatctttaccaaactcctatttaagcctctaaaagtcaatactggccatcagacccaaatttcagaagacaatagtgaaaaattacttacgtttaatctccagtcgtgtcccttggccgaaggtgatccacagtgttaacttaattactttccccttaacaaaaatctcttttcgctgttaatatcactaacctgaccgatgcagagaaaatcttgcaattgagatgcctcacttaactggctagcgcttggctgttccttaagatgaactaattttctatcccttactcatctgactttttgaaagaatctggtactctttggaattgacctgagctaatatctcaaacacaaaaacgctccaaatttaaaaccttataagaaaaagcattaggaaagtgcacttacgtttgatctccaccttggtccctccgccgaaagtgagccacagtgagggatctcaccctttcccctcaacaaaaacctctcttgaagccaatcatatgagataggctgcttgttcagagaaaaatctagctatttcttccccatttcccccatgaatcctattctcctctcaaacccaatgattcgtctatttgctcagctttttaagttcattttctggtgtcctgctatttacttctgggtcaccaggtttattcaaccaaaatatcacaaaacttgcacaaatgatacaatggcactaaaatctcacgaataattgagacagatgtacttacgtttgatatccactttggtcccagggccgaaagtgaatcacagtgattcgtcttaacttttccctttacaaaaacctccctgaaagctcagcaagcctctttcccccaatgaagttattttgatttagaaatcttaaaaattagccacaagctagcgtcctgtggaacaatttcccctcctctgtacctaacctgggaatgaagtttgttagatccctggcatccgactaatgaaaatccacacaaaggaacacaaagtaaactaattagcaacagtgaagaatcagtggaaaaaagtacttacgtttgatctccagcttggtcccctggccaaaactgcacacacaatggttcctcttaacttccctcctatacaaaaactccctttctgacaattgaccaaggctctgtccagaacatgttatgttccccaggacatttctgaagctattacttagacaagttattctcacccaatgactgaatcttgcttgctcttcaaagaaaatgtgcaatcaattctcgagtttgactacagacttatctttatcttttccctgaaggatatcagaggctgattgcagagtcaccttatagatcacttcatagacacagggaacagaagacacagacaactgaggaagcaaagtttaaattctactcacgtttgatttccaccttggtcccttggccgaacgtccaccacagtgagagctctccattgtcttgctgaacaaaaacccttctcaccaaaggggaacagagtcctgggtcagctgctgaagctcaactcccttttcgagcaggtgtggaaaccctgaggcttctctgacatagcatgtgtttattttcttaggtgagacctaaaatccaagaagagaatatatttacgtctatggcctgatggttcctttctttagcaacttgccacatctggactgcttattatttatttattttttagaaagtagactgaatgttaattacaaagaaaaacaagcaattaaaaaaaatggccagtttttttgtactttcttttggggtgggctgggggggcttttgcaaaggataaacttcatttagtgtaattatggaaatcatcagcttctcaatgagtaataattacaggttgtcttactattttatcttctcctttgctgcaatgttatttaaaaaaaggtagactaaatatatatcaacttaaggctcataactttgaaatgcattttgaaatgtagctccagatggtatacgaaaccaaagtgaagactaatagagtagaaaagtagactttacttggttggtttgtctgttttcacagcacaggaagagctcagctcttactgagctggaccaggcgcatgccatctttggagctgccatggagtcccagtgttccatagtgtttccatagtaatctcatcaacaacactgaagaccttttcagtattttcttttgagtccagctccatttttgcagccttgtatctctcttaaccttccatctccaccccttccatacattactcccacctccctacactccttagagtttttctatggcctccagctttcacaagcactccctctgcttgggaacatctttgtccacctgggttagcttgtgaactgctaattgtctttcaaaattcaactgaagagagaccttctctcagattagccctgagcaggtgacctgaatttacagagtacagagacaggtcactgggcctagagtacctaattattttttattttatttatttattttttttgagacggagtctcgctctgtcgcccaggctggagtgcagtggtgcgatcttggctcactgcaagctccgcctcccgggttcacaccattctcctgcctcagcctcccgactagctgggactaaaggcgcccgccaccacgcctcgctaattttttgtatttttagtagagacggggtttcaccgtgttagccaggatggtctcgatctcctgacctcgtgatccgcccacctcggcctcccaaagtgctgggattacaggcgtgagccaccgcgcccagccgagtgcctgtttatttttacctgctttcagattctcttctacccttctaaattataagctgtttgatgttttatttgccctgtatttgggaggctccgtccagtatctttacttagcaaatgcttaacaaacattttcagaataaataaaaaaaaatacctaattgaaagtcaataatagatcagagatgctatcatagaccaaagactaatactgactgccacaacagtaacttttacaacagaaatcataactacaattctaaagattaggggtaggtttatttgattctgtcactggcagctttgctagttgccttgaatagcagaattagcatttggtctcaccagaagatgaggaaggagagggatcaagttagaggtggagagttaacattggcaagtgaaatttaatgtgcaaaatagctgaccaagggcatagtccttttttaaaggggacacaaagtgattttctctgcagacatacacgcaataccaatcataaagggtgacatttattgagcacttactaagtgccagacattgtacatggatcatcacatttaattattcccaagactctatgaactaggaactaatattatcccctactttgtaggtgcaaaaacttgagggcagagaggtcaaggaactggcttatggcagtaagtggcagagctgtgacctaaactcagatcccatgtttttaactgaactatatgcagattatactccaggagtaaagtcactcaacggaagcaacaagcgtgacagggaatgctgggatgggggaaggtaaaaggaactccttagactgggataagtgtgtacagacgtatgtataagactacacatggaaatattgtttaaagagtgaaaaataactaaaatcctcattaataggagtttggttaaactgtgctagagctttacaatgtagcacaaagcagacattaaggggaagacgtagacttctatatagttacgtggaaggtgtttgtgaaaatgcaggtcactgaagagtatgtgtggtgagatatcatgatcccatctacattgaatatatatgtatataaatacgggctgaattttaaaagacataaattgtgcttggtagttatctcctgggattgcagaggaggaacaatgacactttatgccatctcctcctactcttctgtatggtgatgtgaatatattcattttatagtttttagaaataataaaactgtactaattttgaaaaacagtaaactctgacattgcctattagcattctcgatattcctgtgcaatgcataaacataactttttaaaagatatgtacacacatgtgtgagttttctttgtcaaatacttttctataatctttaaatcaagcatgccaaaaaggtaaaagctttcctgtttcagtgtaggagatagtcgtctgcaaaggaaagagatgtaggggatagaaacaggaatgaaaaagatgactgagctgttcgagggacttatgttcctaagtgagctaattggaaatctaatatgaacagtgcaaccgaataactattgtaaagcagtatttgtaaacaataaaagatgattatcataagtaccattgttgcaaaaactattttattgatcacatgcagtggtgatctgtaggaatgattgttgtgatgtttgctgtaacataaaatgaaacatgggaagtggctgagatctttaggatgtgtgtggttcattttttgaaagcaaatgttgtctcagaagcatctgtgagactctgccaggatccaccgttctacaaaatatctgtgatggacattgataagattgatctgttgaggaaaggcaaggtgtcagtaagatagtctgagagcttcttggatttcatgtaaaagagtgctggaaatagaatttcttggggaacattccaactaactcatcactgaaggtgctttacattgaaccctcagcaaagttagattatcagaaaaaaaatataaactgctgtggaggggacaggaaggaaagtcagggagggaggggggcaaggagagaaagagcgagagagaggagagaaagagagagagagaggagagagagagcacaagtacacacttcaatgcacatctataaatcatcctgaaaactactgataaattattttagcaatgttcctcagatgtaacatttcaagaaatatcatttttgctttttatttggcataatttactagccaatttaggaagttcccctcacatcagtaacatacagtacatcacccagtatgtcagaggacacaatggcataagtttgccttttgcaaggtttgagggatggccatttccctacctgactcaggaaagtctgtagctgatatccatcttcaagtttgtggttctttctctctatatatatatttgagctcagcagtcatgctggagtccagagtaggtgattctttctgctttagcttgactcctccttaagattgtaactctctcagttttacattttttgtcagacgtaagctgacattccacaaggagaggaggaaattctgtggttcacatccagtggtgcttggaacctgattggttgtcattcttccagctagtttgtcacgagtggatatctgtcctggattcccaaggatcaaggctgccccattagccaggaagtagggagatagaggaggtcacttgagaaagagctgcttctttgccgcctccaggttgtgtctgtttcctctcatatctgaagacagatgtgctggcagaagcaaagtcctttgtccggccacgtgcaaatgcatgggacataaatatgaacagagattcttgtcccactctagaaaatgtagatgttcatcttgtttccaaggggacagtaaggctgcaggtgttttttgacttccttgagagaaagagaagatagcagcaattgtatcagggcttactatcctaggaggggttcagccaccgagatttacatattcagtgctgtggtttttgtttcattttgcaagaggaacgagcccctcaagctctgtcttagagttccctgccctccctgtctacctacttggcacccagcccctatgttctcttctcgtattaaggcatagaaatcatgggcaactactgttcaggctggctctggatgaagttgtgaaatcgatgagttggggcttagttttgcagacccccaaatgccctgataatcctggctcgaaggggtgtccagcccctccacacctgtgggtatttctcgtcaggtgggacgagagactgagaaaagaaataagacacagagacaaagtatagagaaggaacagtgggcccaagggaccgtcactcagcatacggaggacccgcgctggcaccggtctctgagttccctcagtatttattgattactattttcactacctcagcaaggggaatgcggcaggagaacagggtgatagtagggagaaggtcagcaagaaaacatgtgagcaaaggaatctgtgtcacaagtaaattcaagggaaggtactatgcctggatgtgcacgtaggccagatttatgcttctctcacccaaacatctcagtgtagtaaagaacaacagagcagcattgccgccagcatatctcgcctccagccacagagcggttttctcctatctcagaatagaacgaatgtacaatcaggttttacactgagacatgccgttcccaggggcatgcaggagacagagggcttcctcttatctcaaccgcaagaggccttcctcttttactaatcctcctcagcgcagacccttcacgggtgtcaggctgggggacggtcagatctttcccatcccgcaaggccatatctcaggctgtctcagtggggagaaaccttggacaatacccagttttcctgggcagaggtccctgcggctttccgcagtgcactgtgcccctagttaatcgagaatggagaatggcgatgacttttaccaagcatactgcctgtaaacatgttgttaacaaggcacattctgcacagccctagatcccttaaatcttgattccatacaacacatgtttctgtgagcacaaggttggggctaaagttacagattaacagcatctcaaggcaaaacaattgttcaggatacagatcaaaatggagtttcttatgtcttccttttctacatagacaaagtaacagtctgatctctcttttccctatcctggctgaggctagagctccaagtctaagaaggaggataggaggcggacaggccaatggaaacaatgaatgaacaacagatggaaacaaggaatagtgtggatttttgagttcattagcgcgtcctccactctttcaaaacctcctttgcaatgacagaagaaatataaaaatgataatgaatttatttcgtggttggagaatcatgagaggtcctattagaagaaaaaactttgaagaacaccacagagatttaaaccatgtcattgaattcatagagaaactggaatttagaaacattttttccattgcaaaaacaggaggcgtccttgaagcagccagttctagttttccccacagagccccagaaaagccgtacttcagagctatcgggctgggaatggtgataggtggacagtggagagtggaataacacctgggtcatctctctgctggttacagacagcttggccctcatgcttcaggccgtgggaatagagattgaaagaaaaagggggcaagttaataggcattcaatagtaatgggatttaaaaaaccctcccaaaccactagaaggaaaagaaatagacaaaaataataaaccaatccagcaaagtttaggaaaagtgaataaaaaattgaggtaagcacgatacataaaagtacaaattaagtttgaaggaccaagtcaaaatatacagtcacaaactattgtgaatgttaaattatttaaaactttaaataatttatctaaaaataaaaataaaccaaaaagatgactatgtatgttttcaaggatatttgattcactagagaaacagttcatttgcttcctatttatgatgattaaaaactagattgcaaaagttagatgttaatgtaaagaaaactttatgaaaatgataatggatttttatctagtagaaaagataaccccaatgcttatggttttattgctctgtaggacattaacaagttgtgcatcttatttagcaaacttattctaacattagtagatgtgagtgtgtgtgtgtgcgtgtgtgtgtgtgtacgtatacatataggtgtgtgcaggtatgtgtatatgtatgtatgtaggtatatatgtatatactagcaaatgataaagttggttcaaaggacgatgtacagtagtacctccttatccacaattttgctttctggggtttcagttacctgtaggcaactgtagtctgaaaatattaaaaagaaatttctagaaataagaatttactcattttaaattgtgtgccttagtagcgtgatgacatatcatgcccttccgctccataccagcctgggactgaatcatccctttgtccagcgtctccatgctgtctacacttaccctcctgtttagatgcttagtagccctcttggtcatcagattgactgtcatgatatcctagtgtttgtgctcaagtaactcttattttactgaattgttctattttattactagttattgttgttaacctcttactgtgactaattaatgcattttatcataggtaagtgtgtataggaaaaaacatagcatatgtagggttgtgcaatagcatccactggggggagaattttgctgaagttagaacagagaagactgtccagaagaaagaattttctatacttgccaccttttttctgtttggtgtcctcatgtaagtctcagtgttacgatctgtctccccacctcaatcactgccctctgtctctggaaggaaattccccttgggctgaggccagcatggtgccagacaggagagatccagtacccactctggaaaatttcataagataactggttctccaccttcttcagggaccttttatcatatctcatgtgcccatggcatttgtcactgccatctgcacaacactgaactccagcaacatcaactgagaagaaagagagagagagggagaaagagaaagagagagagagaaaagtcgtttgttgattgagccacacaaaattttttttctaattaaattatatatccaggtagctgcaatatgctacaatcccaaatacacatatttattaaatatgattcaaagagcattcattgagtactctgtatcaaggcacaatgtaaaataagtgcaaaattactggtgattgttacgcctttctgtgggactcgactctctctggttggaggtactgtgtgggagcacgtgagctccaatcaggtggtctggagggagcaaaatgcagctgttggaggttaaatatgaagggaaatagcagtaggcatcggatagcatagaatgaaaataaaagtgcatatacttccagtgcctgttttacagattccttgtctttttttttttttttgaagacggagtctccctctgtcgcccaggctggagtgcaatgctgtgatcttggctcactgcaacctccgccttctgggttcaagcgattctcctgcctcagcctgctgagtagctgagattacaggtgcgcaccatcacgcccggctaatttttgtatttttagtagaggcggtgtttcactatgttggtaaggctggtctcgagctcctgacctcgtgatccacctgcctcagcctcccaaagtgctgggattacaggcatgagccagtgcgcctggcctccttgttttttaaaactagttcaaaccctcaactcataatttgggaaattcaggtcataggatgccctgttatttataaggtatccagcaatgcatggaacagaatatttaacttttaaaaaacttatattaggttgttgcaaaagtaattgctgtcattttctcctttctttttctttttctttctttctttctttctttttctttctttctctttcttcttttctttctttttctttctttctctttctttcctttctttcttttctttctctttcttttctttcctttttctttcttgtctttctctttctttctctttctttttctttctttctctttctttcctttctttcttttctttctttctctttctttcctctttcttttctttcccctttctttctttctttctttcttgtctttctttctttcttctttctttctttttttctttccttcttctttccttcctttcctttccttccttcctccctctctccctcccttccttccttttccttccttccttcccttccattcccttcccttccccttccttccttccctccctccctcccttccttccttctctctctctttctttctttcttcctttctttctttctctttcctttcttctttcgttgttgtgttccagaacgatttagtgttacctacagttcccagagaaagaatcctgtcttgaggggtggctggggcagggctactactctccctgctctgtgctctagtggccaggtggatcagctccagctgccaggtcaaatttcctagggaatggaattctgtctttttaacaagaacaaaataggtgcttagtaaatataagatgccttcagcttttagtatatgcataatcataaatataaatttgtttaaaacctgaactattctgatgttctcactggctagccaaacttaaaatgtgtatttggacttgaatttcccaccaagggtgttactagcttctttactgttgcagctgccttttgttttgtttttgaaagtttaaaaaaatacacaagggggcttttgcttcctgaaagatggagtagaattacttttacctatttctctcaagtaaagtaaaaaccccggacattgtacgtaaagcaaacttatgaagactctggaagctggagagaagaaggcagaccagttaggaacattgggacccaaggagcgacccagcagtgcattccacggggtttctttttgcctcatccattccagacttggttctggagaagtttgtcaacccagaaacaccaacaggcccagaaaaacataaagccctaataaaaagctggctctctctagtcaaaggagaaagaaaggggaagcccagtaaaacaattcttaggcagtaacggctctgctccattcaaacacccaacttctccttcctgagtggcaagagaggaaattcgctgagatgagtttaaatgagatccaaagcctcataacacaatactccaaagtccagatttcaaatgaaaaccacacatcccaacaggaaccaggggaaccaggaaaatctcagctttgatgagacagttaagaggcgctaatactgacatgacagagacgttagaattacctgacaagaatgttaaagctgccatcgtaagaacacatcaaactcaacaccaccatcaatgagtaagatcataaatcaacatttctggaaaactccaaccagcaccagcagaattcgcattcttttcaagtgctcatggaacatataccaaaattgccatatactgggccatgtaacaaacctcaacaaatttaatagaactgaaatcacatgaagtgtgttctctgaccacctggaatcaaactggaaatcgataatagaaaaataatgggaaaaatgccaaacccttggaaacaaaacaacacacttctaaacaatccatgggagatttcaaggaaaataaaagattatatattgaatagaataaaactgaagatgtaacatattataatatcaaggatacagtaaaagcccaaagaaatgaaaacttatcccagaaaaatgaaaacttagcacaaaaacgtatacaatacacaactattcatagtggttttatttgtattaaaaaaaaactggaatcagtcaaaatgtcctacaatagattaatggtaaaacaaactgcggtacatccatcccatggaataattagtaataaaaagtagtgagttgggcacggtggttcatacctacaatccatacctacatacctacagcactttgtgaagtagaggtgggagaatcgcttgacctaggagtttgagaccagcgtaggcaacatagtgagaccatgtctctaaaaaaaatttaaaaaaattagctgtgtgttgtgtcccatgcctgtagtcctagctacttgggaggctgaggcaggaggaagcttgagcccaggagttcgaggctgctagagagagttatgatctcgccactgcactccaccctgtgtgacagagtgagactctgtctctaaaaaaaattaaaaaaaaaatagtgagctgttgatacacatgacttgaatggatctgaggggcattatgctgagtataaaggtcacatattgcatgattccatttacataacgtttttgtcttttcaaaaatattgcaaggggtacttggttgcagggtgtgcgcatttttcaatttacaaattggcctcaaattcgtgtattaagtttcattcccacatttgcaatgataagtcctccatggagtttcctcactctacatcctctccaatacttgatattatcaggctttttaatttttttccactcaaatggtcaatacgttgtattttatttttggtttaaaatacatatttgtgttttctgatcactcatgaggttgaccatttaaaaatgtttattggctattggggtctcatctgttgtgaattgcctgtttttaaggtatgcccacttttttattgagtttcttatttttttcactattgcataggagttttcaatctttcttccctcctcttattctttaataacagaatcccaatttttttacagggcaacagtgtcccagccaaaaatctaattcctcagcttctttgcagttaggactgttgagacatcatctgaaatctattgtgcatttctggaaaaattttgcttgatggacagaggcaccactgcttatttctcctttgtgttctatcttcttctatctggaacttggcagaagcacccatcttgcaggatgaaagtcacaagctagagtggaggagcaggcagggaaaggacctgggtcctgcagcagctgtctagctctgaaccacctgcctccagagtccgccttggtgagaaaaatgtatctctttatctgatcaagctcctctagttagatttcaactacatatagctgagtgaatactgatgaatactgaataatgaatgctggtacaactttctaatatcttctcttagagttctgcattgaagtttttaaataagtttagtctatacctttcttttccattttcagtcttcaattttgacttcaagataattctagtcctatgatgtgatttatgtttctaaataatggcatttaccctctttcactattccctggaattggaaaaaataggttatttatttatttatttatttatttatttgggtttgggtaaaacttaaccatatgtttaacaggacctggactttgatttaagcaaacttagggtaaaaacagtttaaagacaatcaaggaaattggaatagaaaatgggtattggatattagggaattactctcaattatgctgggaatcataatggaatggtggttgttttttaaaagtccttatcagttggcaacgtattaatgattggctgaaaaatactgccagtgtctgtgtgtgaggaggtgagagaacagagtaattggatgaggggggaggcggtagttgaaacaagattagcaaaatgttaatttgtgaagcttagggttcattatactatttgtgtatattcatatttctataaacactaaaaatgaaaataaagtggtctcgtgttgctgactgtgactgtcacactctgtcagcagatggcagtgttgtataaaccatgagcctacataggcctaatggatcattgtgcttgctaagtaacaaaatcaatgatacgatataaaccaggtcagattttattgcttttagacaaaagggcaaggtaagatttgcagagtaaagaacaggtacagagtaataataaattattttaaaaattctaagtgattcattaaagtcttatagacaagttgggtagaaaagtacgtaaaaaccccataaacctataaacttactagaattataaaatcatttggtctctctctctctctcaaactctccccttatttgcattttaaatcagtattttcatacatatatatttgcaaaaccttattgatttcattgatgaaaatgacttggagtttgctttaaaaccttacacgataaacataaatattattctgtagttctttttacccaacttttaactggcatagtttaatctatgaaaacagctccatattttaaaagattctctaactatgacaacaggcaacatttcatagatgataaaatgtcttatcaactaatacctaatattttaacttaggttatgtacagtagctttaagaaccagttgtagaatttgatatatagaaaataatatagaccctgtcactgggcaaacttatggtggaatcattttttgtgttgttgtggacaaattagttattctttctgaacccctgtttggatatatattttttaaagcccataatttgggcatcctcataaagtagtgacgtctgaaattaaacaatcaatgtaagagagctagtttcctttctcggcaagagaatatgactctaaaatttatgcccaagttagactatttttatcttgcctctttcccctagaatatttgggtttaattaaaaatttacaatgaaattagaaaaataaaaataaaaatcgaaaatcaaatggagataaaataacagtggtaatcaaaatagacccctattttgatctaaaaaagaaaagaaaaaaagataatttggacatcataaaattaaacttctgctcttcacatggcacgttaagaaaataaaaggcgccacacattgggagaacatattcataaaacacaaatgtgagaaaaaaatcatatgcagaatatacaaagaactctcacagtccatagtaacaacaccccaataaaaacttgaccaaaaatttgaaaggatatgtcatcaaagaaggtatatagtgaagttaaaatactaggctcgagcaagtggaaccctcattcactgctgatgggagtgcaaaagagcacagcaactttggaaaacagtttggcagtttcttataaagttcaacatacacctaccagatgactcagcagtcccaaagctaggaatttacccaagtgaaatgaaatcctgagttcacacaaaaacctgcattggaaagcttacagcaactttattcttagcagctaaaaattagaaatgaccaaatggctttaaattgttaactagataaacaatctgtggcatatccacacaatggaatactactcaacaatagacagtgaactagtgctacacgaaacagcaaggatgaatctcaaatgcattctcctaagtgaacaagtgaacaaagccagactcaaaaggcttcacattgcatggctctatttacatgacattcaggaagaggcaaacgattggatcagacaaaaaccagtggttgccaagggctggggtgaaggaaggggcataaaggaactttaaaggatgagggacttgtcctatatcttgaatgtggttgtggttacacagctatgcatttgccaaaacttatagaaatatacacgaaaaggtggcttttattgtaatttatacctcagtaaacctcacttaaaataagcagtttttgattgaacataaaatctggttctgagcttcttggaaaccgactaaatgaagataatgtgttatgttacataactttcatctaggggaaaaatttctagtttctacgtgtgactgaaggttttcctgggataaaagttgaagacaatttctatcttggggcattgcataggagctgctaaatggataatattgggggcactgcatagaaacggcattggataatactctcagtagtaatttcatagagaataaaaaacagaattcgtatgatcttttttttacttgtataaatttaagcaatacaggtgcaattttgctacatagctatactgtgtagtggtgaagtctgggcttttagtgtatctatcgcctgaatcatgtatattgtatccatttagtattttctcatcactcaacctccttccacccttccacccatctcaatctccagtgtttatcataccacactctatgtccatgtgtacacatcatttagctcccacttataagtgagaacatgtgacatttgaccttctgtttttgaattatccacttaagataatggcctccagttccaaccacattgctgcaaaagacatgatttcattcttttctttatagctgaatagtatttcattgtggtatgtgtatacacacacacacacacacacacacaccacgttttctttatccaatcatctgttgatggacatttgggttgattccatatctttgctattgtgaatagtgctgcaataaacaagtgagtgcagatatcttttttatataataatttatttccctttgggtagatacccagttgtggtattgctgaaccacatggtagttctatttctagttctttgagaaatctccatagtgttttccacagaagctgtactagtttacattcccactaataatgtgtaagtattcccttttctctgcatccttgccaacatgttattttttggtgttttaataataggcattctgactgctgtaagataatatctcattgtggttttaacttgcgattctctagtgattagtgatttgagcattttgttttttgtacgcttcttggccatttgtatactgtattagtctgttcttatgctgctaataaagacatacccaagattgggtaatttacaaagaaaaagtggtttaattgactcagttccatatggctggagaggcctcacaatcatggcagaaggcaaaggagaagcaaaggcacatattacatggaggcaggcaagagagtgtgtgcaggggaactcccctttataaaatcatcagatctcataggacttattcagtatcatgagaacagcatgggacaaacctgcccccatgattcaattacctcccaccgggtctctcccatgatatgtggggattattacaatttagggtgagatctgggtggagacacagagccaaaccatatcatataccttcttttgaaaaatgtctattcatgtcctttgcccacttttttggtggggttattttgctgttgttgttgaattgtttgagttccttctaaattctggacattatttccctgtaggatgcatagtttgcaaatattttcacccattctgcagattatctgttcactctattgattatttctcttgctgttcagaagcgttctagtttaattaagtcctgtttgtctatttttgttttggtgcttgtgcttttgatatcttagtcctgagttcttcacctagattaattccagaagcattttccctaggttttcttctagtgtttttgtagttacaggtcttatatgtaagtctttaatctgtcttgagttaacttttgtatttggtgagagatagaggtctagttccattcttctgcatatggcaattcaatttccccagtactgtctattgaaaaggatccatatgactatttcttgtataaatgttgaatgtgaatagagaacatcagatggcaaagctggtatgtggctttaccatctgtaaacagatggtggactgtccatctggtggtctcagagggtggcctcctaggtattcaccttgatgaagttagcagagctgaggccacacttttagacttgtgtgctcacaaacccttggatgcaaattcagagctggatagattcattctattgcaaaccaacatgttgatttattcatctgtgcctagaaatctaaccattctgtaaacttgatgacagcatcctctggccagcatgtttcttcctagttggaggcgtggtgtgtttgatggagcatcaacttagacacagaattagaatcttaactctgcatcttatgaactgggtgtgacattaggtaaattacttaactttccccaagcctcaaatttctcatctgaaatgtggaaataataacgtttctcttataaacttgctgtgaggagtaaataaaatagtgtttatgaattacttagcatagtccctgggcatgtaatttcttagtaagtactaatttttgttggttagatccagttacaggggaagcaaatttacagatatgtggttcatgagcaacagattttctggattattgtcttacacacagtaaccagactgatctttaaaaatcacaaacaagaaacaaatcaaattattcccctgcttaaactctctggaggtttcttattgcacttagaaactcattgtcatgatccctaggccaacacctgtggttcccacccttggctggtgtgcatagaatcttctggagaactttgaaaactactggtgcccaaattgatgcctagagattccgaagagtctggtccatgtggggactgggcactgtgacttttattagctctctagttgtttccagtatgatcttgccctgacccctccctcctgtctgtgtttcttattgggccttctctccttccctgctcctatgactgggacctcccttctaatctttgaatgtgctgagctcttccttcaggaccgaaagcctcttcattactgagccaggtgctaccaccccttctatgtcaagctcacattccatcttcgttatgactctggcctctggtcagaacgtggggtgctctttcccttcaggaagttgggacttggagggctgggacttcaccatcagagtcttttgtgcctggttgtagttggaatctcgtgcattttcatgtagaggttacactgtttgcagggcccatctggtcttcacagtgaagagagaagtcttagctgttcaaaagtcatgttgcttgctattggagcccctgatatgtggcccagattatggtaaggcgagtgagtgaggcattgccttggtcataaattttaaggaggtcccgcaaactcagtagtcaagataaataatattttaatgcaatatttaaacaatcaaaattaatgcaaaaaatccatgatgaaaaaaaaatcagaattcaggtcaattccaggttgatttagtgaataaagagatatcaatagggactgctttatttttttatattttatttacttaatttttttttttttaagatggaagtctcgctctgttgcccaggctggagtgcactggcacaatcttggctcactacaacctccacctcctgggttcaagtgattctcctgcctcagcctcccaagtagctgggattacaactgcctgccacaactcctgaataattttgtatttttaatagggacggggtttcaccatgttggccaggctggtcttgaactcctgagctcaagtaatccacccgccttggcctcccaaagtgctgggattacaggtgtaagccaacacgcccagtcacggactgttttatatttgtggttaagggggatttaagggataatttgagtctgttctgctttcttgggttgtgtttctcaaactggcttatggggatttccagcgatgtaaattttgtgatgaaaatattttatagtaaagcacacatggccatattgtggaaagaaatgccaaaattttatgaaactttaaaataaatcaagctcaactactggagaagctgaggtaggaggatcgcttgagcccgggagttggaggttacagtgagccatgcattcgaaagcagaacagaatcgaattatccctcgaatgcgctacagccacaatataaaacagtcattactgatatctctttattcactagatagatcctgaattgtctcgctctgtctcccaggctggagtgcagtgcgagaccttgtctctaaaacaaataaataaataaatacaaacaaaaacaagctcaagactttgaagaaatgataccccggagctttcagaccagagactcccgagttacacacattttcttctttctgccactaggtggaggcagtggagcaggttgagaatcactgtcataaagcttgtaattaaagaacatcagagtgccagacagtggagctgctataaagtgcagaataactactcctgtcctatacttggtcgcgtatgagcgggaagtgaatggaagggaggctcgaaacaatgggaagagccgtaagaatcaggtctgataaacttacataaacggccttgcacacaacttttctggctgaacctgcacttcccataagtcaaatgcaaatgttggaaggaatatcttgcgaggttctttctagcttgtacagcctgagctattttaaaggagaaaagctgacgagcaatcgtccttggaatttgcagtgcataaacttgaccagcaaagggcagcagtgcacacaccttttaaaaagtaactttccaaattttctactgccatgagagagttctgattctacaaataggagacagtgtttggaccacttaataacaaccaaccataaaagtaaattttctttttattaaaccttttaattttacatttgtaaacagaaaagaaatccttattttgttggctctgggacatcactttcttggttcaactccttcctcctgaccactgcttctaagtctcctgtgctgttttcttctcatctcttcgacctctacttgttgggttacctgccaggtcccagcctgccttcattgatttaactcattgctagtaacctcgccctgtttcccaaatttgcatctccacccggactatttcccgaactccagaatcacgcatattcatccacctgtccaagggatattgccaattagaggtctagcaggcatctcaaatgtctaatatgttcaactctaatccctgattcccgcctgccttccccatctcagaaaatgtccttccaaattctctagttgctcaggttaaacacttgcaaccaccttgatttcacgtttctcccacgcctcacatccaatatgttaacaaattctattttttctacctttgaaacatgaccagaatctgacacttttcaccacagttgccactgagcctcttgactattatcaagaaaggagatgtgttctgttttgtaaagattattaaaagatgttaaattgggactttttttgtatttgttttgtaaggtatctcaaaggccaagaataatataatggatattgtgttctctaatggaacaattcattttctctcctcctccactgcatttttggggatggtggaagtattggaggattttcagaataagaaacaattttattgctgttcaccagatgtcaggagggtatggtgtggtgggcctgggagtggactgtttaaccctagaacttagaaaccagtgtccctgtggagcacaaaccctaataggtcttggtgagtaacagaatagataaaagagagctcagtctggtcataaatcctttggccagttgccattcattgccatgagaaattccccaagaagacacccacctctttttcaggcaattctgtttactagattctggaggattcgttatcatcgaagaaccctgccttctagtcagatggtgcattagtcagaattctttttgcaagtaacataagtcagctgtaacacatacaagtagaaaaggaattagaaaaagaaaagtagttatactaatgtgaaagaaaaaataaacctcaggaccccaaaaatcactaagccaaaagggaaagtcaagctgggaattgcatcaggcaaacctgcctcccattttattcctaaataagatagctacaaagaaaaaaaagctacatacctccctcacaatttgcccacaaggtaattccttgtggacaaagaaaggacagagctcaaagtcatccctctgttcacttcagacaaatgcatatgcaatgcttcttctgccctactgtttcaataagccagactaaggcataaatgactatttctctacctgcctttcacatgtgaaaggctgatcagagactcaaaacaatgcaaccccagcaggaagcccccttccctgccttgagttgtcacacctttccagaccaaagcgatgcacatcttctacatatcgattgatgtttcttgtctccctaaaatgtataacaccaagctgtgccccgacccccttgggcacatatatcaggacctctggagactttatcatgggcttgtccttaatcttgggaaaataaactttctaaattaattgagatctgtctcatactttgagttcacactaggttgttcacaaagacacaaggaaggctatagatccaggatggggctatgcaggtggaaaatgtacctttgatcatgtcaccaaaccagtccagggatacgcccaaaacatgcttggcagcatgaggctgcagtgtgcactgatgacattagtgcttatggacttggtctcactgctagtgagagtcattttcttgattatttttctcaaatttgggtgaggtgaatgtgtagctccacaagatggtgtagagggggcaatgtgaagccatgtaaccttattgaacatctttttggagtgtccattttacttgaatggctcatggaaaaaaattatattaaaatttatacacacataaaaggcacaagttgtagtatttactacgagaagaaaacatgatttaagagataagcttcaaactgcacaaatagcagtaggggagacgaagatagttattcacttccctctgctgcttattgtgaaccatgagaagccccatcttaaagcgtctgaggaagtacatggacttataatagcaaatctatgcatatatcttattttagccttttctgctagactttgggttggagaagtgatgtgagaaggtgtaaagagcacaaaattaggagtcaaaaggcctggttttagcctcagctctgccacgaactaagtgacctgggttaagatatttctatctgtgccctctaagatatttccttacatcaaagaatgcaatagataatttctaaggttctttttggcttttagtctctaggtcattggaatggagacgttaggcgagcattcttctttggagctgtagaacattagtttgatcaccagaaggcacaggatcccatggtgatataggattataggaaatgaacaaaacacagtcttctctcatgcacttctctcacagtcttctctcacttctctctctcttttctgttttgtgtatttatattttccataatagggtaggttataccactgccccaaatctcatggcctagctccaacaaatgcttatatcttgctcatgctacaatcttcaccagggccagaaaggtgctctgctccatgcagccactcaaggatccaggcagacagaggctctaccatcttgtatttgcaccatttggagcacatggcctcttaagttgcttatacagataaaggatagactggaaaattccgtaagatctttttcctgcctcagcctgcaaaggatgtatgtatgcctatttctttggccatagcatttgtaaggagactgggacatataggtgagcaaatggaacatatacaaagtaataatgtctctaagataaatatttacaattcacaaatgtacaaagaattttatagatgcatccataattcacattttgtgtcattatcaccattttctcctaaattacataaaacttattttatttattgacatgtgcttcatatttatcatttatcactgcctgctaattttcatcaggagcatcaatggctattcaatatcctatttatgtaccatagtttataaatgtattgacatttaagtgataatttattatggttttttgctattataacttattgaattgatgaaatgacatacttttattaactgatttttctaatattaatttctagttccatgaggctttccactttggatggtaaaaagggagatagcatttctacttatatgcataaattaattctaggtagtgaattttatttatctgggaataatttttagatatggcaactctcattcattttgacaagaaaaatctaaagctcataaaccctgaatcctatatgcttactctcacaaaaatctctaatgtcctgctgggatttatccacagtttagattagacctggaatacatatggtcatgcaacaatgatcttagaacaggactttaacttggctttaggaactgaggctgagagtaatagaattgatttttttgtgtgtgtgtgaagctcctattataataattagaatactttgattcactcagttaaagttttcccctgatttattgtgtacatacaatgaaggatcaagaaagagaaatttttaaatggaagcattagccagacaagtttgacctcacagttttactaggggatatatcacctagttttggatctatttctaacatcttaacattgtgaaaagagtcttgggaaactggttaaatcccaaagaatgctgcaataggaggttggcccttatgagttatttaatatcttgagctgccttcggaaaatgttgctgagcaggcattgaagagtatcgataaaatttattgagaatttgtttattatgattaacagaggtaaaagccagtatattactgattaatataggtaaaaggcagttaagaaattgggaatgctttctcttctgctttcttctacgatgcacaaggcgtttcacatttatgcccctatgaaaattactaggctgtcctagtcattagatctttcagcagtttgtagttttagagcttctaagttgacttctgtcttttctattcatacaattacacattctgtgatgatatttttggctcttgatttacattgggtactttcacaacccactgctcatgaaatttgcttttgtactcactggttgtttttgcataggcccctccaggccacgaccagctgtttggattttataaacgggccgtttgcattgtgaactgagctacaacaggcaggcaggggcagcaagatggtgttgcagacccaggtcttcatttctctgttgctctggatctctggtgaggaattaaaaagtgccacagtcttttcagagtaatatctgtgtagaaataaaaaaaattaagatatagttggaaataatgactatttccaatatggatccaattatctgctgacttataatactactagaaagcaaatttaaatgacatatttcaattatatctgagacagcgtgtataagtttatgtataatcattgtccattactgactacaggtgcctacggggacatcgtgatgacccagtctccagactccctggctgtgtctctgggcgagagggccaccatcaactgcaagtccagccagagtgttttatacagctccaacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcaatattatagtactcctcccacagtgcttcagcctcgaacacaaacctcctccccatacgctgggccagtaggtctttgctgcagcagctgcttcctctgcacacagcccccaacatgcatgcttcctctgtgtgttggggaggtcactctcttgatttattcgttggagggtttgcagggcccaggattaaattaagagacttgacttttgctggatctctttttgtagaagattattaaagcaaaatgttgtaaagatcccttagagacattgtcaggagtttttgtgttgcaggaacctgcatgtttcacatggacacatcacatgaccgagccaaatagatttatctttactctctagaacagggtccactcagttttacgcacagatgggtcaattctttcctctatgtgcctccttgactctggaaagtttctacttggattcctaattctcttttttctttcttcatctgcaatccttcccaatattaaaccttgatccttcctattcatagcctcccacatagaaggtagtgtccctctgtagctttttccttccagagaccctgtttctttccatcatattaatactttcataggcaattttctaattctttattactctagaaatatgtgacagcatttctcattgccttttacaatagtttgccaactttcttcttatttatcatttttccatttttaattttcatggtatacagtagaaagattatatacacacacacacacacacatatatatatacacatatgtatatatatttatggggtacctgagatgtttagatacaggcatgcaatgtgtaataatcacatcatggagaatggggtctccagccccttaagcatttatcctttgtgttacaaacaatccaattacactcttttagttatttaaaaatgtatagttaagttattattgactaaagtcaccctgttgtactagcaaatagtaggacttattcattctttctaagtattttttgtatggattaactatccccactttccccctactccccacccctgcccactactcttctcagcctctggtcgctatccttctagtctctatgttcataaattctattgttttcatttttagactcttcatatacatgagaataaatgatgtttgtcttcctgtacatggcttatttcactaaacgtaatgacgttcgttagttccatccaaattgttgcaaatgacaggacctcattctattttatggctgaatagtactccattgtgtttatgtactacattttctttttctgttcatctgttgatggacatttaggttgcttccagatcttagctattgcgaacagtgctgcaacaaatatgggagagcagatatctctttgatatactgatttcctttgttttgggtatatacccagcagtggagttgctgaatgatatcgtagctctatttttagctttttgaggaacctccaaactgttctccatagtgggtgtactaatttacattctcaccaacagtgtataagggttcctttttctccacattcttgccagcttttgttatcgcctgtctcttggatataagccattttaactggggcgagatgatatctcattgtagttttgatttgcatttctctaatgatcaatgatgctgagcaccttttaatatgcctgcttgtcatttgtttgtcttcttttgagaaacgtctattcaaatcctgtgcctatttttgattggattattagactttttcctatagagttgttttagctcctcatacatattatggttcttaatctcttgtcagatggatagtttgtaaattttttctcctattctgtggttgcctcttcacttttttgattgcttcctttgctgtatagaagcttttaaacttaatgtgatcccatttgtccatttttgctttgattgcctgtgctagtggggtattactcacgaaatctttgcccagactgatgtcatggagagtttcccaaatgttttcttgtagtagtttcatagtttgaggtcttagatttgtctttaatccattttgatttgctttttctatatggtgagagattgaagtctagtttcattctcttgcatatggatagccaatttccccagcattatttattgaagagattcttttccctagtgtaaattgatgacatctttgttgaaaatgaattgactgcaggtatgtggatttgtattgcagggttctctattctttccattggtctatgtgtctcttttttatgccagtgccaccctgttttggttactatagctctgagtataatttgaagtcaggtaatgcaattctttcagttttgttctttttgcttaagatagctttggctattgtgggtcctttgtggtttaatataaatttaagggttgttttttctatttctgtgagaaatgtcattggcgttttgatagggattgcattgaatctgtagattgctttgggtactatggaaattttaacaatgctgatttttccaatccttaagcatgaaatatctttccattttttggtgtcttcttcaatttctttcattggtattttatagttttcattataaagatctttcacttgtttggttaattcttatgaatttaagtatggttattgtaaatgggattatttttaattttttgtcagagtgttcactgttggcatatagaaatactgttgtttttttgtatgttgattttgtgtcctccaactttactgaactggtttatcagttctaagagttttttagtggagtccttaggtttttcaaaatatgagatcatataatcgcctaacaagaataatttgacttcttccattgaatttttgatctccttaatttctttcttttgtctgattgctctagctaggacttccagtaccatgctgaataagagtggtgaaagtgggcatccttgtcatgttccagatctctcaggaaaggctttcacttttcccccattcagtgtgtctgttatatatagtttttattatgttaagatatgtttcttctacatccagtttattaagtggtttttatttatttatttatttttgtttgtttgttttttacacatcacttcttttggccattcctagctccaagagggtctgtgttgatgttgttattgttttctaataaggaaaaagaggaaaactgaggttaggagacaagtagccacctgtgtacagggtcagacataaagtcaaatgatcactgatggagctctggtgataggcctctcttaaaaatcaccaaacttaatgcaaaatcctaaggactccatacctaaaaccccctaaaatgagatcagtgaaaatgagcagtgggcaaaattgggacccatgagaatgtatccagtaggatcatgatcagtcaagcaaatgggtttaacttggctttcctggtttattattatttatttcctggtttattattattatactttaagttctgggatacatgtgcagaacgtgcaggtttgttacataggtatacacatgccatggtggtttgctgcacccatcaactgatcatctacattaggtatttctcctaatgctatccctcccctagcccccgctctccccccgcaggccctgatgtgtgatgctcccctacctgtgtccatgtgttttcattgttcaactcctacttataagtgagaacatgcagtgtttggttttctgttcctgtgttagtttgctgagaatgatggtttccagcttcatccatgtccctgcaaaggacatgaactcatccctttttatggctgcatagtattccatggtatatatgtgccacattttctttatccagtctatcattgctgggcatttgggttggttctaagtctttgctattgtgaatggtgctgcaataaacatacgtgtgcatgtgttttatagtagaatgacttataattctttgggtatatacccagtaatgggattgctgggtgaaatggtatttcttgttctagatccttgaggaattgccacactgtcttctttggtacgtgtaaattgttgaactaatttacacgtaccaaaacagatatatagaccaatggaacagaacagtggcctcagaaataatgccacacatccacaaccatctgatatttgacaaacttgacaaaaacaagcaatgaagaaaggattccctatttaataaatggtgttgggaaaactggctagccatatgcagaaaactgaaactggatcccttccttacaccttatacaaaaattaactcaaggtagattgaagacttaaatgtttaagatctaaaaccataaaaaccctagaagaaaatgtaggcaataccattcaggacataggcatgagcaaagacttcttaagcatttttttgatagagtagcacagataagtatctgtctgttttttttttccaactgtatttccttctgctctatttttttctgtctctgcaacttcaaatatttgtaaattaattattgagaaaataataatagtaataataataattattattatttgagacagggtctcactcagtcacctaggctggagtgcagtggtgcaatctcagttcactgcaacttctgactcatgggttcaagcaattctcctgcctcatcctcctgagtagctaggtctacaggtgtacaccaccaagcctggctaatttttgtatttttagtagagacagagttttaccatgttggccaggctggtctgaaactcctgacctcaagtgatccgcccaccttggcctcccaaagtgctaggattacaggcatgagccaccgcaccctgctgagataatgattttttaatcaaataactaagttttctttctgttctctatatattgatgtatgttgtatattgtcattgaaattttgattatactcaccatgggatatcttactttggaataggtggcatctcaaatacaatttatttcctttggcagaaggggattattttgttgtgaattcaaaccttcattaacttcagtgtaacataataccataagtgatgtttcctgttattaaatcacaaacagtattaggaatgagaggctgaagcaggagaatggcttgagctcacagatttgaggccagtttgagtgacatagtgagaccccttgtgaaaaaaaagagaaaattttaaatgcggtatatttaaaacacatatttctagacatttattactggtatatggaaatcatgtttattatctaatatcataaactctgacatgatcactatcatttctttagtttttaataaattttcagcatttgtgtatgtcatatgtatttattgattgacatagaccttaatgtcttataatataatacagaagtggacatgagcatattataatttaattaaaaaaatgaaagaatttccacttagaagaccaccatagctgttgctataaatgcagaaataaacacaaacttaactaaaaattcatgtgtatgatgacatcggagagctacagaagacacaaaggttagatgacctaaaattctagagaagaaatagacctctgtaggtgaggtaaatctgagctctcatttagttctttttttgtgtgtgtggtttccatggaatctatttaatcaaaactgcagaaggttctagaaaaacacatttttaaccaaggactgccgatgattctaagttttgagtaaaactgtggttgggggaaacaattttctgctttattgtgtgtccgagtacatacatgataaaagtaaaagccagggaatggaataaaacatagctttatataatatattagtagatacctaaatacaatatggtcttaaaaatgaagtcatatgtatatagttgtattcctaagtatgttagtcccccctcatccacaaatctcctttctgtggcttcagttacttatagtcaaccacagtctaaaacacatgagtactgtaaaagaagatattttgagagcgagagggaccaaccaaattcacataacttttcatattagatcttagtgatgcaaattagatcttactcatacaaatgagacattgaattaagtctttctctcagtctgacccttagaattgtcttttgtaagattttaaaatgcatcaagtaatacttacatatgtaacagctgacccctgagccatcactgacacagatggtaccaggactgctgtgcacagacaggctttcgactctgagtagtagacacaagtttgctgtatttgcagcctccacttgagggcttgggggttccctggcctggctacactgatagcacaactggctttgactctatccccaattccccttcctccctatcccctatgcaaatcccagtaattctccaggtgatatcctggggatttccttgggatattcttggtcttcatcctgccttagagaaaactgatcctcagaggcctcacctgatccagagttttaggtttatcctgacccagactctaattccagggttatcctcttgagttggaggaagaaatggtgatttttaaaagataatcatctataggatcagtagtcagaggcttcatgctgatgagctgtaggaaataagatcaaatggcagcaaaagggtggaatacggaagtttccaaaataataataaggtatagcccatttggttcactggaaattaaagagacccatggccttgaacaatgatgtatgtgtgagttacacacccttcaaagaaacatggtgttatctttgtgtgtctgcactgaatagcttggtcatataacggtaataagaatggcagcaaaatgcccagtcatcgcccaatgggctcatgaacaaagtgatcgcagtggcaggaatggagcttatgcatggcctcagtaaaatggactttcactccctacagctgatctggctgtggccacagctgagtgtccaatctgtcagatgcagagacctacactaattctctaatatggcaccattcccctgggtgacaagcagctacgtggtggcaggttgattacattagaccacttccatcatgtaagaaacagcatttcattcctactaaaatagatgcctactctggatatgaatttaccttccctgaacacagtgcttttgcctgaactatgatccataaacgtacagaaagccaatagtcctaagcaagtttatattctctggacacagtttttagctgctgcaatcaaacatgatttaattaacttaccatgggtaagtggcttctcttccttagctaacaaatgtgccactcaaaaacttagttttgcggcagcctcattttcattttttaattttgtgaataaattctgttatgaacagctattgtgttttaaatttttctaatttttacaaatcatgaataggtattggattttgacaaatgctttttctgcacgtaatgatataatcatatgaaatttctttcctctcaatctgtgtatctttaatttccattatttgtcttattatattggcagaacttgtagtactctgtggaaaaggaagtaagagggaacatcctttccacatcttagcaggaaagcttctaatttctcaccattaaatatggtgttacatgcagatttttgtagatggacttcatgacttgcatctacaagaggaagttctcttctattcttagtttactgagagttttttctttataattaatgagtatgggatttctttaaattctttttctgcgtttattgatatgattatgtatttcttcttaatctgttaatatgatggattacattaattggtttactaatattgaaccagccttgcagatgtggaataaatcccaattgcttatagtatataattctttttagatattgttgggttcgatttactaatattttattgaggaatattgcatctattttcatgagcaatattggtctgtagatttttttagtaatttcttttttttggtttggcattctgattatgccagtctcatagaaacaggaagtattctctcttgcttttctcttctggaatatattgtagagaagtggtataatttcttccttaaatattagatagaattcacccataaatccatctaggcctggtgttttctgttttgaaagcttattaattattgattctacttcttcaatagatacaggtcttttctgattttactatttcttcagtgtgagcttttgtagattgcatttttcaaaaagttggtttatttcatctaggttatcaagtaagtgggcacaaagttatctatagtattcttttactatttttttttagcatacataaaatctataatgatgtcctctttttaattccttgatacttttccttgctctgaagtctggtctgtctgaaattattctggttttcttttgataagtgttagcatggtatatctttctccatccctttacttttaatctatatgtctttatatttacaatggatttcttgtagactacatatagttgggtgttttttataatgtggctgacaatctcttttaattggtgtaacaatccactgatgtctaaagtgattattagtacatttggattgatgaataatgtttgttatttcatatttggtgctctggttctttttgctcatttgtctccacactttttttctgtcttttgtgatttcaattgagcattttgtatgattccattttctttcttttcttagcatatcagtgatggtgatctttttttttgtttttgttttttactttttaagtagttgtactagggattgcaataaatgtacaattaatccaagtcaggttttatttacttttttatgctaatttttttattagaatgaaagctataaataaacacattacatagagaaaacttttaatatatattcctatgtgtagattatacaagtgatgtttgcatacattcttgttattaagaaactacaatgaagtatttagattaaaaagtaaaagtcactcttcatacaccactagtggtctttctactgttccagtgatttaataaaataatttttaattgtttttccaaaatattttattattaaataataatttttcatatttatggggtacctgtgatattttgatatatgtgtgtgtgataaacaaatcaaatgtgtaataaacaaatcaagatatttaagacatccatcacttcaaacattcataatttctatgtgttgagaatattcaaaatcttctcttttagctacttttaaatgtacaatgttattgatagctattgtcaccctatgatgctatcaaaaacttatgccttttctctaactgcatgtctgtacccatcaaccaacctctctttattccccccttcccagcttctggtaactattctactctctagctccataagatccactactttagctcttacatatgagtgagaacatgaaatatttggctttctgtgtctggcttatttctaagtgcacttttaattaacattaaatgtttcatgggtagtgcaaatatgttatgataatagtagctattaatcaaaattctatgtattactgctgttatataattgtgtggcttaataaatcgaaattaaattgaagtataattaattttaactctccagcctgagtattaaaacaggaactactgatgcttaggcagtaagcactgtgagtaaatcattacaaaataaaagcatactcataaacattgtaacaaaacatatcaaggagttattataattctcccaagagtttagaatctccatgtttgaaaattgctgtaataatgcaaagcaattttccacagtattagaagtaaaaactaagtttaaatattgttatatttgatagaaaagaacattattctcatatgaagattcaaattatcaattattattgagaaaaacaatttaaaaattattttttccttgtaatggaggatccagtgatatgatagaatgcataagcagacattttgaattatatgaaagctgatcttgctattcatgttactattatattttcaaagtaataaaatatttttgagaaaattctcttcctgttttaagaagcagccctgcatttttattttgcactggggctcacaaattatgttgttggttctgttttccagtaatacatatcagataccagcaatgctgaagtttggaaactttctagaatgctttttgtttcattaggaagagtcctccacctccatgattccctttgccttctagaagaataaaatgggaaaaacagaattttattattaaaaaaaaaaacccagaagagtaacatcactttccactcaaactgactacactaatctaatttctcattctttatctcttttacactaaggtatacctgtaattttcagagttccattttcaaagactgcttatagtttttaaaaatgtgcatttatggtatagaaagaaaatcattttacgactaccaggttccactgaaaagtaattaatatactgtagtcaaaataaaataaaaattttaatacatgaaaacaactaccgaaatgttatgaaattatagtttagtagaactaacaagtgcattaatgcaaaagaaaagtagggctcagtaatcagggaaccaagtgtgcattgtaaaagtgcagcctctctaacactgggtttcatcacaagtaacagaacaggatgcctgatgcagggaaaaaagaaaggcaattgttggcaatgtcaggaatattgccatggcgtctaccactggtgggttactgagcatcagaaccacagaagaggtaacactgaagcctgcagaataatgagtcttgttgcagaaatgcaaagaaaaagaaagatgataaatgcacacccaggaggttacgttaattttaaccttctgagtgtgcacagctgtgaagataaaactatgcacagctcatgggttaggtttcacacagtctgccatttaaacactccctatgtcaccatcatgtaccatataatttgcatatttgtcctttatataaccctataatatgtttgtggccataaaatctgtgctgtcaaactgattaggaactgactaccacctgcaggtcagggccaaggttatggggtcccaggttcacctcctcagcttcctcctcctttggatctctggtaagagaaacacttcctctcctctgtgccaccaagtcccctgcatatccacaaaaataatatattttcataaggaattgattttcctcattctctgcaaatatgatgcatttgatttatgttttttactttgctccataatcagataccagggcagaaacgacactcacgcagtctccagcattcatgtcagcgactccaggagacaaagtcaacatctcctgcaaagccagccaagacattgatgatgatatgaactggtaccaacagaaaccaggagaagctgctattttcattattcaagaagctactactctcgttcctggaatcccacctcgattcagtggcagcgggtatggaacagattttaccctcacaattaataacatagaatctgaggatgctgcatattacttctgtctacaacatgataatttccctctcacagtgatacaccctgttacaaaaacctccaagttctctcagtgggattgcctcagctgctgctgaaaatgttcagaatgtggaactgggtggccctgtggtgtttataaggcttctccatgcccatgcaactcacttcctttttctttttgtttctgtagtttctgctgcccccatgctgtgcctgacacacttgatatggcaaaaaccaggacagcctttctcacgttgtccagctgtgccaacaatttcacttccaagcagaggtaaattctcatggccaactccctgtcttttgccacactcatcatttccacctccaagaaaaacaaaaccaaaaaccaaaatgcatctagcttagattccaaatagtagcattaaaggaaattgtccctccctataagcattctcaccctcatccacacagtcatcgtgactcttccctaacccactgagtgctcaccagtcctcttcagtcctccctccagtgatggggaaaagcgagtgatagttatgagagcaacatgtaacctgggtgcagactcttactagtcaggtttgcctcagatttcaagtatttatctttcttttattttccattttttttcttaattatatggatcagtaagatgtctcatttcttttttttaagttacttgttcttttaacacaattcaattctataattccaaatttaaagagataccctgtatgtctttggcatgtgttatatctggacaagttttgggttatccccttcatgccactgctcaaatcttacctgaaaccccacatatttttccaaaaacctgaaaactgtgtagcggttgaggaaattaaatttggcaaatcacaatacttgaggaaacatgtatctttttatcttcactctctaatgttcaggtgatgctgtttaattgagcatttgctatttagaatcacccctctgaaacttgtgggaaaacagcaccagcaaggcagtcttcatgttttgacctcattattcctggattatgctagccttcttgctattgttctactacagccactacctgaagaaacctcatgtaggattgtttcctaatgaaatattaagatttatctgcaattatccctaactctgcaaacttaactgacttctcaggttagtatttaatagccatcaaataaggagtggctgaaataatattaccaaggaaggaaataattggatcatagaaatgagggctttgtggttattgcatggtgaagaccaacaaaggccattgcaaccagtaataatatgcacaatgatgagctcgtagttaagagcaatttctgtcttagttttactgtcactgaactgggctggaaccctggagggcagggtagatgaatgataatcaaaaacatgatttcatatgttaagttctttggaaggctcaatttcggagatttctcccactttctataagagcagacatcaaagaatctgattctggaatctcgttttttctcttacagctctctttttttctactctaatctcttttccgcttccaaggacatacattgataaatatggtcaacagaatattaaggtgatgtcaatattagtgactaccctataagagggaacagaaacattcgtgtttgtaagcttttagtcctcacttaagcttctttcttgagtaatgtaatcgctccccttaatgtctggagcagacattagtaagaataataaatagtatgtttagtctcaaagatggtgaatacagaaagtggtcagaatgtgaacaacactattaagtatttagctaaaaataaaactattgagttttgtaaattcttatcaagtcttctctaagattgaagctccaggttttagtgaaaatcctgtccaggaaatattacattataatccctttctctctgttcccatctaccttaggctcatagtgacatgaaagcaaatttccatcctctgggaatatataaacccggattatttctttttatatagatgctctatcccttgcctgtgtgctattttcttactgagtcactaccttgcaccatgtacacaacccccagtggtttatgataggatgaacctattgaagcagctagcagagaaaaggttatttatgtgggtaactgtgtatgcttgttggacattccctgggtctctcacactgttaccacagcagcattataaaaacatcatctatctatctctctatctatcaattgatctatctgtcaatctatctattgtctatctccataaacacacaaacatactcacatttgtgtgtgtgtgtgtgtgtgtgtgtgtatgtatacagaagaaatgataaaagttatatatgtcttatgtcccaaactttagaaaggatatgtaacatgttagcaatctttgaacacacttgctggaatatagagtaaaatactttgttgctggtatatcaaactgtagtagataatccttctgatttccaaacagggtatacaaatgcacctttccaccagcaatgtatgagggtttctattgttctacatgtccaccaatacttggtattgtaaaactttttaatttaagcctttcttctacatgtgtagtagtatcactccataattacgatctgtgtttgtgggattatatatggattatatatgcttgtagggcatttgaccatcctctgggttaaaatttctgtcaaattctgcccattttactaatgcattttctgatttagttgaacagatatgtatgaaaatatatatataacatatgcgtgatatatatcagcgtgtatctgcctatcatccatccatctatctatccatcaatctgaatgtttgtgctctgccaaaattcatatgttgaaatcttaatctcaatatgttgatcaagattgagccttggcaggtaattaggctgttagggtaaagccctcatgaatggaattaatgtctttataagaagaagtgaagagaccagagggctagctagctctctgctcttagccacatgaggatgcaaggagaaggtcctctacaaacctggagtcgggcttcactatacaccagattggctggcaccttgatcttgaacttctcagcttccagaattgaaaaagtttctgctgtttaaccctgtccatcccccagtttatggtagtctgatatagcagcctgaactaacatctgtatctatatttatacaattatagatatagatagaaccagtattttttcgcatttgtctctgtctctggtttacctttttactcacttaagtctgtaaatggaatcattttcttaatttgtttttcagattgtttattgttattgtagaaatgcaacttttttattttctttcctgaaactatatttaatttatttattagttctaatattttttgataagttttttaaaaaaatttattttgttttaagttccaggatatatgtatggatgtacaggatgtgcaggtttgctacataggtaaacgtgtgccacggtggtttgctgcacctatcaacccatcacctaggtattaagccttatgtacataagctatttatcatgatgctcttcccctatcccccagtgtgtgttgtccctccctgtgtccatgcattctcattgtttagctcccacttgtaagtgaggacatgagatgtttggttttctgttcctgtgttagtttgctgaagacaatggcttccagctccatccatttccatgcaaaggacatgatctcattactttttatggctgtataatattccatcgtatatgtaccacgttttctttatccaatctatcattgatgggcatttgggtggattccatgtctttgctattatgaatagtgctgcaatgaatgtacataagcatgtatctttgtaatatgatgatttacattcctttgggtatatacccagtaattggattgctgggccaaatggtatttctggttctaggtctttgaggaattgccacactgtcttccacaatggtggaactaatttatattccaacagtttaaaagtgtttctatttctccacagcgtcaccagtgtctgctgtttcttgactttttaataattgccattctgactatcatgagatggtatctcactggggttttgatttgcatttatctaatgatcagtgatgttgggcttttcttcatatattttttggccacatatattttgagaagtgtctgttcctgtcatttgtccacttttaatggagttgtttgtttttttcttgtaaatttgtttaaattcctggtagattctggatattagacctttgtcagatggatagagtgcaaacattttctcccattctgtagttgtctgttcagtctgatgatagtttcttttgctgtacagaagctctttagtttaattaagtcacatttgtcaatttttgcttttgtttcaattgctttcgatgtttttgtcatgaaatatttttatctgggtatgctgaagaatagttttcctaaaagttatatattaataaacaaagagttagtgagagcactagaatcagagaatatatgtaagagtttgttcaaagcagggtcttaaattttagtctcattgcaaatttggattctattcctcttgaatggactactgaagagatataaagaccatgaggaagcacgaaaatatctgctttgctgcctcaaggatgtttaattgccccattgattctcttgggaaagaattctcccattgttgctcactgattctcaaagattagaagtaaaaataacttaggggatttgtgactaaagttcccatgcctagagatactgacctcctacgtggtgttgagtttaccttaattcttgaaggatgcttaactttgaagggaactctagctatatggctactttttcttatcattttaaggaaattttatggtctctgcttttcctgatttatgtttagaggttagctattaatcttattcttgtttcttcaaaatgagagaattttttctgattaagatttttttgtttgatcagtagatagtaaagtgtgacattatttatacaacgtaacactacacaacaaaaaagattaataaattgcaacaacttgaatttttacagtaaaattaaaatgacacatatctattacctaaaacacatctgagaagctaatttatagaaatagaagtatgcatgtgtaaagatataggtaaaattgtattaacaaatccattgattatattagcaaaacctgaacataatttaattgcccttcagtagaaatgtttgaataaagtataggttttctacacaatccaaaatgtgatgataaagaataggttatatttttcatctcttgatctggagataatctctttagaaatgttaaacataaattcccaaaaatgttaatttatgagccaatatttgaaaacatagaagcagaattatgaaaagtagtaatttgtcttttctatctttacaaatatggaatcattttacatcttgtggggttacaatgaagaaaaaaagcagttatgacaatgggaaaaatgtatgcgtaacatacagcaatgttcacagagatgaatgaagttatagtgacaaatgaaaaatgtaaaaggcaatttgatttatattgaatatatatatgtcaggaatatggaatgagaggagacaggtaaacacaataaaaactctgaccaatgcctgaaataaggatattacagaaataaaacaatgctatttaaacatctaaaaacagcataataatcaccagaattaaaaaagatcctgtagatgtgtgttcattcatagaaagatggaagtccctacattattattaatattttcaccatcagagaaatagggtgctactcagaaaaatattttttaaacaattgacctaaatcatatcaagtaatgagatatttcttgagtccaggcatgatcatgtaaatgcatgttggttaaatccttggacttgtaatgcacattacaactttcagaactcctctctgtttagcatttataggagaccttctgactacatcaaacttcatctaatcacattttacctgcactgagaacttttggtgggaagtgagatggaacgccatagtgtcattgcatattcagaccccaagagggagctgagagatcatgccttgaggaagtgattctgaaagagtccccacagtggaggattccagagctctgtgtgataacattgcctatccactgacccacgccctccccaaatgtgcaaagaaagtccagctgccagaagcccttatcagtgtgcagattccccataatcaacactcctttgcatccaccatatctgtaggggaagtgcagttccaggctcagctcctcaggtgtcttctacccaggtgaaagtccaaggtagatcagtcacaaaatcagtgcaattttaaaattgctttattaaagtacagtgtcaaaccatgaaaagcacctattttaagtgtgcaaatcactgacttatggtaaatttgcaaagttgcagataaccacagtttaatcttacaacattttaatcatcccctgaaggatcccttatgcagaccggcagctatttttatttccactcccagtctcaggcatgtattaatcgactttccctctattgattgcttgatatgaacattctatataaatggaataatgcatgcatggtcgtttctatctggtttctttccattaaacgaagtttaggttcatccctgttttagcatgtatcagtaggccattcctttttatttttggatagtattccgctgtacggatatatcacattttatttatctattcacaggttgaggaacattgaggtcctttgcactttttggttatatgatgatcaacaatgctgctatgaatatttgcctgtaagtctttgtgtggacaccggttttgatttttctcagacagacctctacaagtggaaatgctgagccatatgataaatttctgtttattttttaaaaactgccaaactgttttcaagagtgtgcagcatttaacacttgcaccaacagtgtatgaagccttcttttctgtcacattctcaccaacttttgttattgtctgttttttaaattattaaaatcattatagtgtatatggaatggtgcctattgtgaatttaatttgatttttgttaatgactaataatgttgagcaccttttcatgtgattactgtctgttcatatatcttcttccataacatctatactaaaatattttgttcatttttaaattgggttgtcttatgacttatatattctggaaatatggcgtgtatcagataaatggtttataaataatttctctggtctgtggtttgtcttttcattttcttaatggtatcctttgaaatgcaaatgttttgaacattaatgaaacctaatatattagcattttctttcataagttgagcttttgatgttgtaactaagaaatatttggtgaacccagaaatggaaaagttttaacctaaagtttttataatttcagattttaggaatgggcagaagctggaaacattccccttaaaaactgacacaagacaaggatgtcatctctcaccactccttttcaactgagtattggaagttctggccagggcaatcaggcaagaaaaagaaataaagtgcattcaaataggaagaaaggaagtcaaactatccctgtttgcagatgacatgatcctatatcttgaaaaccccatcatttcagccccaaagctttttaagctggataagcaactacggcaaagtctcaggatacaaaattaatgtgcaaaaatcactagcattcctatacaccattcatacattcctatacaccattcatacattcatacagcattcctatacaccaacaacagttattccgagagccaaatcacgaactcccattcacaattggcacagaaagaataaaatacctagaaatacagctgacaagggaagtgaaagatctctacaaggagaactacaaaccactactcaaagaaatcagaaacaacacagacaaatggaaaaacattccatattcactgataggagtaatcagtaacattaaatggtggctatactgtccaaagcaatttatagattcaatgctattcccattaaagtaccactgacattcttcataaaactagaaaaaaacaattttaaagttcatacggaacaacaacaacaaaaaagtcctgaataaccaaggcaatcgtaagcaaaaagaacaaagctggaggcatcacactacccaatttcaaattatgctacagggctacagttatcaaaaccacatggtactggtacaagaacagacacatagaccaatggaatagaatagagagcccagaaatatgtcctcacacctataaccatctgatctgtaataaagttaacaaaaacaaaaaatggggaaaggacttcctattcaataaatggtgctgggataactggctagccatgtgcagaagattgaaactggacgcctttccttaagccagatacaaaaatcaactcaagatggataaagtatttaaatttaaaacccaaaactataaaaaccctgaaagacaacctaggcaataccattcaggacacaggcacaggcaaagatttcatgacgaagatgccaaaagcaattgcaaccaaagcaaaaattgacaaatgggatctaattaaactaaagagcttctgcacaccaaaagaacctatcaacagaatgaatagatccctacagaatgagagaaaaatttttcaagctatgcatctgacaaaggtctaatatgcagcatctataaggaacttaaacaaatttacaagaaaacaatcaaccccattaaaaagtgggcaaaggatgtgaacagacacttctcaaaagaagacatacaagcagtcaatagtcatatgaaaaaaagctcaacatcactgatcattagagaaatgcaaatgaaaaccacaatgagataccatcgcacactagtcagaatggctgttatcaaaaagacaaaaaataacagatgctgatgaggttgtggagaaaaaggaatgcttatacaccattgatgggagtgtgaattagttcaaccattgtagaagagagtgtggtggttcctcaaagacttaaagtcagaaatacaatttgacccagcaatcccattactgggtatatactcaaaggaatgtaaatcattctattctaaaggctcatgtatgagtactttcattgcagcaccattcgcaatagcaaagacattgaatcaacccaaatgcccatcaatgatagactggataaagaaaatgtggtacatacacaccataggatactatgcaagcataaaaatggacgagatcatgtcctttgcagggacatggatggagctggaggccattatcttctgcaaactaacacaggaacagaaaaacaaacactgcatgttctcacttataaatgagagttaatgatgagaacacatggacacacaagggggaaaaacacacacttgggcctataggagggtggagggtgggagaagggagagaatcaggaaagataactaatggatactaggcttaatacctgggtgatgaaataatctgtacatcaaacccccatgacacatgtatacctatgtaacaaacctgaacatcctgcatatgcacccttgaacttaaaagttaaaaaataaaataagatctctgatctattttgatctagtgtgcatggcaagagatcagggcctaaattcgtcttttcacctatagataccaattgaaaatctatccttcctcccatttaatttcctaggcattattttaaaaaataacttaccaaaaatgtaaaggtttatttctagattctcaattccatcctactgatctataagttcatttttgtgccagcaccatcttgtcctggaaactgtagtttatagttgttctctgctttatagtataggcgatccttggacaacactgatataagctgtgcaggttcactcatacatggattttctgccacatctgaaataacaagaccaatctctcctctccctcctcctcagcctactcaatgtgaatacgataaggatgaagacatttataatgatccattttcacttaatgactagtaaacatatgttctcttctttataattttcttaaaaacattttcttttctctacattacttgattgtaaaatacagtatataatacatataacagtcaaaatatgagctaatcagctgtttatacaattggtaaggcctccagtctacaacaggctatcagtagttagatttttggggattcaaacattatacatacattttctattgtgcacggcgtctgtgcccttaactcccacattgttagagggtcaactgtacattttgaaactggaaattttatgccctccaacttcaattttcttgaaaaattgttttggttatttgaagtcttctgaattttcatataaattttagaatcagttcaccaaattctatagcctactgggattttgactcaaattgtgttgaatctgtagatcacactggagagaattatcatcttaataatactgaatcttccagtccatgaacatgaaatgtctcttcacttatttggatcttctttaatgtctctcagtaatgttttatagttttcagcatatctcttacttttttgttaaatatattcagaagtattttcttcttatcaatgtttgttcattgtctttatgctttattttcaagttagtgatccacagtagtcaatcttatttgtgtattctgtatttgtgaatttgcctgcctgctaaaatttaatacaatcccaaagtcaatacatagagtgcttttattctcatttgtggacatgcacagagtggcaaaaaaattgagccactgaacactcatgttcccaactgaggtttaacaaagccacactcttccatcttgtttcacttctcatactgtaaacaagtgtccttttgctcaattttgctctttatgttggtaattttgtggttataaatgttccccaaatataataatgctgaattgctgtttaatgttcctaagcacaagtctgccatgtgtcttacgaagaaaatatgtgtgttagataagctttgttcaggcacaagtcatagtgcttttggccatgagttcaatgttaataaatcgtgtgtgtatgtgtgtgtgtgtatgtgtgtgtgtataggaaaatgccttgttttattgcacttcactttgttgctctttgaagatactgttttttacaaattgaaggtttgtaacagccttgggttaagcaggtctatcatcaccattttcccaaaagaatatgttcactttgtgtctctgtatcacgttttgctaattttcacaatattttaaatttttcattattatatctgttagggtgatctgtatttagtgatctttgatgttactattataattgctttggggaaccacaaaacacacaaaccacacttactcgataaatgtatgtgtggtgactgctccagtaactggccgttccttgttttcctcttgtcgggcctccctatttcctgagacacgataatatgaagattaggctaattaagaactttataatgatctgtaagtgttaaagtgaaagaaagtcacatgtctctcactatcaatcaaaagctaggaatgattaggcttagtgagcaaagcatgtcaaaagcttagatagaccaaaagctagacctctcgccccagttagccaagttgtgaatgcgaagaaaaagttcttgaagaaagttaacagtgctactccagtgaacacatcacaaatgtctaaaaagcaacatagccttattgctgatatggagacagttttagtgatctggatagaagctcaaaccagccacaacattcccttaatccaaagcctaatccagaggaaggcccaaactcatagaatttatgaaggctgaaagagatgaggaagctgcggaagaaaactttgaagcagcagaagttggttcatgatgtttaaagaaaaaaagccatctccatgacatacaagtggaaggtgaagcagcaaagtgctgatggagaacctgcagcaagttatctagaagatctagctagaagtattaatgaaagtggctacacttaacaacagattttcaatgtagatgaaacagtcttatgttggaagatgatgccatctaagactttcatagctagagaggttcctggcttaaaagtttccaaggacaggcagactctgttattaagataatgcagctgatgacctatgttaagtcgaagccaatgctcatttaccattctgaaaatcctagggcccttaagaattatactaagtctatttttcctgtgctgtatacatggaaccacaaaacctagatgacagcacatccgtttagagcatggtttaccaaatatttgttgagacctactgctcagtaaaaaaagatttctttcaaatattactgctcattgatttacaatgcacctagtcactgaagggctctgaaggagatacacaaggagatgaatgttgttttcatgcctgctaacacaacattaattcttcagctcatgcatcaaagagtaattttgacttccaagctttattgcttaaaaaatacatttcataaggctagaactgctgtagatagtgattcctctgatagatctgggcgaagtaaattaaaaaccttctggaaaggagtcactattttagatgccattaagaaaatttgtgattcatgggagctggccaaaagatcagtattaacagaagtttgaaaaaagttgattccaaccctcatggatgatttcgaggggttcaagacttcagtggagtaagtaaatgaagatgtgtaaaattaaaagagaactagaattagaagtataactatgtaacaaacctgcatgttctgcacatgtgtcccatttttaagaagaaataaagaaaaagaaaagaagcggagcttgaagatgtaactgaattgctgcaatatgacagtaaaacattaatggatgaggagttacttcatacggatgagcaaataaaatagtttcttgagatggaatctactgctgtgaagatgctgtgagcaaggttacaatgacaacaaaggatttataatagtataaaaaaatttagttgataaagcagcagtagggctcgaggattgactccaattttgaaggaagtactactatgggtaaagtgctatcaaaaagtatgtcatgctacagagaaacctttaattaaaggaagattcaatcaatgcggaaaactttattgctgtcttattttaagaaattgccacaatctccccaactatcaacaaccaccaccctaatcagccagtagccaacagcattgagataaaattctcaaccagcaaaaagattactcactgaaggctcagatgattattaccattttttagtaatgaagtattttaaatgatgtacattgtttttaaaacgtaatgctattgcacacttaatagactacagtatagtataaacataacttttatatatatgcagaaacccaaaagtttgtgtgattcactttattgtgatatttgctttattgcagtggtctggaaccaaatctacaggtatgcctatatgtatatgcctatatttaagactttatgagatatatataatctgtttaagatactcatacaaaaagttacctattgatcagttaatgaaaatgtgaccataggctcataggaacataaaccagtactaccactaggaccaatggttcaatatttgttaattcagcgtttgtgactttacagatatctgttgaaacataacaaaatgtaactgtacatggagataaaatttatttctgcatattgcatatcttattgtgtgactttgccaaagttgtttattactagtagattgtatgtgtagtggtgggggacatgtattccttatcatttaatatacatacaggattatattttctgtaattaaaatacttttactcttcttttaaatattgatatactttatttttcatttttttcttgcttgattgcttgacaagaacatccagtgcagtgttgaattgagtagcaagagtgaatatccttgtcttgtttatgacattagaaagaaggcattctgtcaactttaagtagatgttaactgtaagtttttcatatatatcctttataaggtaaaggaagtttccttctattacaagtttgttgagagcttttgtcataaaagagttttgaattttatcaaatatctttctccgtttattgagatgattacattttttatatttactctatgtggcatattactttattgattttcagatgttaatctatcttgcattgtttaataaatcccatttgtattatggtgcataatcatttctatatgctactggattctatttagttatatcttttgataattttttcacatgcattagtaggggatattggtctatggttttctttccttggaatgtctttgcttggctttggtattggggtaacactggcttcatagaatgagttgggaagtattcttttctcctatgtatactgaaagaatttaatgaagattggtaatatttattctttaaattcttgatagaactcaccagtgacgccatgtagtctcagtttttctttattggaaactttttaatttcttcacttgttatggttctattcatattttctatttgtttttgaattagttttgggttatctcatctaaattgcctaatttaatgacttattattgttcatcatattctcttacagtatttttaaagtttctgtaggataggcagttgtaccccttatttcaatcctgattttaataatcttggccttctctttttttcttcaagagtcataaagatttttaattttgccaatctttccagaaacacaacttttgctttcaatgattttcgtcttttacttcattgatttatactctatttttaaaattattttcttccttctgcttgctgtgaatctcgctggttcttctttttctagtctcttaaaatagaaactaccccattggtttttagatattctttctttctttactatacaggtaattacaggccaatatttataaaattatttatttatttcaaatcttccactctatagatgaaaccttcaccacttcgtcactcaggaagcaacaggagaaacatgagaagctgggatgaaaacaccattttgaggaatctgtttgtctgatgctggtcagaacctattaccagaggaagcttccttatttaatccccttaggacaggggccatttgagagaaagagaataaaaacaaacaaaacacttaggcaatatgacagttttagtggacaaccctaggttggccccatgatacagaaccactggtgttcctaactgtgtaattccctcttcttgagtctgggcagaatttttgacttccttctagcatacacaatattgcaaaggtgaaagtattttgcagatgcagtagtcccaaatcagttgggtttgagttaatcataagggagattattgtgagtggatctgacttaagcaggtcaaagccattaaaagaggaactgagctctccttgttaccaagaaattatcctagctggtttgattattagtagcccatgtggcaggaaacttaagatgttctctaggagcttagggtgatctccagccaacagccagcaaaaagccaggaccctcagccttagagttactatgaaaacaattctgtcaacaacttgaatgatcatggaagcagactctttaagtccctggatgagaatgcagcctggtcaacaccttgactgcagcctgtgagaccttgaagagaggacccagataaactctgcccaggctcccgactcatagaaactgcatgtgaattataaacgtgtattattttaagccactaagtgtgtgataatttgcatgggccaacagccaactaataataaaattttatatgtagtgagatagggttacaagggttacaaatttagaaaccaatgtaaatcttattagactgaaatgctgcaaaagcctattttgccagagtttctctgcttgctttgtggaggatgcagaagactgacggaggccaaggtagggatggaggggcacataatcactaatctttccatgattgtgactatgcacacctgcatttctggagtccactctgcctgtagtgttagagcaattagaaaagcaaaaagagaagatgagaaaaaaaaccttaacaatggacatggaaaatatcatagaaaaaggacatgacctgtaatcccagcactttgggaggccaaggcaggtggatcatgaggtcaggagttcgtgaccaggctggccaacatggtgaaaccccatctctactaaaaatacagaaattagctgggcgtggtggcaggcacctgtaatcccagctacttgagacattgaggcaggagaatcacttcaacctgggaggtggagactgccgtgagccaagattgtgccattgccctccagcctgggtgacagagtgagactctgtttaaaaaaaaaaaaaaagaaaagaaaaaggacatgaacactgcatgaagagtaaaggacaatttattaaaactagagctgagaatctaacttttgggaaagtcaccgagatagagacatctaaattaaataagcagagataactacctcacaagtcttaggtttctaaataactagaaaagccttttcatgtgggttcagcaaataaaagtggagaaaagtcaaaattcaggtgagaaggtcacctatatctgaaagatatagagctaataattttgactattcagagcattttttaaaatgactacaaagttttcttaatgtttaaaattcttctattggtaagggtctttgacataaaaaatatacattgagaagtagaaaacttctgagaggtcctgatacagtaaagaaattattaaattataaaactggctgtgacacacatgcatgcacacacacacacacacatcaatttaaggattttctctttgataatttgacccctttgttcaaacaagcctatgacagcaggctgatggacctgcataaaaagccacatctgagggatttgagcctcagggagcagctgcctggggaggtttttgtttagacctaaagcactgtgggaggaaaattcttactctgcagacagtaataatttgcagtatcattagcttccacaggattaattgtgagggtgaaatcggtcccagacccactgccgctgaacctggctgggaccccagtgtctttattggatgcttggtaaatcaggagtttaggaggttgtcctggtttctgctgataccagtgaattaagtttattcccaagaaactgacactctcactggctctgcaggtgatggtggccctctgtcctggagacacggccaaggaggctggagactgggtcagcacaatgtccccattgcagcctgaaatgataaagacagataaattatatcagatatactgagactgtccccatgtaggcccatgcattggtgacacttgtaaccacagtcatatgcaacatcttgagtaaccagaaaacaaaagataactggggaacttacaacctacaatgagtgccctaaatccaacaaccaagaatccagagacacaaaaaacaatgatggccacatgagtttgcccgatgtttccctataccccctcacttggagcccagagcaggaggatccacagcaaaggagccccggaccctatctctgagagctgaactagaggctgctcctcaggggccctgacaagctgtctttaaggatgctctgagaagcttggaccgttgtctaatggcccaacatgcaaatcagctcagaaaagtttgagttgatgctcaaaggggacacctgctcttatttcacccagtgggagttggggctaacaaaacatttcctagggtagctcaagcatgtcccaagggatttggtgaccttttctattggatctttgcctgccagtctacttgagatgccatgtggaggagtgtactggggctgccctgccatttggatataagttatttcagaaatacttttgatttttcaaaattcatattttatatcattatcaataataatgcattttaagttatcattgtcagaaagagaaagcaagttgggtgggttttatgaaactggttcatatgggaaggagaagtttgttccactgagtaagtggtatttaaaacaagtctataaatgttatcatgatctggaaaggatgaagggggtgagcatgaaaccttgatgaagactggtaacctaaactaatcaaggaacttgcctcattgtggataaggcagggtctctccatctgcttagtcctgaaaccaatgctgtatccaccagaggccctcagaggcagaagagtcattgtagtggatcctattcagagtggagaataaccatcccccaactcccactggttccatctgccttgccactggaagctggggctaaggaagtccatcttctcctacagcaagatatggtgtccacaccagtcagctggcactctcacccatccataggtgaaggttttcccccaacaaaaccaacttaaaatgtctggaagaagggactgcatcttcaaatgtgcagacaccaacacaaggctacaaggaacatgaaaagtcagggaacatgatgccaaccatcacttctctatgagctccactccaggactctattctgttacttgtgatggagttcagggccagagaggtcccactatactgcttccaactgtgcgcttgggtccctgattactcagttatatttttcattgatgttaacatgcatattagctctagttaactaaaagttttcttttatcactctgggaattgtttttatgcttttaaatttttattttatttgatttcaactaaaataaactagtggcttcccaaaggatctaggtagaactaaaataatggtctttctacaccttaaatctacatttttataaacagctgaaaatgaacagctgagaattacagctacaccttagggcaaaggagatgaagagcgggaacttagattagtgtggtgagtttgagtggaaagtactataccctcttgtttttcctaaatgattaaattctgcttacctagctctattcccctagaagaaagcaggaataatggaatttgagtattccttgaaaaaacaaagaacattttcaagaaatttaagaagttttcaaactttaacctttcagatgtctagtagatatctctggaaaacagggcaagcatcaatttgtggattgagaagaaagataaaatatttcagaggagccaatatgccatgagaaaagtcctgaaaaactccccctgaacccttggaacttttgtgccatgattagggttgggacaatccctgagctttgccccctcctacaactctgggtggaggaggacagaagtagaggtgggaagtaaaaggggtgaaatttgcatttttttattaggccacctagatgaccgatcattaagaaggctctagaaaatagagacaaacttgaccactttaagttgttcactgtcccatcctctgtcttctactctttctccagcaaccaagtgataactactacacacaacctgcaaggatacagtcctcagactcagatctggggtggaggtagggaaggtaataataaaatgcacccacatgtgtttggagcaatcaagaaatattgaactataccatattttggcaaataaaagacttgggtaaagcaaccccatcaaggataagtaatttgaaatgaaataatactgaaaattacaaatataccatgggagagggctatatgactgacaaaaatacatagcaagtaaataataaattagataactcttctgaaaatgatgtactctagtaaaacaaaagtattttctgcagcaaatgattgtaaatttagaagacacaccaaaaaaaaaaaaaaaaaagaaaaacacttaaatttattttcaaggatgagatagcaagaaaataataggtaaaataaatgtgtctggttacaggtacaggattaaaaaagtaaagcagaactagtaattttaacatagaaaaaatgtaataaggcaaagaaataaatggagtcaaagacacataaggtaagcttagtaaagggataaagttcagaaaaaaaggcaaaaaaaattacagataattatagaaaggatagaaaataggcacccaatatacatggataattgatgtgttttaattatggaatttaataaaatggcatatgaaataaaatgtaataacataatgaccagaatgtcaatatgtttaagtgaagatatgttaaaacaccccaccataacatatatgtgaattacatatttattaaatacagaaatattaaaagataaatctataacaaagaatttatatgaatatatatctgactttgtatttaaagagactatttataagccagaagaaaaaggaattctaaaagaaacaaaaaaatataaaaagaaagcaacagaagcctaatataaagtttctaagtagaagttttaaatcaatgtcaaacacaaaattatacactgaagaaaatcaatacatgtaaaaataaaagtaaactataacaatcaaagacatctcacaaaatgatgaagaaagcaaatttaaattagaaaaataatccataaaatgaaaaattaataaattggacctcatctaaattgaagtttttgatctgaaaaaaaatctctattaaagggatgtaataaattgaaagtggacttgtgtaatttagcaaatgaactcttgagcaattatctcagagaaataaaacattattatacagaaacttgtacacaaatgttcacagaagctttatttatagtagctaaatcaaggaaattacccaaatgtctttcagtaagtaaacagttaaataaactggggtaatccgtattatagaatacattcagaaataaaaagcaataaacaattgatatacccaactttgatgagcctgaagggtattacgccagtgaaataagccaatctcgaaatggtacttattgcatgatgtcttttatgtggtgtttgccaagggttaaggatggggtagagaaggtgagtgcggctataaaagggtaacaccaggagtcgtgtggtgatgatttagctgaatttcttgattacagtggtggttatagaaggtcacataaatgattcattcacatcgagctacacacacataaacacaatcacataaacaaacaaaaattgtgtgcgtgcgtaacttgtgaaaactgaataagttctatggatgacaccaatgttaatttcctgtctttggtattgtactatagtttgaaagatgtcaacactggaggaagttgccaagatgtatgagacttctgtatatttctttgcaacttcctgtgaacctataactatgttatagttaaaaaataaaaagtaaaaaaaatcttaagctttattacttgaaaaccttgaaaaaaatgaattgccctttttctatcaaatgattggcaaaaaaacttaaagccttatgcctccctctgctggtgggaatggagagggattgaaaagccatactttggtggttgcaatgtggatttctactgtttcctaagtaatctctgctcactattggagtgaaatttaaaatacgtacacttgttggcccaaacttactactaagaaaattgcctatagaactaataactccgtgttgtctaaggaaacatctgaatgcctatcagtaagagatggctaaatatattgtgctattttcatattatgaaaaattatggctgcctctgcctctgcccctctgcccctctgcccctctgcccctctgcctctctgcctctgcctctctgcctctgcctctctgcctctctgcctctctgcctctctgcctcactgcctctgcctctgcctctgcctctgcctctgcctctcgctctccctctctgtacggtgtccctctgatgcccagccgaggctggactgtactgccgccatctcggctcactgcaacctccctgcctgattctcctgcctcagcctgcctagtgcctgggattgcaggcgcgcgccgccacgcctgactggttttcgtattttttggtggagacggggtttcaccgtgttggccgggctggtctccagctcctgaccacgagtgatctgccagcctcggcctcctgaggtgccaggattgcagccggagtctcgctcactcagtgctcaatgttgcccaggctggagtgcagtggcatgatctcggctggctacaacctccacctcccagccgcctgccttggcctcccaaagtgccgagattgcagcctctgcccggctgccaccacgtctaggaagtgaggagcgtctctgcctggccgcccatcatctgggatgtgaggagccccctctgcctggccgcccagtctgggaagtgaggagcgcctcttcccggccgtcatcctgtctaggaagtgaggagtctctgctcggccgcccattgtctgggatgtggggagcgcctctgccccgccgccccatctgagatgtaaagagctcctctgcccggccgtgaccccgtctgggaactgaggagtgtctctgccccgccgccaccccgtctgggaggtgaggagcgtctctgaccggccgccccgtctaagtgaggagcccctccgcccggtagccgcccagtctgggaagtgaggagagtctccgccctgcagctgccccgtccgggaggtggggggcagcccccgcccggccagccgccccgtctgggaggtggggggcgcctctgcccggccgccaccccgtctgggaggtgtacccaacagctcattgagaacgggccatgatgatgatggcagttttgtcgaatagagaagggggaaatgtggggaaaagaaagagagatcagattgttactgtgtctgtgtagaaagaagtagacatagaagactccattttgttctgtactaagaaaaattcttctgccttgaaaaaaaaaaaacagaaaaattatgcaatttttgaaagaaagggttaatttcatacaattgatctgtttattatacaatatcaagtgtaaaagcagaaatacaaaaatgtttttataacacgtaatccagtgtttgagaacctacaataataaccacagaactatagcatacacaatatagtaaatttttttcatatattaaatatgattcacgtttcttggggtgactatagttttctcactaatagaagaacagtaagttgattaaaccaaaaatcatgacacaattatatagggaggaagtcagagcactctgttcttaagctctgctctagggagaaactatttaaccagcctaatgtgctatatacagttttattattatctaactgactggggaaagagaaatactcaactccatccagcactagcatccagtcccacctacatgggtggagaaagaagcaaagagacacttgtgatgtttacagtccacagacataagctcactaaagcactgaaccctaagcatagaagtatagaatgtttctcttcccctacaccttacccccatattattaaaggcctatttctagcacttcccttcacccaatatattttatctggctatcaagtaaaaattataaggcataataaaaggcaaaaagacatggtttgaagataacaagcaagcttcggaaccagacatggcagggatgttgtaatttttaatagaggagcaatgtaaactgaaagatgaagatcccaagaaaaagcaaaaaaaagaaaatgctagagattaaaaaacaaaactaaacagaacactgtaacagaaaggactgggtatggctggaaaaacaaagtctgatcttgagagtatattaatagaaatctccaaaactgaagagaaaagagaataaagactgaaaaccaaaggcccaagaactgtgagacatatacaaaaggtgttacattgtttaactctttttctctttagaaaaaaaaaaaagtgcagtttgctgccagcattcatataattttacataaacacactctttgaggctgaagcaaatctgactgattttcaatgtgaaataaaatataaaatccgttcttggaattatttctaaacagaacttgtctctaatcctaatataacagaaatgtatatgataatcagtatttaataattttttgtgtggtaaatttcaaagcacagaacaacataaagcggaatatcacattccacacaaaaatatcacgtttctcttcagattgtcttgctaggctcgtctttgcacaagcagcaaactttgcagtgaccagttggatttcgctcccctgatgttggtgatatctcttggggaaaggtcttccatacaggtgaagaggtatgacatcttcagagcaaggatgacctggaagactttgctgccctggcctgtgatgctttaagagcattttttcaatcaacgtcagtctgaagtttatatggctaattgtgtgctcaggattgtccttcttgaacagggtgtagaggttcattcagcactgtaatgtttagaaggtggtgaaagaatttcttagaccgaatcttgtgccctttgaagaagtgagcatcaaatcagctgagtccactgctcccatcttctcactatagtccacagtggcatatgacttcttagttttctctccatttctgttgtctacttcaatcacagtatcattgtggaatgttgaccacattctcaccttcttctttttgaggtaaacactgtagctgcaagtgctgccagcaagtattcttgggcaaaaggtaaatgggttaatggacatgaagaaaaaggaggaggacggggtggaggcgtggtaaacaaaaccatattgagtgaaaatttttctaaattaatgtcagatatcgaaccacagatccaagaagatcaggaaacaccaagcagtataactgccaaaataagcaaataagcaaaacaaacaaacaaacaaaaacaaaaaacacttgagcatataatttttaaactataggaagtcaaaaacaaagaaaaagtattgaaaaggagacagagagagagagagagcatgaacataagagaaacaaacctttcatgtagaggagcaaatataaatattgcatccaacttcttctgtgaaacaggaagcattcttcacttcaatgcaagcaagaggagagtagagtgaagtatgtcgtgttgagagaagaaaaccaccaacctaggattctgttttctatgaaatcatccttcaaaaggaaatgataaatgatggctttctcagacaaacaaaaattcagaaaaatttgttgccagtaaacatgctttgtaataaatagaaaaagaaaagttcttttgagagaaggaatatagtataggtcagaaatttgaatttacataaaagaagagcatcaagaagaaataagtgagggaaaaattaaggaacatatttttcttattcttaactgatataatttttttcaaaataatagtaatgtgattattatgcatgctgatgtatacatttacatatataaatacacacgtatgcacatatatgcatacttatttatacttacatataagtgaaatgaatgacaataatgcaacaaatggaaaaaattaggaatactttgttattatcaggtactcacatgacctatgaaatggtataggagtatttgaaagtaggcttggattagttgtaaatgtatattgaaaacttcagagcaacactaaaagaggttaaaaaatctaatatgctaataaaggagagaaaatagaagcgcataagatgctaaattaaaaccataaaaaagcagaaacaagtagaagataaacatagaaaaaaaacacaccaaacaataaatcgaaaacagtgaaagtgtggtagacattaatccaaggcattgataattagttggagcatcaagtgtctaaatgtacaaattaaaagatatgttattagagtgtatcaaaaaggaagattcaactatatggtgtctataagaaacctaattaaaatattaaagcacatatagattgaaaagtatatgaatggagaaagatataccatgctaatattaatcaaaagaaagcacaagtagctatattaattttggaaaagaagatctcaaagcaaggaaatttatcatggacagaaagagcattacatatgaaaaaggggccaattcttcaagaagacaaagcagtgcttaacatatgcgagcttaacagcagactgtcaaaataaatgtggcaaaaactgatagaactacaagaaggtacagctgagtccacgattacagttaaagactttaacacttcactatcagaaatgggtagatccagcgggctgaaaacccataaaaacagtcaaactcaacaacactatcaatgaactatgtataattgccatgtgtacactattttgtccaaacacatattttttcaagatcacatggaatattctctgtgataaacttaatgccaggtcataaaacacacagtaacgtattttaaaaaaatagaaatcattcagtgccttctctcaaaccacaatggtattaaaatacaaatcaataccaaaatgtagacaatacccaaatatgtggagattaaacagcacacttccaaataacaaaagagttaaagaagaaatctcaggagaaatttaagaagattttgaactaaatggaaataaaaacatgactcatcaatatttgtggaatacagcgaaagaggtgctgagagggaaatttatattatcaaatgtataaattagaaagaagaaaaatctaaaatcaataatctaagctttcactgtatgaaagtagaaaaagaagataaaattaaatctaaattaggcagaagaaaggaaataaatattagagcagatatcaaaaaaattgaaagcaggaagtcaacagaaaaaaaaacattaaaagctaatactataaaaatacaaataacattgataagcctcaagccaagctaaggaaacacagaaagcacacacattgctaacagcagaactgaaagaggggacatcactacagatcctatgaagcttaaaaggatactgtacgactattataaacaatgctatgatccaaacttgataactttgatgaaatggatgaagtccttgaaagaagcaatctaccaaaactaactaaaagaaatagacagtataaactgccctatatatattttatatatttaataaactgaataaataactaacaacctttttaaaaataaagcaccagattcagatggattcaatggtgaattctaccaaatatatgaggaagaaattcttcaaattctccatctatttcacaagatagaagcaaagggcatacctcctaagtcattctgtgagggaaatactagtctactaacagaaccaggcaaagacattacaagaaaatagaactacaaatatttctcatgaacatagatgcaaaaatcctccaaaaagtattagcaaatcgactatgacaatgtataaaaaaacactatacagtatagtatgccaagttggatttatgctaggtatgaaaggctgattcagtagtcaaaaattaattgatttaatccaatgttaattcttgtgcatccaacacaattgagtatccagagaatgggatattatttatagcctaaataaacaagctatcaaaccacgaaagaacatggaggaaatttaaatgcatattactaagtgaaaaagtcaatctgagaagactgcatattatattatttcaactatatgatgttctgtaaaagacaaaatcatagagacagtgaaaggatcagtggtagttagggatttgggagggtgggggatgaatgggggaggtgaacagagaatttttagggcagtgaaactgttatgtctgatactacaaagatggatatttcctattatacatttttcaaaacctataacatgtatgacatcataagtgaaccctaatgtaaactaagaagccctaatctaaactctgggtgataatgttgtgtcaatgtaggttcactatggtgggggatgttgataactggggaagctttgcctgtgtcagagaaagatacgagaatctgcactttcttctcaattttgctgtgaacccaaaactactctaaaaatgagctctttaaaaacataacttcctcccctgcccggccagccgccccgtccgggaggtggggggcagcccccgcccggcagccacccagtctgggaggtggggggcgcctccgcccggccgccccatctgggaagtgaggagcccctctgcccggctgccaccccgtctgggaggcctaccgaacagctcattgagaaccggccatgatgacgatggcggttttgtcgaatagaaaggggggaaatgtggggagaagagggagagatcggtttgttactgtgtctgtgtggaaggaggtagacattagagactccattttgttctgtactaggaaaaattcttctgccttgggatgctgttaatctataaccttacccccaaccccgtgctctctgaaacatgtgctgtgtccactcagggttaaaatgattaagggcggtgcaagatgtgctttgttaaacagatgcttgaaggcagcatgctcgttaagagtcatcaccactccctaatctcaaatacccagggacacaaacactgtggaaggccgcagggtcctctgcctaggaaaaccagagacctttgttcacatgtttatctgctgaccttccctccactattgtcctatgaccctgccaaatccccctctctgagaaacacccaagaatgatcaataaatactaaaaaaattaaaaaacaaaaaaacaagaaaaacataacttcttaaaaaataattagttatttccactatctaatacagcaacttgaattgtgggagaatgagtaacagtgaaagatttgtcatattttcttttattataaatcaattattaaaaatattattcttacaaaataatcttttttgaatttcagagtattgctattgccagtaaaagttaatgataaacctttaaaaagtctgccttgtaattggttattttgtctcaaaatctgttgcccttaagtatccagaccatgtaaacttttgtaagaattcttctttcatcagaaaaaggctttgaaattttcttatactatctgggagtataatattcttaattctaaatgggaacctcccctttctgtatgttaacataccgtgccaaaatgttgacaacagcagctagagtggatcactccacactggacaaagataagaattgataaagtttgtaagaacagcctatgtttagatctaggtgggaagcaggccactgtgtgtctccaatcttggtcacattcaactgcatgaggacagacttatataggtcagttttcttgtagttcaactttcttgccaaatcctgtttgggggtccataagtgtaaaagcacatgtaatatatatacatatataatatgtatgtgtgtgtgtaataatatatatattacatgtatacatgtatatatacatgtaatatatataccttatatatattctctctctctctctctctctctctctctctctctctatatatatatatatatatatatatatatatatgacttgggaaagaggagtcttggaagtggaattgcttgtgtccattaagctggattcagtgttcgtagggtggagtttgaccctatttgtaggggatttgggggcttatcaaggaaaaagaggtgaccacagagtagcagtagcacacacatttattgggtgaaactttgaggggctcacagggacaagtccttcacagcaggagtctttgcagatgtgaaggtgccaggttgctattcagaaaggaagggaaacaagaaaacacctgaggaaagggacactggagaaaggggcttatgtgtctaggtgatgtcacacagcagcatgatggagagcctctgggttagaaagctcaagaggacagttgcagtttgggggttttattgcctgaatcttactttatttattggcagcaggtgaggtttcctggcatatgcaaagcaagcagtgtctaaatggcaaaataataataataataaaatttgagggctatttttgaaataattagttgtgtaaaatttgaacttgatgatagtagtttaaaaataaacctgcagtttagcaatacacaactttgagggcagtaaacagagctttgattcatttatataacactgttgcacatcctataatgtttgttctgttgactttatcaacccaaactgtccaaacctataatgctttgcactagaatacatacccagatgtgtggttccttcccatacccaaatggaggttccttatggcattgattgtggtgatggattcatgggtgtgtactaattttcaaactcatgaaattgtgtacattaaatatgtacaattttttggtatgtcaattatctcaataaaatggttttaaaaatctcaactagcagagggatattccccaaatgcagattgtctagagtggattcctggcttcaagacacttgtaatgaaagctggttgtctcttctaaataactataaattgtcacccagaagaagtaaaattcatggctaaccattctgttttacaggttcagagcaggctttgtggatgtgtttatcctccgaatttatatattctctctaaacactgggagacgttagtatgtttacatgtctgacttctctgggttgtcaagatcccatttttgatctacctaatatgaatttgtatccaaatgtttaaattcttttctttccttttacttgaagtaaatactaaaaaatcctacagagatactcaacccaaccataaaaatgagtttgagaatcatgtgttggcgatgaaggctttttatctgtaaatgctaaactttctgctgagcccagctcacccatggactaactggataaagtgagacaataattccattgtctacctgagcattccccaccttaaaatttttaactgcctctaacatctctgctctaggcttactcttgaagacagggtcctctatcttgaaaagaagtttttctcaaaagccagagcttgtttaataattttcagtttttttaatgtgagatttgtctattccaccttgtaagaaaatttgatttgccagacaaatgaaaagtggaaaactcaagaagagtttagagatagaatcaaggacaatagcattttaaactgtgggtacatctgtctttgaaataatttgtataaatatacggaaatgacaaagtaaataatttttttgtatttttaatttagataagatagtttacttgcagaaaaatggagactatgaacctggaattctcaaattcaatgttttttcttccggtttaaataatttcaagaatctataaaatacttacataaactttaaatacagaaattttaagagcttcagaaaaaatcgaccaaattaaatcccttacactagtttctgaaatcaaccaaaattgtgttttaactactgtgttttatttccaatgaacaacaatcaaaaacattagataaagtaagatgcaataggtgaatgaattgtttggtggtcactcttagttataatgagataataatgagacaatatcttcatcagaaagtggaaatggtgactttctgccttaagggagcaggggactcacagttgtaaacttcccctccgtcttgatctttcttgtgcaggagccgagggtaatccactgtttcagtggtctttgagcagcaacagtcctcatctttctgtaattctagaaatgctcatactgggctcttctaaaacactttttatgctaaatagaaaaataaagatcagtaataaaataaaaagaaataaaataaaataacttatgaactcctggaagtagttgtgggataaaattataaagtttaacaaaaaactagaacctagaacaacttactaaaaactaatttagtcaaattttactcttattttgtattcttgccctcacaaattaggaattttctcaacccaaagaatgattgcctttcttatattctggaatcttaacagccataggagaaatttgaaactatgagaatttatactaaccagttatcctaggaaatctggttacacaaaaattaactatttagagtaaaataaaaggaaaaatttgttgatcccatggaaataattaactgaatatttgctggtcaataaagctaatcctaagtatgcccctaaataacagcgacatcgttgtttctggattaatgctaagttttcaagatccattaaaagtaatttgccttggattcagactcatagtattggtcataactgtaattcaactaccaccagaacttgtagaagacaacaacaaaaaagaaggggtaatgagaaatatgttatgaaatgtatcccaatgttaacatttatgaaggagagggaggtgttttatgaatatctattctcatagcactgatatcttcaatttgataagcaaatacaaatctttaaaccagaatttggaacagggtaaatatggctctcatgaatttgacttgactgcgtcctggggttgtattgacataaggactagatggaggtacatacagcagaagtaatgaaaattataatgtcaaattttagagcctcctaactaaagcactagctcagatactgtataaagatgaaaaaaaagttatgtgaaaatgccctggaactgtttctggactgcctagtaacatcctggctgtggttggatggctgatttaccccagctggaagtatcagtattgtacagctgaaatttgtgggcactctcctctgcagttgtcaccaaatggcttatacttttattttcaaaatccacttgcaattctaagagctctccttttctctcacaaaaggcagttgaggcaaatcaaagacttttgggataaaatgttatctccactatgaattgacaaagtctatttagatgtttgcaaactaaacattttcactaattgctgtgagtcacactccccctgagtatagcttgtgtagaatgcaatcacaggtatgtaagtggaggtttggtataaccactaatggagaggtaggaagttagaaagtgggaaaataccaatttctgaatattaccaaacgttatcgtgttaaaaatataacaaaacctgctaatcctaacatatacccaacctttgtagccatgagtaggcctcaattttcttgctgttatgctgactaaatctcattgacaaatgcaggaaacacagggaggatcagaatgcactttccaggtagctctctcttctgtcatgtctagttgctcagagagcactttgatcaccttcattcttctgcttgagccatgtgaaataaggctgttacagtgatggggccagaacagtctggatcttcctgcaaattattccctgcagtcatctaacatctacctgtgaagccaactcagaatctgccatgcagacagtccacgtgcaaacacttgtggatggctgggccatcccaagtagggaggtttgtgttcagggttttaccactgtgtgaggaccttgcagaccctgttcacagcaataaaccccaacatcctcagcctccactttgctgaatttaagtgtgaaacctgtccctgacctgctgccactgaacttgtttgggactccatagaatttgttagaaattgtgtagataagaagctgtggagactggcctggcttctgcaggtaccaatccaaataggtgtttccatcactatgcaggaggctctgactagacctgcaggagatggaggccggctctcccagagggatgggcagggagagcagatgctgggtcatcacaatatccccactggatcctaaaataataacagtgagaagtacaaggttacatacaaacaatgtgagacatttttataatttagttttattgtatacgttaggctacttttttgtgtttgattagattcatacactacatttatccaatatccaaaaataatccaataattaaaggcacaaagtggcctctttgtttttgaagttctcgacagtgaagttctttttccttgtggctcgttcttagttcttacaggtctgaatattaaattccctttgctggaggacaagaaatctgcatctgacatgtagacagaacaacaaatgggaggctgcagattccacagagctcaccctccagtcccattctcctctcttctgtccttaccagggacccagagcattagcagccccaggagctgagcagggagcctcactgtgagaaggtgaactgaggagtcctgatcagtcaaggcaaggttagagctgagcttttatctcagactcacaagggaaggtcttccctaggggacaacatgcaaatcccctggtgagtgaagcagtgaagaaatatccagttggggtcgaagagtgggcttcttatgtaagcaaagtgacacagaatatcttttgtgttgatgaaaccaaaataaaatattggtgttgcctggcttagaagggtgacattctgaaataccatgaatcaatgtggaagacactgtgactgcagcctgtcactcttcattgctgatgcaatggagattgtgatgatgaagatgtgtatcaatctttaggtggtgaataggctttcttcttggctccacccagctaattctgaggaggaactagctctcactaactctggtgctcattgatagaatgtctctaagtatcaggatgaacttgaaacagttccagggttatttggctgtggttgcaaggctgatttccctcagcttgtatttcactgtagctggtatttctgggcacttggctctacagctgccattaaatggcactaaatgatgccccagtgaataagctagctgtaatgtgtgcttcgtaaacaaggagaaaattagagttcacgggaagaggaatgcatattccattccattgtatctaatgcatgtcgttgtctttgaagggaggaaggccttggtaggcctctttggattctagaggcaagaaattctgtaccttggaatactgtactggctcactgaccgactgatacacgagtcagccagccttgagtgggacccggggcaaaaaaagggctctgcagcaggttcagcctgtagcacaagcagtcctgcctctcaggccagtgcagatgcagatgaattggacagcacaatcaaccatctggacataattgacacttcgagaacactccaccagcacagcagattgcataatcttttcaaaaaatttactaaaatagaccatattgttaccagaaaaggggattttgattcaaactccaagagaggattcttggatttcatgcaggaagaaattcaaggaaagttggaaagtgcagtgataagagagaatttattgaaaattactccattacagagtaaggcatcctcagaaagcaagcagaggaacataccgtctttaagtttttcttatataggagtgtcgtctatgtaaagactaaactaagctgtgcctacatgcggatgagcagacattacgacaaaatttattattctgttgatttaagggaaactattcttgacattctagtgtgttatcttggaaataaggactgtgtcttgcaaagaaacatattcattggggcaatgtgttatcaaaaaaaagattttatctacttatgatccaataatttagactgacttcaacagatttttttaatgacaaaaagcagaagatggtataagaggaaaatacaatacaacagaaaacacaagctattataactcttgcttcatggatttttacatatctattagacatatgctgggtatatgtgtgcaatgataatctaaaaactggatgctaactagcttaaggaatgcctgcattacactgagtcttgcccacttttccaattataaacagaaagctacagtactatttgtatgagtatcaaaacttttagctgcctgagatagaggtaaagaagatttactgagataaaagccttggaagtagtagagatttgtcctatgatgttatggctgttgctgtggttgccgttgttaggaaatacagtgggagtgaaagcaagattgacaagctctgctcttcctcatactcacaaccccctctagagatggacagatggtggtacaggaatctctgacacctcttagaagtcttttgctctttccagaatgtttcctgacaagtattgttttgagtcacagattaggtgaaactgggtgtagaagaaaggactagagcaagggaagaagttttccatcccagatagttgttgtaggaacagggaaatggaatttttcatagatttatgccacatttctatcatgttggggagagaggcatcaaaccaggctcattcctgaaagaatcattacattattttagagagaaagaactacaaatttcttgtcaaatagatgtttaaaattcaaagctactgatttttttttttttttttttgagatagagtctcgctctgtcatctgggatggagtgcagtggcacgatcttggctcaccacaacctctgtctctctgattgaagcaattctcctgcctcagcctcccaagtagctgggattacaggtgcaggccaacatacctggctaattttcgtatttttagtagagacggggttttgccatattggccaggctggtctgaaactcctgacctcaggtgatctgtctgcctcagcctcccaaagtgttgggattacaggcttgagccactgcaccaggccctgctgatgtattaatattattcatcttcttgaatacaccaaatggtaaagtgcaaatccacactttaaacttgagatttctactcctatgtaaattatactagtgaggaacaaaaaaattctctattggttgggagatgatgtttgacagtggtcagtttgtgaagtggaggcttacgtcacagtactttttacagtattgcatataaacatgaatgtcctcatacccagaagaatcagcatttctcatgagccatattaccaccaagaaagaagtgaattgaagcctgtgactacttgatgaagggtgtatagaagagggaaagaaaaaggacacaaaacacaatattgtaagtggaaaggagaaagtcattacacagcctataagagtaaaaaaataaagagaggatattatgagtaattttatgtcaactgacttgacaaaagtggtgcagggcaggttcttggcttcactaggaaggaatgcagcgtaagctggtggtagaagaaaacagctttactgaggtggcagtgttacacctctgtgactgctcttgtggagcagagctaccccataggcagtgtgccaagagcagtagcatagggcagttttgcagtcatatttatcactgcttttaatgacgtgctaattaaggagtgggttattcagaaataactagaaaatgggcagtaactttcaggttttgccatggcaatggtaaactgatacggcactggtgggcatgtgttatggacaggtgcttccagtgtctcttccttgtgtcacccactcttcaatctggtccagagttgagtcccacctacctcctacctcattgccccttggagattagatactcctccttaatcttaaggggactgcagaagagcagagtcccttttctgtgagtgcttccttctgactttatgggggcaggccttccctagcatttgaagagtaaaaatctttggtatctgaactaaggggcccagtggcaggatgctttcatttgtggggtcagaagacagaatggattgaaagacttatgacggaccgtatcatttttacatgaaatttagaagatataaactttactaggaggttaaacaagaaaattataattggaagagagagaaaaattaatgctcctatgtccacccacagaaccaagttgttaatctatgtgtttgcaaaacaacagccttaagttttctaggttttataaatggaggttgtggtgtccaccttttgtgcctgcaggatctcataagaaacaggtttaatcctggacagctagtggcttcctgaagcctaacagtagttggaataattaagaatatctggtaagggcccctttattctgattattattgattcttgggggatcattttgttgttgttgttttttaagacagagtctcgctctgttgcccaggctggagtgcagtgacacaatctcggctgggctcactgcaacctctgcctcctggtttcaagctattttcatgcctcagccttctgagtggctgggattacaggcatgtacccccatgcctaggtaattttttgtaattttagtagagatatggttttgctatgttggcaaggctggttttgaactcctggcctcaagtgatccacccacctcagtctcccaaagtgctgagattataggcgtgagccactgcacccagccagttccttctttttaagtttttcataagactaagtcttttggttaaacagaggagctattattttgttttgtggaaaagggcactattttattttcataattttaaaagcccttttgaatctggcctacatttcaaacaggggtggagcaaggtgtgtctgactccctgtttcccaccatggcttgagttagattttttttaggtttctttggtagttcctttggccacagagcttggaatgaaaacatttatagccaattaaatattttaggccagacagcatggaggtgggcaggcactcattagcccttaagcaggcagatcatgaggtcaggagatacaggccatcctggctaacatggtgaaaccccatctctactaaaaataaaaaaaattagctgggcatggtggcatgtgtctgtagtcccagctactcgggaggctgaggcaggagaatcccttgaacccaggaggcaggggttgcagtgagccgaggtcgcaccactgcactgcagcttgggtgacagagtgagactccatctcaaagaagaatatatgtatttttaaagctgtataaaaataaaaaagtaaggccccaaataaggttatatatgttaaaaaaccaagtacgtagaataatactatactgggggaaaacattgcttccagagacgcctaagacaaaacactttagcatcaagtccgcaacaacagtcagaaccggaggtgaaaaagccacaggagctgatgaagaagcaaaaggagacagcaatgatctcaggcctttttaaagggagaataagctgaaagcagcaaaacaccacagttgaatctctaagacactaatctcagaagttttaaaagaaactcattattgcatcaaaggcaaaattttctgttttactttttgtttgtttgtttttcgagatagtctcactctgtcactcaggctgcagtgcaatagcacaatcttggctcaccacaagttctgcctcccgggttccagccattctcctgcctcagcctcccaagttgctaggattacaggtacgtaccactgtgcctagctaatttttgtatttttagtagagatggggttttaccatgttggccaggctggtcttgtactcctgacctcaaatggtccacccgcctcagcctcccaaagtgccgggattacaggcatgagccactgcacctggcctgtataattttcaataatgtagcaaattaataacttaagaaaacccagtttcaatatgcagacgattttctagaaagtgactgggccatcattgttctcatctcagatttccacttcctgtatagaaggtgtaagaagaggtagcaagacattatgaaactaaattgtaagcatttgttagtgaacaaaatatgactaaagcgctactttttttaaaaaatttttatttattgttattattttttgatacagggtgtcactcttttaccaggctggagtgtagttgtgccatcttggctcactgcaaccttcgcctcctgggtttaagcaattctcatgcctcagcctcccaagtagctggaattacaggcatgcatcactatgtccagtctatttttagtagagacaacacttcacagtgttggctaggttggtcttgaactcctgacctcaaatgatctacccacctcggcctcccaaagtgttgggattacaggcgtgagccaccatgcccggccttaaagcagtatttttattaaataaagtgtagaagaaaaagtgtaaataaagtgacaaaaagaaaacacaaggccgttatggaaaatgataactttagggaagaaaacaagaaaaggcaaaccaagattcccatagggtgagtctccaatccacaatcctcagacaaatgtcaatgctggaaaccctggagcatccagggagtgaccgaaaataccaaatgctgaaaacccagagtacccgcgtatcagcctatgagtgtcccacaccaaatgccaggaaaccctggagtatccaggggctgaccagtgcagaaaatcctggagcctcagtggggtggccaacagtgagccccaaaggcctggttggggccacagaacaatgtgactctggcttcttagagtcaacagaacaggagaattcttacatccaagtgtcctgccttaaacaattgcacaaacataattagtagggacccaaagaaaaaactgcaaagcaaacacatatatcagggtagaaaataagataaattggctaatggatagataaaatggcattagaggagaaatgactaagagaaggagcaatgaggatgtagtcaggtgtgctatgggggacttcaaatggactatttagccaaaggccttatttcctggatcatctgacatagggcaggtgggtagatgggacacttacaggtgtgcaggagccaaaatggtgccaagcagtgtctaacgtggggcctgtgtgaagatctctccaggccccccagcttgggtgggttgagctcccgtgggtgaactggtgcatgcagcagctggcctgcatgaagcagtggctctgtggccacttacctaactgctcagctccaccgcctgtcaggaaagatgatggctcttaaaacagcctttggctagtgttaacagctctgcaatgttagcaactctgtagctttgctcgctgtagtgctgatccccatcacaccctctctcactgatcactgtcttgccacttctccaatagctgtcttgcccattgctgatcgctatgtccatcttctcacaaaatgccatctcttgctgtctcttgctgtcttgcttctccgctgtttccactgactcactggcacatcaaacgctgcctctcaccatgtcacatttatcctccctcctcattaaacatccatcttcatgtccagcccttgcatcaccaggctgatgtctctgtactgggccaggtactggagagtattgttcctccatcttcaccattaagccatggttctctcaaatcaaaccttctcactgcaccaattttgccaagaaggtttgctgtgcactggttgccaacttacccaaatccggtgacacacagcacccatgcacaaccagttacatgaagtggattactacttacagagagtcagccagagagagcacaaagctgcggggacctgattgacactagactgtgtgtaccccacaaggactgcagctgagggaccctggaatacagcccaccctgggttttatgtcttagaatcacatgacacactgggctagagtgttgaaggaattcctgtttctagtagggacagaaacggaacccaggctgttctggccaatcatgccctatctcagaatgttacatttccagaacattctacagttattccagaaaactacaatcaagaaagggaaggggactgggttgattcaagacaaaatgaaaactattctgcaaataccatagtgaaatcacagctcagtaatctttttgtgactggcttatttcatttagcgtaatgtcctctagtttcatccatgttatagcatgtgtgagaatttccctttttaaagctaaataatatgctattgtatgtatatatcacatttggattaccagttcactcctttgtgaacatttgagttgctctacctgttggctactatgaataattcggttctgaatgtgggtatacaaatatctcctcaagttaatgtcttcaattacttgggtatatgtccaaaagtggaattgctggattatatagtatttccattattaattcttcgaggaattgccatctggtttcccacagcaggtgggccatttacatcaccacgacagtgtccacaggagttccagttccctaagttctcaccatgactggtcattttctgttggaaaaaaaaatcctaataggtgtgaggtgggttttgtttttatttttctaaggattaataatattaagcatcttttcctatgctagttatctaattatctctaaagaatattctccagagaaatgtcgattcatatacttttctcgtttttaatcaggtattttattttaatgttgacatgtaggacttatttttatgtactagatattattaaccccttatcagatatacgatttacaaatattttcttctattccacatgttgcattttcactgtgttggttatgtcttttgatgcccattttacatttttatgtagtccaatttatcttcttttctacttttgcctgtattatggtattaaaggtgttagtattcaaatgtctataaatactgacttactatgctgagaaggtcactctagaccatctctctgatggtggagctaagaattttacactctctcattttgtaccagggcacagtgcagctaggtgagaacacagtggctttctcgagcttatttgtcttgcatttttggcgacaaggattgttgttcacattggcctcctctggcaggtccacctggaaagcattatatttagcaagaaaaaaggaggctgtgaatgatgtcaactgtgtatattccctgttgcaagtgtcaaatccatgaagcataaaaggatttactagaggatattaaattccttgcaaagtgttgaaaaacctgaaggaataggctccaggcaaagcctctagaacaattccaagaatggcactgctggcgcaggctggggaggagctcctgctgcctgagactccacattcaagctgtctcctgcaggaaagagagcagctcttctcactactgccccctgaaggacagcagctctgctatcaactactagagacctgacccctttccctgcagccctgcctgtgttgattatatcttcatgtcagactcatgtagattcatctgttttcaagggtacaggggttatttctgcccaagtccacactgtggctttctatcataaatacacgtttctacacttgaatttccaggaattactagtatcaacagcaaaatgctacaacccaacataaagatttcctttacaaagaacatcatgctccccatgtagcattgtgctccccaaaatgtggggaaactccaatctgttcatcccaacaccatctaggaaaaaatgttcttctctcatgagccattaatctgtctacttattgtttaatttttggcctaaattgtaaaggtggctaaaaatagcactttgaatttttttaaagaaagggtatatagaaaatattaaattatttaaaatacatatatgcatgacacatttagttattgtcaccagcttctttcacatttattttattctgtagtttctggcaatactttctctatggtagagtctggaaatgctactcctcatgtccttggcttcctaagtcccagatgtggtgaagaatgcacatcagctgtgttactacagaatgcttttggattgagatgggggaggggacgtgcttgatctcactcaaatgtgctcaatttcctggtctgggtcacagccaggcagcccagtcctatgggcacaatatcttcactcgccaggtttctatcaaaatgagagtgtccttcttgactgtggaaaacacggggcagggagaggatcaagaaatagcaaaaggagtatttggacttgcctgagctgccactctggtttccccaaatgttttcattccatttcattcatgataataaacacctttctgcctaaccagccataatcacttttcttagatccagctgattcagtgataaaactaaagggaaaaaataaatacagttttcaacgtttaagctgaccaggtggctgtctctggtgtttatacctccatatcccactatgcatttcatcttccctttgcctcactggagatccaagtgcagggaatgcttcacgtgactgtgatccctagaacttcatcttcatgactgttgaaatcttctctgagttttaccagtggaaatggcaataaatagaaagattccagaaggtcccctagggtccatattttctgtacttcttctctaaaataagtaaaatcaattccatttgctcttgctttatattggctacatctatgtgcccaggacacaccctaaagccctgtgttgacaacttatccagtattgtattaagtctaaatggtcacatgcttatcatatcatttcttccaatttcatggaataattgtcatgtcaactctttggattaagaaccatcaaccagataaccacagccctgaataaatagaaacagaatatttcaagctgttcagttggcataacagtgatgagtctatagctcattttcaagatataaatattctatttatgggagtaaaagcacgaatcatggttagtgtttcagagcctccaccacatctgacagcatagcaattcaacagcacaaggtttgtgtgccagctgtgcctgactaataatgtttttttcccctgtctatagggaaatctgcacctgtgcacatgacaagagcatgagctacacttttttcactttttctgaggtaaatacattgcttgatccaaaaccgtattatggaataatttcctgactctgatgaaagcatttggaaaatcctcaaataatatttgtgcagaaatacaaccaaaaagaaaggcaaattcatatataggaaaataaccagtgctctcctcatgttacatgaggtccactagtatcacctgaccccagctgttcatctgatccctgatgtgttgtacaatgttaggggttcaggaggggtcattcttcttggcaaatgaggtgttcagaagagccagtagccctttaagtctcagttagttgaaattcataattgagtccccaaagggacctccataacattggttcatgagactccctggtaaagctgggaaaggtgactgactgaagtccatgtgttgaatcatcctcattattaaaagcccctgctcattaatagcattttgattaatattcactgggaaagcattttttttttattttggctcatctttgaaaagtctagtcatagcttttcaatcactttgtctgcaatcgttttgttgcatttctttgaaggcctgatgatctgtcaaaaccaacagccaatattattacattgccgttatgttgggaaaagctgaatgttgggagaagctgaggcagggcttgcatgtctgacgtaatgtaaaagagtcttggaacacgtccggggtccagggtctaaaaccccttgtggcctttagtacaccaagctctgtgctaaagggtggaaggctaccctgacgcaccataatctaagcccagggcataaaatcccttgtgacttggatagaatccaggactcgtggctctggagtgtgtctacacttgctggctcctttctctttgctctccaaggatcgattgtatcttgagttaaaagaacctgctctccattatctcaagtagtagagcaaatgctaaaccatcacaggtgtaaatcatgtgcttaatgcaatgcatccttttggcctccacattcttaccacgtgtttctttgttggattaccaataaatagcatgggatcccagggctcagggccttcttagcctccatacactacgatggtccctggtgcccacatttctctctcaaactgtctttttctcaatctttgactccaccagactttgtcacccccacgacctggtgttgggtctgatcaccccaaaactgttatcgttgcaatgtgatcatcagatataacccttgcagtttactcattgttatgatttttacatttgcagggcttccttgacaatggcactaatgtgacgccatccagcatccattattgtgagaactctatttggaatatcaccattgtgggcatgaacagaatggagactttcataggatgcaatgtttaatattcaacattagtcaaaatttgttctagtcctacccttggagctccattgagttggaaaaatataaataaatttattttaaatataatataaatgtaaatataaacaaatttaaatataatataaatataatataaatatacataaatttaaacataatataaatataaatataaataaataaataaacaaaaaaattttctgtagcaagagtaagaactacatgtggtccagaataccattattttatggaaggttacaaaaaattttaaatgtatttaattcagataagaattttataaatatgcatatattgcatatatgatagaataaatgtacttaaatatgaatactatatatatttgtagccaacattttatcaaaaacatatatattcacttctatgtatcttatatacatgtatgcatacttttccgtaagataaattttaattttttattgaaatactaattagttttaattttgtctttaattttcttttaataacttcataatttgattactggatattcacatttaaatcaccaatttaagaaaaaatacatgtgtgtacatataggtagaggtgtaaatactgtatcaggaagcttttatgcattactgattggtaactggttaaatacacaactcagtgactgataacagtaaacatttgttttcatgttcacggatgctcatgttcacaatcctctgactgatcaaggaagggctcagctgagtggatcctctgaaggacacagacctcatcttcagcctatagatatcaattgtctgaggactaagctgaacaccagtgactacacatgatacaagattcttgtggcaggtcacaggagtgaacatcccaaaccaaactggacagttgaatttaagtccaataatttctaacatagcttcagatatttaaaatatattcctttatttcagtgagtacaaattttcaagaaaatgtttactccatttaattatagaggtgtttgatcattccatggacaaataattatgttttcatcctttacaatcttgaaaatatttgcaaatgtaaatttgcattaataagaaaataaagctggatgtgttttcaacatgtggctttaaatataattttttaaaatggcctcattgggggaaaatcattttaacttatatgaatatccttttttgcctctcttgtgttctatagagtggcccaataagaggtcctcccatgagatttggaatcaggaaaggatggctcaatattctccattggtacctaggacagacacagggacagagatgaggactggagaaacacctggaaagatgctgtaggaagctgagagcatcagcacccccacccctaagcttccagacaggactgaggaccacatggttagatagcccatacttcaggggaagatgcattcagttttctgagggagcaacagagattcctgcttctaatatcaactttcctgactactatatccttggctttgaaaggttgtagtgggaaagttaatcgtaggaattgggtcattcttgtcatacccaacagagccaagaaaccaggagggaaagacactcagggtgcaaaatattgtctgaagaatgtaattgaaataggccctattatcccatggaactaatgtttatggttttttgaaggaacatagaaattgactcctccagtcttaaaaactcaagatagttatatttttcttatctgaggagttcttttgtcaggaaaccaaccatcaggcctccagatactatcaaaaggagctgaaacttacatatcactgaatcgggacagtgagacatcagactcttcacccattgtgattgcctaactgacctcctgcttcctgttgaccaaatcatcttccttacccctccctaattcctgttttcccacatttcttccctgatatatatacccctcattttagtagttcagggagatacatttgagaatggtgtcccatctcctcggctgcagcacctgattaaagcctgttccttggcaatacttgtcttagtgattgtttttctgtgtggtgagcagcaggatctacactgaatccctggcatttcagtaacaaaattctctgcaagcttcactgcctttggcttattgtaacctgaaatcaaatttatccacaacttctgatataacttgatataactgtaggattcactttgtccaccactgcttcccagtctgagcttgccagctcccaacccttcctagtgcccatgaactttctcaaagagccataggtaacatgttccctttttcgtaaaactctaaccttctctttgttcttccaacatattgaagaccactgagttttcctgtatgccccatttggcaaatatttctttgcacgtaaaacattaaatttagagattcatctctacattttatttagacttcagtagtttagactctaattgtctgtattaagacaattcctgctttgaatatctatagtggcctcttctctgttatataaagtccagctgaagccataaactagactcttcaggtgtcatgatctctgtctttattaaatcaggagaggcattgctagatctgtgcagttggggctgagaaagagaaaagaattagggtgcagaggtgactccatgtccccctctaccaacaccatcagagtgtggctgcatctgaggaccactctcagctgatagaggcatcaggaggagcagctggggcagccctgcctcacacatctgcttccctgggggtttatgttcgggtgtgtaacactgtgggagaataactattatactgttggcagtaataagttgcaaaatcatcaggctgcaggctgctgatggtgagagtgaattctgtcccagatccactgccgctgaaccttgatgggaccccactttctaaactagacgccttatagatcaggagcttaggggctttccctggtttctgctgataccaggccaaccagctactaatactctgactggcccggcaagtgatggtgactctgtctcctacagatgcagacagggtggaaggagactgggtcatctggatgtcacatttggcacctgagattggaaatagaaacacaaatattcatactattgatcatattataggaagacttccctgaataaccaggcagtactgagcacactgggctgagtaaattcctagtgttctccttccttacctgggagccagagcagcaggagccccaggagctgagcggggaccctcatgtccatgctgtgtcctgactgggtctgactcctgcacaaagtgtgaccagcctattaataaggcttcagggcaggaggttgtgctctgggaacatgcaaatgagcaggggatggggcaggctgggcacagctgcagagctggctcatctcagtaactcagcaccagctcagtgtccccaggtgtcccaggtaagaccagggtagcacaaatttgtctgcagagaatgtgtttctactggggactattttattatgagaaacaatttttaggtatttttttgagaattttaaatattcctcaggagccgatagagtaatgtatttcattggtgtatcaggattatttaggagaatattcttgtttgtaggaaacacatagtaaaatgttagatggtaggattctcaagtcttcaaaagactctcataagattccgggtagggaagggggtaattgtgctatacctgcaacatttctgtgagtttaacattgttcctttctaaaaaaaattaaaaataaaatgtatcggcatgatgctatatatttgtaagtattaggtaatggtgttatgcctttgttcttactagtattagatcaagcaatttattacagatatacaaagatgataccgtgttgtctccatgcatgcagcactcacagatccaccactatcaagaactgcaggtctctttaatacccagagactaaatgaggtgcaccttattcttgttttgggtaccttcatagtctaccttcttttctgccattgggtattatttcccaaagttcatctgtcttagtgagggtggccactgcacggagcatgtccctgccatgcaccatcaatgacactttcttcttatactttttatcagtgcatggggacatcatcctgacccagacaccagcctccctgttaacacctttaggaaaaacatactcaatctcttatcaagcaattgtctatgtacatggagaaatcagttggatccagatgaaactggacatggatttgcattcattatatctcatatctctaatgtaccctgaacgtcccagcctgactcagtagcaggggaagtggatgtaaccacatcagcatcagtgggctgcagcctcgggctccacaaaattttactgatgcctgactaggggagcaaaatcacagtgctgcagcccatgcacaaacatttctgctgctttgtaagcagcctgaattttaagggaacttgcttatattggaagaaaggaagaaagttccatttgtcctctaaatgtttgctgaaaatgaaccgacaaaagaataatgaataagagaaaaggcaaacaaaattcacttagagtgcggtgggatatcatagtggggtgattacccagataactcaatgagatccagttgttcatatttcctttctagggaagagggaattgggaagtgtaggcaacctggagagaatagatgaaaaaagaaatgcatcctcaaaagaacaggcaatagcctgcctggataaagcatcaacttgcagtctcttctatttttgattcatgttttgtgttaatcttccctgatataaaatttcccaggaagaatttccttgacaattgtttttcttctggagaatttgcttttaggcagataagggatatttaggaaaagacttcttgtgcatttgctgctttctaaatgcctttggctttacataatcatcataccaatgcagcatagtttgagatgttattttctggattcctttacttgcagccacctgccaagatcctgtttcagagagatgcagctgcagattgagtgagcagttgacccctgaacaacatggaggttggggcactgaccacaggtgcagatgaaaacctgtgtagaagttttgcatttctaacttaagtactaatagcttacttttgactggaagccttagtgataaaataaatagttgattacacttttttacattttatatatattttatactctattcttccaataaagtatggtaaagaaaaaaatgttcttaagaaaaccataaaaatgagaaaatatatttactactgattaagtacttgctttcaggtgacacagaagaaaatataagtgtatctgcaaacttcaaacccaagttattcaagggttaactgtaccatgatgaatgtagcagtccccatctgtagtctagggctttctcctttgctgtacctctgctcacttccaatggccatatatatgtcttatgttctttatgatcttgggcagagaggtctgcctacatgcattgctggccagatgtcctggaatgtgtatctctgaggaaagtgctatggtttgactgtgtcctccaaaatccatctgttgtaaagttcattctcagtgaaatggtttttgccaggtgggccctattgggatgtgtttaggtcatgagggtggagccctctagtggaatacattaatgccagtataaacagggtttatagggctggaatctttctctctcttctgctggtctgtcctgataagacatggccttccttccattgaaggactcaatgccccaggcatcgtcttgaaagcagagaaagctgaccttaacctgcccatgccttgatctcaaactttccgtactccagaagtgtgagaaaatatatttctgttttttatgaattacacagcgacaaggaacctgttatagcagcttgaaagagaacaggagagacagctcacaatcagtgaggataagatgaggtatatacatatcccagctttctcatctctcaggtggaatagcccagaggaatttagtccatgtttccacatgtggttgatcttcagttatcctgagtcaggtgggtggttgatgtgtcttttaccattcatcttctgctcctgcctcactttcttcctttcctcccagtgtaaatttgctgcctaaacaggaatactcattgctggtggacccaaaataagacagaaaaaaaaaatcattgtacttttgtatgagggatatttctcatctgaattcttatcacttctctttctttgacatctaggaatattcagaaaacacttttttttaaccaatctattttagattgaatttattgattttttttcctgtgtgttttgtgaaccaaaaattaagttgtaagccaccaacgagctaaatggactccccttttggcagagagaacttcaaagaaatctgaaaaactaggttaggccatgactggcaggtgggtttggatgtgtctcattatgctctcttccctttggagttcaggcacaactgaccagcattatcattataacagagatctttggactgaggaaacagatgcttgtagcaataagataccatactccaacatgacagataataggccctgaagaaaatctaaaaattttactctaaaaatatttctttttctttttcttttttttgtttttttttgagatggagtcgcgctctgtgcccaggctggagagcagtggcgcaatcttggctcactgcaagctccgcctcctgagttcatgccattctcctgcctcagccttccaagcagctggaactacaggtgcccaccaccatgcccgactaattttttttgtatttttagtagagatggggtttcaccctgttagccaggatggtctcgatctcctgacctcgtgatctacccacctcggcctcccaaagtgctgagattacaggagtgagccaccgcacccaacctatttctctgaaatattctgaagtggccctgcaaagctgcgcgttgtgggagaaatttgcattctgtagagaatctcctatgcttactaatcattttccaaaggtctgactttttttttttaaggtctgacaagcaacgtctactttttctgctacccataggattcatctacacgaaaagaaccttggcttatctaaactcaagcacaccccgttatctaaactcaagcatttctttatggtgaattcaactctttaggcagagcttaactctttcaaccagttgccaatcaggaaaactttgaagccacctgtgacctggaagcccctgcttcaagatatcccacctttccagtacaaactaatgtatatcttatatgtattgatttatgtctttgcctgtaatttctgtgtctccctaaaatgtataaaaccaacgtgtaatccaaccaccttgggcacatgtttacaggaccccctaaggctgtgtcacaggccataatccttatctttggcaaaataaatctataacttgattgagacctgtctcagatactgttttgcttacactgggtcacaaaatttaaaaatcctctaaaactatctacacatccataaatctacattagaggcagtggagtgagcacactccaacagtcaaaactcacaagttagaggaacctgagtctaagattttgtccagctctcttgcttcataaaaataatttgtgatttttttaaattttactctagagaaggacaattttggggaatatgtttatggtcagtggaatgaataatgtccccaccccaaaagatgtccatatcctcgtctctggaacccatgttatacgagttattaagaaactattttaggcatatagagaggaaacagggtccttgggaaggttttgtttcttttaaagcagctccagaaatgtttcttgtttagcaggaaagccctggctcttagagctggtccggcaagcttttttttcttttttagagagggagtctcgctctgtagcccaggctggagtgcagtggcacgatctcggctcactgcaagctccgccctctggtttcctcatgcctcagcctcccaagtagctgggactacaggcgcccgccaccacggccggctaattttttgtatttttcagtagagacggggtttcactgtgttagccaggatggtctcgatctcctcacctcctgatctgcccgcctcggcctcccaaagtgctgggattacaggcggcaagctttgatatacaaatactggccattagaaactgggtccagccaaacatggagattcccacattcttcttctttttttttttttttttttgagatggagtctcgctctgtcgcccaggctggagtgcagtggaacgatctcggctgactgcaacctctgcctcctgggttcaagcgattcttctgcctcagtctcctgagtagctgggattacaggcacatgccaccacgcccagctactttttgtgtttttagtagagacggggtttcaccatattggccaggatggtctccatctcttgacctcatgatccaccttccttggcctcccaaagtgctgagattacaggtgtgagccacggcgtccagctcccacggtcttcttccttgccccgacatttgcctgacaacatggctgcccccacatatccccatgtgtgtagaactttatggcaccctgcatttgcatattaaaacactagggtgggagggccagttttttctcaagctacatgaatgacatgcttggtaaaaccaatcccctaagccctatgcaaatcagacaccacctccttcagcctcctcatataagcagccacttttccaccgcacatggagttttctcttagttctaatctcccctctctctgtctctgtacggtggagctgttttcttcttccttccttcttgcgtattaaacttttcgctccttaaaacaaccccacgcatgtccgtttctttttaaacaaacccgcgtgagactaagaacggtggtggtcctccagtcatcagagccctatcataaggattctaccttacatagcaaaagaagaacttgacaggtgtaagttaacgactttgagaataagcaacctggttatccagatgaaaccaatataatcacaaaggtcattaaaatagaggaggaggcttgcagagaggagctgggacaatatggaaggatgtggtttgaggagggaaggggccatagagccagaaatgtgggagcacctggaagataaaagcagaggattcagttctttcctctggagcctccagaaggaatgcagccctactgacaccttaacattagctcagtgagaatgctgacctccagaactacagggtaatacatttatgttgtgtgaagccaataagactgtggcgatttaaacagcagcattggaaactaatgcaaggggaagaaatgtctttcagctcactgagcgcgtgcttgtcttctgttcttggaaatatttccaccttgttttctggtgtcagttatgacaagagacagagaaaatttttccgagagaagagctaccacgagaattcgtttttagctagaaaatctcctgggtaaaatctcatgattatctgttatacgatctgggtatcacagagtttggggtcagatctcacaacatgtgataggaggaagagggttttgttagtttgttttcatattgcgagggaaaattagattttcaggacacaatctgagaaggacagacagagtcagagatattgtaagagaaagaggagatgtggaaggagtcagggcaatgaaacacgtgtcccagctcccaaatctaaaataaagtcattgattttacaaggtgaagaaaagctcttcaccttccatcttcttaggaaggatcaaattcttcccagagtccctgcccctccttcacccccctgacattgcattgtggagctaatcacatgtgcccttaatccctgctcctgtcccaggctgggagaggctcactgtcctcaccatgcccagcaggctagagctggtgccctaagcaccaaaggagaagaggatgatttctgtgcaggcaataagagctttaccgcattttacatttccctaaaattctaagcaaagttctgtggagagaagagaacatggggcaactttatctggtggggctggaagagaccaggctctgagaatgacaattaattcacatttctacttttccagatgccaaatgctagctttatcaattgtggaaatgtggactttgagtttaagaacaggtttcaggtactgcaataattgaggagacatttggaatagagtccttagtctagggctaaagtcagactggcagtgcctgagagcttccaggcgctggccctgggctgtgagggaagcagcagttctcctgagccacagggctgaggacctgggagcaaccacaggccttggccacagggctgcctggcaggggcttgagggaaggaaactgctcacaaattcacaggagctgcattaagcatatatcccgcagcctggcaagagtgaaagtctcagagacccagaccttagggctggggctgggattctgggctggctgctgtcggctctgccctcccttgtcctgaatgactggcaccctgctggagccaaaaatggagggtcggccaatgtcctcaaagtctttactcagccagaccctgttctgcttggaaagaaaatgaacacatggtatacaaataaacataaaatcatgtgtatctgtaataagaatttctaatataaattttacatattgaatacatatattttagaaataagttgtacttatacatttgcctatactatgtgtctatttatggataaatatgtggtacatgtttatatataaagatatataactttggttgctagtataaggtatagttttaaactttaataaagtaaacacgaacattgaaaatgagcactgggtgcaccacttcatggccctcctcactccagggcctaagggtgataaagctcaggaccctcttccatgtcccccggcatggacagcagtgaactacccattgctgaggatcatgagtgacctgagggggatctgcagaatcacagagcagcagatgcccagaagattgatagtttggaccctgaatggagggacattttgatcacagggctcagcatagacaagtactcttctggtcatttctgtcaaacaaaacagcacatgtagctcagaggctgcatgatcacaggatgaagcacctccatgagtcattgccagcttcccctctgactggggtgatgtgggatctctctgccccactttcatggctcaccagctgctgggactctgttgacagtggtctacatctgtcccacgcacaaacttctcaatagttgtcattttacttactggtctccaataaccacaaattgccagccatgacccttccacaaaaattgatggagtggggttggaactatgggttcagcaatgtgccagggcatgtatataagagaaacaaggtgtggccagcccatgtctgaagtgaggatgaattttcaccatgaattcggagtaggaggtggaagaaaacatcctgacatgctccaggcagtgatgcccacaagatacactagaagcgcccacagaggaggtgggaagggggtgtgagaaaaagagggagtgtgaatttacaggtgtctccagactgttcacctgaaaagagatcagacccttaacaacacctgggaccccaggcagagctgttgctatggaagatttgtgcaggacagggataggaggagggagcacctacctgtgatggcatcttggttgctgttggccagaatgacatcttttcaggcctactgtccctgacccaggcagggatcatgtccaggagggcagcaggagctcagagccaggccctggttctgctagtgccaggctaggatgttcttcatactctggccagctctacaggtgacagtgaccctctcccctgagacacaaggaggaggacaacgatggcatccacataacatgctcactgtcatccaagtgggggaacaaacatgcagatccccaaatattaataccgagtttgtagttcctccaacttggtgcaattctgatcagaaggaaaaacaggctaacaacttcatcagcagggaaagttcatgtttaatacaaactatctgaggctgaagcctgagtttcccttcctcaccaggcagtcaggacagcaggagcaaaaggagaaaagctgggtcccaaagtccacaaggtgcctcctgagactgatcctgcttagagaaggtggtgacagtggatgagtcttctgggactcccacaccaacataccctgagctggatggcttgagccatagacatttattgctaatttattaaacgtttattgtgaatgtattagaaccctggaaagttcaagatcaaagtccagaaggatttgctttctggtgagaaccctgcttcttgttttcagatgtcacccctggatacatcctcacgtgtgttcagcaatgtgccgggcatgtgtaagtaggagaagcaagtacatgctttcttcagtgcatgcttggaggctggtgaggggttaaggaacagatcgatgatgtttatttttactaggacacaaatcctattaaatcagagccccaaggttttcacttcatttcaccctaattaccccttcataacctctatgtctaaatacagtaattttgcaggttggagattcaaaatatgaatttgtgaaacacaattcagttcatagcaggtgtgctttgaggacatgcccaaggcagtaggaagggcaaggcgaggcttccagtctcagagcacagaaggcgttttcccaccactcagcacactggcagctcctcttaggtgatccaggtcacacatgagacgccattcccgccttgggggctgcctgctgataatggaacaatatcacccttaattttcactatttctaagatcagacttctattttatgtttattatggagtttgtccaatggccaggtttgtaacataacctccaatgtttggtttgtgacataacatcttatagaattttagatgctggtttccagtgagacttgatggagttttttcatgggttttcatggagttgatcttattacatccaccattatgctgcattctgtagggaacacaaaatgattcctctcctcaataaaccagtcacctagttgaagataaagggtgttcagaaaagatggtcacaaaacaattaggggctagattctgtgatccatgtgagatgccaatgatgtgattctggaaagcagaaggtgaggttgtgagataccctgcagcacataatgcccaaggctagggtggcgagtagagggcccctggtctggatctgtctacccagcttcattcctcccattcgtgaaacagtggctgcaccagccaggaagcatctgagaccacctgattctctggaataatagctgctgaggtttgtgctgtgagctataacactgtgagtctctaactgtaaccatttagattagcactaatgaaaataatttttaagatggtgaaaatgtctatatctatgctttgcaagtgtagccgttatatgtcatatgtgactcctgaacacttgaaatgtagtgaaaacaactaaggaactatattgttaattttaattaattccaatatacatgtttgtggctgggtactgctaatgttggccatgtgagtcagggaagttttagatggtaataaacagcaatgtcatcaggacaaccaatctgctaaatgttaagcaaagatgatcccaggaccattgcaccaagctggagtggacaaggtggaaagagcacgtaggtggatctttggaacccagattctgcttcctccaggtgaatgatgtaaactctctgtcttgaagacactgacattgaagctagcgactggggagctgagtgtttctcctggaagctgcagtggaaacagaacatagatcttccttagtattactcatgtccctctccataggcttcccagcagagaggtgctgtctgatcaagtgggaggtgaatgctgtgctccctaatcaatagtctttctcagtcccatgggacatatgaaccctgtcacatgcagcccacgcagttgaagccagagccccatgtccagtgtccagtgttgcctctgccttcggtgatcccaccctacaggacccagtgatgaaggcttgagtggcagggaagagctttggggagcctgccaactagcaataagggtgcagacttgggcttccagcttctgagcaagggaacattgtatgtcctaggtgtgatccaggtcaaggtgtttgataaaagatattacaataaattattttcttaagaaaataaaaacacagaaggcatctgattattataggactgtttgggttttataccactaaagtggtaaaaataaatttttcaatgcgcagtggtttatcaggaatctcccagcccctgcccttcccgtgatgattctgtagtctttgcaggttgtatggtcacttggtggcctccttaccgatcagatgcatctacagcacaaccctaagatcttccccgattaacatagatgagcaacttcaacctccagataccacataccattggctgatttttatgcaatttatcaacactgaaagtattctattccatttcattatgtagttattattctgtgcatggctcattcccctactgagtatcagtatttgcgatcaaaaattgttttatttacttacatgcactaaaccttaaatgatagcatttattagttctgaaaactctgacattaagttaaaatcccttaaaagcaactatatgcttctttttttaattagaataaatatggtgcaatcacctcaactaaggatactaaactacttttacagttgaaaatgattaattggacatggggaaacatattgacaaaagtaacaagcattattatgatgttgaataaacacagtttgcatgtaaagtgtacagttatgattaattgtattaaaacacaggaggaagaaaggtggggattgctggattggttggtgattcagtccttagaagcaagggggagctgatgagtgatctcaggcaggcatccaatataaggtccaaatatgattaattacaatgttcttttccttaaggtttgatattttaagctggtcctgctggggaagttttgagcacattcatggaatatgtggaataaagattaaaaacagtatatttcaaaatactcttaaaaagctcagaaacacccaaagaaaactattttataaaatatcatgccttcctcgcccattcttgatatttgtgtttaaccaagcatgactcacaattcaacttttctccacattgttgcctagagtgttgaagaaattcctctaataggacagaaatggagtcaatcttgcaatatctggccaatcgtgttctggccagtcttgctttatctcagaatgttacatttccagaaacttctacagttattcctgaaaactacaagcaagaaagggaaggagactgggatcattcaaggcaaaatggaacctgttctgcaaatactgtagtgaaatcataactcagtaatcgttttgtgactggcttatttcacttagtgtaatgtcctctagtttcatccaagttgtagcatgtgtcagaatttccctttttaaagctaattttgcctttttaaagctacaatatgctactgtatgtatataccacatttggattaccagttccctcctttgtgaacatttgagttgcttctaccttttggctattgtgaataattcggttctgaatgtggatatacaaatatatcctcaagttaatgtcttcagttacttgggtatatgtccaaaagtggaattgctgaattatatagtatttctatttttaattcttcgaggaattgccatctggtttcccacagcaggtgggccatttacatcaccacgacagtgtccacaggagttccagttccctaagttctcaccaagactggtcattttctgttggaaaaaaaatcctaataggtgtgaggtgggttttgtttttatttttctaaggattaataatgttgaccatgttttcctatgctagttttctaattatctctatagaatcttctttagagaaatgtcgattcatgtactttcctcatttttaatcaggtattttattttaaggttcacatataagacttatttttgtatagtagatattattaaccccttatcaaatataagatttacaaatgttttcttctattccacatgttgcattttcactgtgttgattatgtcttttgatgcccattttacatttttatgaagtccaatttatcttcttttctacttttgcctgtattttggtattaaagttgttagtatttaaatgtctataaatactgacttactatgctgagaaggtcacactgcaccatctctctgatggtggagctaagagttttacactctcccattttgtaccgggggacagtgcagctatgtgagaacccagtggctttacccagcttatttgtcttgcatttttggtgacatggattgttattcacattggcttcctctggcaggtccacctggaaagcattatatttagcaagaaaaaaggaggcagtgaatgatgtcactgtggactgtgtatattccctgttgcaaatgtcaaattcgtgaagcataaagggatttactagaggatattaaattccttgcaaattgttgaaaagccttaaggaacaggctccaggcaaagcctctagaacaattccaagaatggcactgctggcacaggctggggaggagctcctcctgcctgagactccacaacattcaagctgtctcctgcagaaaagagagcagctcttctcactactgcccccagaaggacagccgctctgctatcaactacgagagatctgacccctttctctgactgcccatcagatgtgttactacagagtgcttttggattgagatgagggagggaaaatgcctgatctcactcaaatgtgctcattttcctggtctgggtctcagccaggcagcacagtcctgtgggcacagtatcttcacttgccaggttcctataaaatgagagtatctttcttgactgtggaaaatatggggatggtaagggtcaaggaataggaaaaggagtacttggagttgcctgagctgccactctggtttccccaaatgttttcaatccattaaattcatgataataaacacctttctgcctaaccagccataatcgcttttcttagatccaaatgattctgtgataaaactaaagagaaaaaataaatacacttttcaacgtttaagctgaccaggaggctgtctctggtgtttacatgtccatatcccactatgcatttcgtcttccctttgcctcactggagatccaagtgcagggaatgcttcatatgactgtgatccctagaacttcatcctcatgactgttgaaatcttctctgagttttaccagtggaaatggcaataaatagaaagattccagaaggtcccctagggtccatattttctgtacttcctctctaaaatatgtaaaatcaattatatttgctcttgctttatatgggctacatctgtgtccccagcacacaccctaacgccctgcgttgacaacttatccagtattgtattaagtctaaataggcacatgtttatcatattatttcttccaatttaatgagataattgtcatgtcaaatctttggattaagaaccatcagccagaaaaccacagccctgagaaaatagaaatagagtatttcaagctgttcagtttgcacaacaatgatgattctatagctcatttacaagatataaatattctgtttatgggagtaagagcaacattcacggtgagtgttgtagaccctccgccacatctgacagcatagcaattcaatagcacaagggtttgtgtgccagcagtgcttgactaataatgggttttttttctatagggaaagctgcacctgtgcacatgacaggatcatgagctacactttacttcactttttttgaagtcaattaccttcttgatccaaagccacagtatggaagaacttcctgactctgatgaaggcatttggaaaatcctcaaataatattttatgcagtaacataaccaaagacaaaggaaaattcatatataggataataaccactgctctcctcatgttacatgaagtgcacttgaatcacctgacatcagctgttagtatgagccctgatgtgtggtagaatgttaggggctcaggaagggtcaattttcttggcaaattagtgttcaagagagccagtagccctgtacatctcagttagttgaaactcatattattgagtccccacagggacctccgtaacagtggttcatgaggttacctgggaaagtgggcaaaggtgactgactgaagtccatgtgttcaatcatcctcattatgaaaagccccctgctcattaatggcatttggattaatattcactgagaaagcatgtttttcgattatggctcatttttgaaacatctagtcatagctcttccaaaatgactttgtctgcaatcatcctgttgtgtttcttttaaggcctgatgatctgtcaaaaccaacaaccaatattattaaattgctgttctctttgcaatgtggcaatgtgatcatcagatgtaggccttgcagtttacccacggttaggatttttacatttccagggattccttgacaatggcactaatgtgacgccatctagcatccattgttgtgagaactctatttggaatatcatcattgtgggcatgaacataatggagactttcataggatgcaatgattaatattcaacattagtcaaaatctgctgtagtcctacccttggagatctactggtttggaaaaatattttaggtaaggacaacaatttggtaaagttttaaaaataaaggctaaaaagaaattttctttagcaagagtatgaactatctgtggtccagaataccatttttttacagatgcaagaaaaaattatttaaatgtatataatttagataataattttgtaaatttgtatatattgcatatataatagaataaacataattaaatatgaatactatatatacttatagccaacattttatcaaataaatatatattaacttctatgtatcttatatatatgcacatttttccataaataaggtaaattttaattttttaatgaaatactaattagttttaatttcatctttaattttctcttaataacttcataatttgattacttaatgttcacatttataccaccaatttaagaaaaaacacatgtatctatatataggcagaggtgtaaatactgtatcagtaagcttttatgcattaatgattgataatcggttaaatatacaactcagtggctgataactgtaaatatttgttttcatcttcatggatgctcatgttcacaatcatctggctgattaaggaagggctcagctgattgattcctccgcagggcactgagcttgtctttagcctacagataccaattttctgaggacgaggctgaacagcagtgactacacgtgacacaagattcttgtgacaggtcacaggagtgaacaacatcccaaaccgaactgcacagttgaatttaagtccaataatttctaacatagcttcacacattttaaatatattttttgatttcagtgagtacaaattttcaagaaaatgtttactccaattaattatagaggtgtttgatcattccatggacaagtaattatgttttcaacctttacaatcctgaaaatatttgcaaacgtaaatttgcattaataagaaaataaagctggatgtgttttcaacatgtgcttttaaatataatttttgaaatgacctcaaagggggaaaatcattttaacttatgtaactatccctttttacctctcttgtgtcctatagagttgcccaataagaggtcctcccatgagatttggaatcagaaaaggatgactcaatattctccattggtacctaaggcagacacaggaacagaggtgaggactagagaaacacctgaaaagatgctgtaggaagctgagagcatcagcacccccacccctaagcttccagacaggactgaggaccacatggttagaaagcccttacttcagggacagatgcattctgttttctgagggagcaccagagattcctgcttctaatatcagctttcctgactactatatccttggctttgaaaggtcatagtgggaaagttaatcataggaattcggtcattcttgtgatacccgacagagccaagaaaccaggagggaaaggcactcagggtgaaaaatactgtttctagaatgcaattgaaataggccctattatcccatggaactaaagtttatggttttttgaataaacagaaatcgactcctccagtcttaaaactcaagatagcaacatttatcttacctttcttttttttttttttttttttttaaatttcaggaaagcaaccatcaggcctcccagatactatcaatttgctgaaacttatatatcactgaatcgggacagtgagacatcagacccttcacccattatgattgcctaactgacctcctgcttcctgttgacccaattatctttcttaaccctccctaactcctgtttttccacatttcttccttgttatataaacccctaatttcagttggtcagagagatacatttgagaatggcatcccatctcctcagctgcagcacctgattaaagcctggggcttgaaaatacttgtcttagtgattggctttctgtgtgacgagctgcaggatctacaccgaatccctggcatttcagtaacaaaattctctgcaagcttcaccgttttggtttattgtaacctgaaatcaaatttatccaaaacttctgagataacttgatataattctaggattcactttgtccaccactgcttaccagtctgagcttgccagctcccaacccttcctagtgccaatgagctttctcaaaagagccataggtaacattttccctttttcataaaatgctaaatttctctttgttcttccaacatattgaagaccactgagttttcctgtatgccccatttggcaaatatttctttgcaaataaaacattaaatttagagattcatctctacattttatttagacttcagtagtttactctaattctctgtattaagactatatctgcttcaaatatctatagtggcttcttctctgttatacgaattccaactgaagccataaactagactcttcaggtgtcatgatctctgtctttattaaatcaagagaggcattgctagaactgtgcagttggggctgagaaagagaaaagaattagggtgcagaggtgacttcgtgtccccctctaccaacaccatcagagtgtggctgcatctgaggaacaatctcagccaatggaggcatcaggaggagcagctggggcagcccagtctcacacatctgcttccctgggggtttctgttcgggtgtgtaacactgtgggagggtaattgtaatcttgtagacagtaataagttgcaaaatcttcaggctgcaggctgctgatggtgagagtgaaatctgtgccagatccactgccgctgaaccttgatgggaccccactttgtaaactggatgcagcatagatcaggagcttaggggctttccctggtttctgctgataccagcctaaatcatttctaatgccctgacttgcccggcaagtgatggtgactctgtctcctacagatgcagacagggaggatggagactgggtcatctggatggcacatctggcacctgagattggaaacacaaaaacaaatggtccacacaattaatcatgtagtaagagaatttccctgaatagccaggctgtgctgagcaccctgggctgagtaaactgccagtgttctccatccttacctgggagccagagcagcaggagccccaggagctgagcggggaccctcatgtccatgctgtgtcctgagtgggtctgactcctgcacagggtgtgatcagcctgttaataagtcttcaggtcaggagactgtgctctgggaacatgcaaatgagcaggggaaggggcaggctgggcacagctgcagggctggctcatctcagtaactcagcaccggctcagtgtccccaggtgtcccaggtaagaccagggtagcacaaatttgtctgcagagaatgtgtttctactggggactattttgttatgagaaacattttaaagatattttttgacaatattcctcgagagtcaatggggtaatatatttcattggtgtatggggattattttggagaatattcttgtttgtaggaaacacagtacatattagatggtacgattctcaggtcttcaaaagactgttataagattccatttagggaagggggtaattgtgctatacttgaaacatttctgtgagtttaacattgttcctttctaaaaaattaaaaataaaatttattgacatgatgctatatatatttgtaagtattaggtaatggtgttatgccattgttcttaccagtataagatcaaacaatttactacagatacacacccctgatgccgtgcttcttcaatgcatgtggcactaacagccccaccattatcaagagctacaggtctttttaatacccagagactaaatgggctgcacctgtgtagaatttttgcatccctaacttaagtactaatagattgcttttgattggaagccttagcaataaaataaatagttgattaacatgttttttaatgttatatatattatatactctattattccaataaagtatgctaaagaaaaaaatgttattaaggaaaccataaaatagagaaaatatatttactacttattaagcatttgcttacaggtgacacacacagaacaaaatataagtgtatctgcaaatttcaaacccaagttattcaagggttaactgtaccatgatgaacgtagcagtccccatctgtaatctagggctttcccctttgctgtacctctactcatttccaatgaccatatatatgtcttatgttctttatgatcttgggcagagaactctgcctggatgcattgctggccagatggcctggaatgtgtatctcttaggaaagtgctatggtttgactgtgtcctccagaatccatctattgtaaagttaattctcagtgtaatggtttttgccaggtggggcctattgggatgtgtttaggtcatgaggctggagccctctagcggaatacattaatgccactataaacaggaattacagggctgagatctctctcctgctcctctgacatgttaagacatggccttccttcctttgaagaactcaacgctccaggcatcatcttgaaagcggagaaagcagaccatgtggttgatcttcagttatcctgagtcaggtaggttgttgatgtgtcttttaccattcattttctgttccctccctcactttcctcctttcctcccagtataaatttgctacctaacaggaatccttattgctggtggatccaaactgagagagtaaaaaagaaaagtcattaatcttttgtatgaggggtatttctcatctgaaatcttaccatttctctttctttgatatgtacaaatattcaggaagcacctaatttttttttttttaccaatgtatcttagattgaatttacgctgtgattttttttctgtgtgttaaaacaaaaaatcaagttgtaagccaccaacctactcaatgggcttctcttttggcagagagaacgtcaaagaaatctgaaaaactaggttaggccatgactggcaggtgggtttagatgtaactcattatactctcctccctttggagttcagacaaaactgaccagtgttatcattacaacagagatctttagactgacaaatcaaatgctttgtagcaataagataccatactccaacatgacagataataggccctgaagaaaatctaaatattgtaccctaaaaatattttttttgatgtattctgaagtggccctgcaaagctgcctgttatgggggaaatttgcattctgcagagcatctcctcctcttactatgtcttttccaaagagttggacatttctttaaaggtctgataagcaacattcaccatctactttactgttacctgcaaggttcatctaagtgacaagaaccttgacttccacacccccttatctaaactcaaggatttctttatgatgaattcaactctttaggcagagcttaactctttcaaccagttgccaatcaggaaaactttgaagccacctgtgacctggaagcccctgcttcaagatatcccacctttccaggacaaactaatgtatatcttatatgtactgacttaggtctttccctgtaatttttgtgtctccctaaaatgtataaaaccaacgtgtaatccagccaccttgggcacatatttgcagggcctcctaaagctgtgtcacaggccataagccttatctttggcaaaataaacctatacattgattgagacctgtctcagatactgttttgtttacactgggtcacaaaagttaaaaatcctctaaaactctctacacatctataaatctacattagagacagtggagtgagtatacctcaactcaagtcatactttgagtttaagaaccagacagattttcaggtacttcgataaatgaggagacatttggaatagggtccttagcccagagctaaggtcaggctggcagtgcctgagcgcttccaggccctggccctggtctgtggaggaagccactgttctcctgagccacagggctgagaacctgggatgagccacaggccttggccgcagggctgcctggcagggtcttcagggagggaaactgctcacaaattcgcgggagctgcattaagcatatatccccccagcctggcaagagtgaaagtctcaggacacagaccttagggctggggctgggatcctgggctggctgctgtcagctgtgtcctcccttgtcctgaatgactgggaccctgctggagccaaagagggagggtcagcaaatgtcctcaaggtcttcactcagccagactctgttctgcttggaaagaaaaggaacacatgctacaaaaataaacataaaattatgtgtatttgtaatatgaatttctagtataaactttacatattaaatacatacattttagaaataagttatatttatatatttgtatatactatgtatctgtggataaatatgtgatgcatgtttatgtataaagagatgcaagtttcattgctagtataaggtatagttttaaactttaataaattgaacgtgaacattgaaaacaagcactgggtgcaccacctcatggcccctcctcactccagggcctgagggtcataaagctcgggactctcttccatgtgccccctgggccgatagcagtgagctacccattgctgaggatcatgagtgacctgagggggatctgcagaatcacagggcagcagatgcccaggagatggatagtgaatttggaccctgaatggagggacgttttgtccacagggctcagcacagacaagtccttttctggtcatttctgtcaagcaaagcagcacacatggctcagaggctgcatggtcagaggaataagcccctccatggctcattcccagcttcccctctgactggggtgatgtgggatctctctgcccagctttcatgactgaccagctgctgggaccctgttaacaatggcctatgtcagtgccatgcacaagcttcttgatagttaccattttactttctggtctccaataaccacaaattgccaaccatgaccgtttcacaaagattcatggagaggggtcagaattatgggttgagcaacgtgccggggcatgtatgtaagagaaacaaggtgtggccagcccatgtggaagtgaggatgaattttcatcatgaattcagagaaggaggtgggagaaagcatctgacatgcttcaggcagtgatggccacaagatacattagagatgttcatagaagaggtggcaagtgggtttgagatgaaaagggaatgtgaattcagaggtgtcccccagcctgttcccctgagaagatttcagacccttagcaacccctgggcccccaggtagagctgttgctagggaagatttgtacatgataggggacaggaagagggatcacctacctctgaaggcatcttggttggtagtggccagagtgacatctgttcaggcccattattatccctgacccaggcagggatcatgtccaggagggcagtaggagccagcaggagctcagagccatgccccagttctgctggtgccaggctaggatgttcttcatactctggccagccctgcaggtgacagtgaccctctaacctgagagacaaggaagaggatgaagatggcatccacataacatgctcactgtcatccaagtgggggaacaagcatgcagattcccaaatattaataccaagcttttatttcatccaacttgatgaaattctgatcagaaggagaaacagtctaacaaattcatcatcaaggaaagttcatgtttaatacaaactatctgaggctgaaacctgacttccccttcctcaccaggcagtcaggacagcaggagcaaaaggagaaaagctgggtcccaaagtccacaaggtgactcctggggctgatcctgctcagagaacgtggcaacagtggataagtctgccgagaatgccacaccatcatactctgagctggagggcttcaaccacagacatttattgctaatttattagacatttattgcgaatatattagaaccatggaaggttcaagatcaaagtccagaaggatttgctttctggtgagaaccctgtttgtttccagatgtcctctctggatacatcctcatgtgtgttcagcaatgtgccaggcatgtgtaagagaagcaagtgcatgctttactcagtacacgcttggaggctggtgaggggttcagtaacagctcaatgatatttctttttattaggacacaaatcctattaaatcagaaccccgatgttttcacctcatttcaccctaattacctcttcataacctctatgtctaaatgcagtaatattggaggttggagattcaaaatatgaatttgtgaaacaccattcagttcatagcaggtgcactttgaggatatggccaaggcagtaggaagggcaaggcaaggcttccagtctcagagcacagagggcattttcccaccactcagcacactggcagctcctcccaggtgatccaggtcacacatgagaccccattcctgccttgggggctgcctgctgataatgaaacaacatcacccttaatttcactatttctaagatcaggcttctattttgtgtttattatggggtttgtccaatggccaggtttgtgacataccacccaatggcaggtttgtgacataacatcttatagaattttagatgctggtttccagtgagacttgatggagttttttcatgggttttcatggagttgatcttattacatccatcaataggctgcattctgtagggaatacaaaacgattcctctcctcaataaaccagtcacctagttgaagataaagagttgagaaaagatggtcacaaaacaatcaggtgttaaattctgtgatccatgtgagatgccaacaatgtggttctgggaaagagagagtgaggttgtgaggggccctgcagagcacaatgtccagggctagggtcgggagtagagggcccctggtctggatctgtctactcagcttcattcctcccattgttgaaacagtggctgcaccagccagcaagcatctgagaccacctgattctctggactaacagctgctgaggtttgtgctctgagctataacactgtgagggtctaactgtaaccatttagatcagcactaatgaaaataattttttaatatggtgaaaatgtctgcaaatttctaacagaaaaattgatgaaaagatggtttttcttaggcccccacagcagtctctgcctgggacctgactttgtctttgagccagtggaatctatgctgagattgtaagctgggcagggaaatcacagcagggcaggctgtgctctgggtgctgaggaggacaggaggacactccttcagggttagtgatgctgggagttcgaggggagagactgcatggagctgcctgtgaatcgccctagcaatgccctctggacactgctcatctcacaagtgtactcggatgccagtggatggcccaaacatgggctcaggttggacaaggacaaagatttagggatgaatatatggggctcatttgatactctgaagtttcagcacaagcataacgaattatatggggagagaaagaagtcacaaggttgtgatttttcatttggtattaaaatatatcccctctgctcatttttccctgcagaatgtaactactgatacatatttaagcaaagtcactgtttttaattgttttagtaactgacagcctgtgtgcacagttcctaagtaactgggtagccagaccatcattcctatggtaaagccaggaagtgactgtggatgtgaacaaatgtgagtttaatgtacatgtctccaaagccacgggccactgatctagggagaacctgcagtcagtttgctttcccatgcccagatgagaggacaccttgatctgtgttcttctgatgaactctaaaaactctaaaaactgatgaactctaaaaactaatattctgaaggtctagttcatacttcttttctttgctagagggactctctcactcacatgtattgtactctctgcatagaacagtatgtgatacatacaacttgttttctgctaaatacccatcaatcatgtcattcatgagtcttccatagatgttacctgccctatgaatctgggctcttccaaaagaatgggccagaggtggagctgtgctttcacattctcttgtgcttccctcgtggacaacctttgctagttgtcacccttcccacccagcaaaagtaactgtctttctgacatctacacaatcatttaggttttcctgtcttaaacttcatataaatagcattatgtgtatttttatctttttagtcttggtattattccttactacttttgaggccttcatttcttccagtggactcaaggtcctgtctgatgtcatttcctgtgattctgaaggattttctctcaaatgttttataagacatagctgctatgaatgaatgtattttgtttaccaaaatttttttttttgcctttttgttagatttgaaggatattttcactggatagatttcctggctgccttcttttttttccttttcagcatttaaatatgtcattttactgcttctagcctctattggtcccgatgaaaacttagccaatggctacgttgttgtgtctctgtatatagtgtctgcttttattctgatgcaatgaagattttttctttgtctttcaacattttaatatagtgtgttcacttattaatttctattgactatctaaaagggttttattgaattatttcatctaagaatattttttattacttttgaaaagtttttgtcattgtatctccaaatattttttcagccactttctctgtctctccttctttgtgactctcattatacatttgttggtatccttcactctgagctataaatctctgacatttcttcctttttttctaaacattttctttaggctcaaacatttccattcctctattttcaagttaactgattgttctgtcatctcaatttgctattagacctagctaataaatatttaaattgtattatggtacttttcatttctagagttcccatttggtcattttttatactttccatttcttttcttgaggtcctacttgctgaatcttctttttaaaaatattttcgtttttatgtcaatgatcatagttttaaaaataattatttgaacatctgcatattaactgctttgtagtctttgctaaagccaataatgaggacaagttagaatcagctttcattggctattttctgttgtcattattgtagttgctttactttgttccttcaatataaatcatactcctctgtttttttttcaggattttttaaaactgaaagctgcacacttttgataatatattatagtacctctctttagattgtggggtttttattttaattttaatttttttagaaacagggtctcactctgtcacccaggctggagtgtggtggtgtgatcatagctcgctgcagcgtcaacctcttgggctccagtgatcctccagcttcatcctcctgagtagctgggactataggtgcatgccaccactctctgctatttaaaaaaaaaaatttgtagagataagggtgtcactattttggccagcctggtcttgaactcctggcttcatgtaatccttctgcatcaggctctaaagtagtgggattacaggcttgagctaccatgtcaggcctggaactggtttcatttttctgagcattttaaaatttttttcttagttacttgtcagaacttacttctggtacctgacttatgatagttggagttatcattttttgactttcagatggtgtgaaagtgatatgcattcaagtagaaatagtacttctagtatttatacaactattctatcttctctttcaatagagtattcaataaattgcatgagatattcaacactttgttgtaagataaggtttgtgttagataatgttgccctactgtaaactaatgtaagtgtactgagcacatttaggatagaataggctgagctagtggattacatatattaaatgtattttcaatgcatgatattgaaaaatctatatctcatatggtgtttgaccactgatatctctgctttttattcttaatatttagtttgaatttatagaaactgcacatgtatctgcacagcttagtggtcaccaatgatttgagaagaagttttgctcaaatatctggaggttataaatctatcttctgtcaatccatctgtgtgtagtttaaaaagctcctgcaaaatgcagctagttcttacctccctctggttttactttgcaccgggcacttctgggtctcatcactcatatctatagcttctaagtcaccaggaatgtgtgtagagattgtttcagcaatatggctctatcttacccaggaatctgctatttactgttagcaggtgtactacttgccccaaacagggcatcatctttgactaacaaagctgtgggctttttctgttcattccctatggagttctgcatgtttagctggaaacactgaagaattttacttcattccttggctttactcaagttcacccgctttggcagcaagctgctagctttatttgctatcctcatattggtaaaactccagttctgtatttcatgctgactgagctgggggtagaagggtgctgtcacaggcaaaaggctacagactttttctgtccttactcaaagcactagtacttttttttctataaagaatatacatctttaattattttatgcttcaccaattttcagagtgctgaaatagttttgatattttagctttatatgtgtgtttgttatttatttttgcacagaagatttattaaactctttgtgatgccataaacagagatgccttctaaaatgcatttaaatgaacataatagccatgctgaaatggaatgaggttatttactaacataagtaattttggacttgagaacttgaactcttcaccctcagtttaaagagaaaccaaggacttaaaaaatagagaatcctggtccctggatttcacattcatgaagaaatgcacagtcaatttttaagatgccttctttgtattctagaactgagcaaattagtgattacactctacataatgggagctatgattgtctttaatagagataagaattagaaataggaaaaggtagctgggtgcggtggctcatgcctataatcccagcactttgggaggctgagacgggtggatcacgaggtcaggagatcgagaccatcctggctaacatggtgaaaccccgtctctactaaaaaaatacaaaaaaattagtcaggcgtggtggcgggtgcctgtagtcccagccacttgggaggctgaggcaggagaatggcgtgaacctgggaggcagaggttgcagtgagccgagatcatcataccactgcactccagcctgggtgatagagcaagattccatctgaaaaaaaaaaaaaaaagaaagaaagaaataggaaagtgcaaaataggaggaaacttgtggaattgtttaaaaactacctttttcttattttttagttacttgtgtgtgtgttttaagtttatgtggaaatacttttagacctaaaatttgaaaaatatggtaaaaatgattcccatatgcgcctctttcagcttgctctaatgtcagcatcataaataaccacagtataagtatcacaaccatgaaatgaacatagatataatgttatttgttaactcatttaaaataccatatggatttcactgatttttcctgttgatgactttttttatgttacaagataaaattcaggtttctgtattttatttggttatcctgtcctcaatatctttaaatctgtgatagtttttcacttttgtttctctttcatggccttcaaacatttgaagtttactgtccaggtatgttgaagaatgtcctcctagttgggtttgtatatggtgtttactactgattcaattcacaccattaatttttggcaagaataatacagacaggatgtatcctcagtgcttcacatcagatgttacataatgtcaacatgtcttataggtggtaataaacgaatatgatcaatgaaatcccatttggaaggaagttttggacaaaaataatgaaaacaactgcttctatcactctttctactaggtcattgcagacgtcattaggaataatctatttcttccttatcgaatatgtactttattttaacaaactttaatctttttacagtctactgcatcacagagaaaattgaagaaataatttagttaacttttaaatggcaaatgtttccataataaccatttgccactgaaatgttgatagcctgaagaaagaaaaagaatgggatttattcagccatggtagtatcttcacatgaacagcttttaccgagtcaactatttggataaataaatagaattttctactacttagaatgttgcaaaattcaaatggagcagtgtagcatgcactgagctacctctactgggaaagttaagaaccactgaggctatataaggattcatacagtgagtcactatttctggaaacctgggattctggtgcctcagttgaacagagtccaagaatcaaagtccaaattgttcaatgatttttttttagaactgcaaaatgtccaaatagagcagagacgctaaaactgagtggccaccacattagctgtctgtaaaggaagcagctggtaaaatctagtaaacactgatggtcttgttgaggtttttgtttcatgttgaatcactgtgggaggtaagttataatcctgctgacagtaataaactgcaaaatcttcaggctgcaggctgctgatggtgagagtgaagtctgtcccagacccactgccactgaacctggctgggatgctagtggccctggtggatgcaccatagatgaggagcctgggcgcctggccaggtttctgctgataccaggttaagtagctgctgctaacactctgactggccctgcaggagagggtgactctttcccctggagacaaagacagggtgggtggagactgtgtcattacaatttctctggtggtatccaagattggaaataaaacagaaatgcactcatgtaatctagatcaaaccagctgtctttgagtagagccaaaattgttgatctacattgaattttaattatatttcttgctgagcagaggtggcaggagttttcactgatgtgcaaaaccacctcatgttcccctcacctgggagccagagtagcaggaggaagagaagctgagctggggcttccatggttccgtctgggtcctaactgagcagttccttcccagggctctgacccaggcattgatatgggctctggaaggtagggcagctgggagggacatgcaaagcagctgggtgggagctgagcttccagctgcagagaccacctgcttcttcctctctgcactgagcgtcctgtgcctccctggttgtcaggccagaaaagtctgttggctcagtctgagtgtagaactcctcccttgtgctcacataatttcactcctgtgcctttcttctcttcaatcacctaaatacacccgtatgatatttggcacaagtctgttaagaacaatataaaaggctgtgttttcatttctctcttcctgtcctcagtatgcccagtcatctccctaagtgcattattggatctatggaaatgaagagtctgttagaacttaatcttccagatagacattttttttttttttttctgagacggagtctcgctctgtcttccaggctagagggcagtggtgcgatctccactcactgcaagctctgcctcccgggttcatgccattctcctgcctcagcctcccaagtgcctgggattacaagcgcctgccaccacgcccagctaattttttgtatttttagtagagacggggtttcaccatgttagccaggatggtctcgatctcctgacctggtgatccacccgccttggcctcccaaagtgctgggattacaggcatgagccaccgcgcccggcccagatacacctttcatttgcttattagtaatgttttctgagggtcctgaagctttccattaacccagacacataccctctttgagttaaaaacttctgtttacagtcacatgtcctggcagccctgacatagatgctccatggcttgccgattgcttgaaattaatcaagtaacttaacttccctgtgtctcggtttccatatctgtgtaactgtgacaatagtggtacctgccttacagtgctgtagacagtttaaagaaaataagataaaacatttacaatagtattcaggacattatgtatgtggcaattaattttgttttcattgtttaaatattcagcactacagtcatcatcattataaatatacttagcatggaaaatagtcttaaatctaatccaagaatgttttatccacagtcaaattaaattctaaggcattttcttcagtaactgtacacaactcttaaaatcctaatgatttgatcttaatctgtgctaaagtactcagaccttccatcattcccatccatccctgtctaacgcattacttctcatcatccattatttaaatgttaccctataaacggtccccatgtcctgttgctgtccttctttcttatgtaatctttattctaccttgttatcttttatgttattcttgccccaggactgacaataaggaaaagctaccatcatttcttgtagacttgctccagtataattttttcaggcttgttgtcttggaaatgaggattgtgtcttgcaaagaaacatattcattgggtcaatgtgttatgaaataaaagattttatctacttatgatccaataattaatttagactgacttgaacagatttttaatgacaaaaaggagaagacgatataagagaaaaatttaatacaatagaaaacacaagctaatataacgcttgcttcatggatttttacatgtatattagacatatgctgggtatatgtgcgcaacgacaatctaaaaactgaatgataactagcttaaggaatgcctgcattacactgagtcttgcccacttttccagttatgaaaagaaagctacagcactatttgtatgagtatcaaaccttctagatgctgtgatagaggtagagaagatttactgagaccaaagccttggaagtagtagatgcttgttctatgatattatgtggctgtggttgccgttgttaggaaatacagtgggagtgaaagcaaggagaagatttacaagctctgctcttcctcatactcacaaccccctctagagatggacagatgttggtccaggaatctctgacacctcttagaagccttttgctctttccagaatgtttcctgacaagtattgttttgagtcacagattaggtgaaactaggtgtagaagaaaggactagagcaagggaagaagttttccatcccagacagttgttgtaggaacagggaaattgaatttttcatagatttatgtgacacttgtatcatgttggggagagaggcatcaaaccaggctcattactgaaagaattattacgttatttaagagagaaagaactgtgaatttcttgtcaaatagatgtttaaaattcaaaactactattttttttttggagatagaatctcactctgtcacccaggctggagtgcagtggcacaatcttggctcgctgcaacctccctctctccatttaaagcaattctcctgcctcagactcccaagtagctgggattacaggtgtgtgccaacatacccagctaattttcatatttttagtagagacgggattttgccatgttggcccggctggtctcaaactcctgacctcaggtgatctgcctgcctcggcctcccaaagtgctggaattgtaggattgagccactgtgcctggccctactgatgtattaatattattcatcttcttgaatacaccaagtggtaaagtgcaaatccacactttaaacttgagatttctcctcctatgtgaattatactagtgaggaacaaaaaaattctctgttggtggggagatgatgtttgacagcggtcagtttgtgaagcagaggcttatgtcacaggactttttacagtattacatataaacatggtgaatggcctcaaacacagaagaatcagcttttttcatgagccatactaccaccaagaaagaactgaattgaaacctgtgactacttgatgaagggtgtataaagaagagggaaagatttgggaggccaaggcgggtggaccacgaggtcaggagatcaaaaccatcctggctaacatggtgaaaccccatctctattaaaaatacaaaaaaattagctgggcgtggtggagtcccagctactcgggaggctgaggcaggagaatggcatgaactggggagtcggaggttgcagtgagccaagattgcaccactgcactccagcctgggtgacagaacaagaatctgtctcaaaaaaaaagaagagggaaagaaaaatgacacaaaacacaatgtcataaatggaaaggaagaagtcattacacagcctacaggagtaaaaaaataaagagaggatattatgagtaattttatgtcaactaacttgacaaaagtggtgcagggcaggttcttggctacactcaggaaggaatgcagcgtaagctggtggtagaagaaaacagctttactgaggtggcagtgttacagctttgtgtctgttcttgtgaaacagagctaccacataggcattgtgccaagagcagtagcgtaggggcagttttgcagtcatatttatccccacttttaatgacatgctaataaaggagtgggttattcaggaatagctagaaaatgggcagtaactttcaggttttgccatggcaatggtaaactgatatggcactggtgggcatgtgttatggacaggtgcttccagtgtctcttccttgtgtcagccagtcttcaatctggtcctgggttgagtcccacctacctcctatctcattgctccctcagagattagatactcctccttaatcttaaggggactgcagaagagcagagtcccttttctgtaagtgcttcctgctgactttatgggggcaggccttccctagcctttgaggagtaaaaatctttggtacctgaactaaggggcccaatggcacgatgcattcatttgtggggtcagaagacagaatgggttggaagacttatgacagaccgtatcatctttacatgaaatttagaagacataaactttactaggatgttaaacaagaaaattataattggaagagagggaaaaattaatgctcctaggtccacctacggaaccatgttattaatccatgtgtttgcaaaacaacaaccttaagttttctgttttataaatggaggttgtggtgtcccccttttgtggctgtaggaccttgtaagaaacaggtttaatcctgggcagctgtacccaactagtggcttcctgaagcctaacagtaattaagagtaataaagaatatctgataatggctccttattctggttattattgattcttgggggatcattttgttgttgttgttgttgttgttgttgttttttgagatggagtctcgctctgttgcccaggctagagtgcagtggcacaatcttggctgggctcactggaacctctgcctccagttttcaagctattttcatgcctcagcctcctgagtggctgggattacaggcatgtaccaccatgcccagctaattttgtaatattagtaaagatatggttttgctatgttggcaaggctgatttcgaactcctggcctaagtgatccgcccatctcagcctcccaaagtgttgagatgaaaacgtcacaggagctgatgaaaaaggaaaaggagacagcaatgatcccaggcctttttaaagggagaacaagctgaaagcagcaaaatacaacagttaaatctctaagacactaatctcagaagttttaaaagaaactcattatcgtatcacaggcaaaattttttgttttacttgttttttttttttttttttttttttcttttttttgagatagagtctcgctttgtcacccaggctggagtgcaatagcgtgatcttggttcactgcaacctccacctcccaggtttcagccattctcctgcctcagcctcctgagttgctagggttacaggtacatgccactgtgcctggctaatttttgtatttttagtagagacaaggttttactatgtttgccaggctggtcttgaactcctgacctcaaatgatcctcccaccttgggattacaggcatgtaatcccaaagtgctgggattacaggcatgggccaccatgctcagccttaaagctgtatttttattaagtaaagtgtagaagaaaaagtgtaaataaagtgacagaaggaaaacacaaggctgttatggaaaatgataaccttagggcagaaaacaagaaaaggcaaaccaagatttccatagggtgaggctccaatccacaatcctcggatgaatgtcaatgctaaaaaccctggagcctccagggagtggccaacagtactaaatgctgaaaacccagagtacacgagtatcagcctatgaatgtcccacaccaaatgccaggaaaccctggagtatccaggggctgaccagtgcagaaaatcctggagcctcagtggggtggccaacaatgagccccaaaggcctggttggggccatagaacaatgtgactctggcttcttagagtcaacagaacaggagaattcttacatccaagtgtcctgccttaaacaattgcacaaacataattagtagggacccaaagaaaaaactgcaaagcaaacacatatatcaggacagaaaataagataaaatggctgatggataaataaaatgtcattagaggagaaatgactaagagaaagatcaatgaggatgtagtcaggtgtgctatgggggacttcaaatggactatttagccaaaggccttatttcctggaccatctgacatagggcaggtgggtagatgggacacttacaggtgtgcaggagccaaaatggtgccaagcagtctctaacatgaggcctgcgtgaagatctctccaggctccccagcttgggtgggttgaactcccacgggtgaactggtgcatggagcggctggcctgcatgaagcagtggctctgtggccacttacctaactgctcagctccaccgcctgtcaggaaagatgatggctcttaaaacagcctttggccagtgttaacagctctgcaatgttagcaactatgtagctttaatcgctgtagcgccgatctcgccctctctcactgatcgctgacttgccacttctccaatagctgtctcgcccattgctgatcgctatgtccatcttctcacaaaatgccatctcttgctgtctcttgctgtcttgcttctccactgtttctgctgtctcaccaccacatcaaacactgcctctcaccatgtcccatttatcctccctccttattaaacatccatctgcatgtccaggcctggcatccccaggctgatgtctctgtcctgggccaggtactggagagtattgttcctccaacttcaccaataagccatggttctctcaaatcaaattatctcactgcaccaattttgccaaggtttgcagtgtactggtcaccaacttacccaaatctactgggacacaattcccatgcacaacgagtaacatgaagtggattactacctacagagagtcagtcagagagagcacaaagctgccggggcctgattgacactagactgtgcctaccccacaaggactgcagctgagggaccctggaatgcagcctaccctgggttttatgtcttagaatcacatgacacactgggctggagtgttgaaggaattcctgtttctagtagggacagaaacagaacccaggctgttctggccaatcatgccctatctcagaatgttacagttccagaacattctacagttattcctgaaaactacaatcaagaaaaggaaggagactgggttgattcatgactaaatggaaactgttctgcaaataccacagtgaaatcaaaactcagtatttttgagactgggttatttcacttagtgtaatgtcctctagttccatccatgttgtagcatgtgtcagaatttccctttttaaaactaaataatatggaatagtatgtatataccacatttggattaccagttccctcctttgtgaacatttgagttgcttctacatttagctactgtgaataatttgcttctgtatgtggatatacaaatatctcctcaatttaatgtcttccattacttgggtatatgtccaaaagtggaattgctgaattatatagtatttctatttttaatcctttgaggaattgccatcttgtttcccacagcaggtgggccatttacatcaccacgacagtgtccacaggagttccagttccctaaattctcaccaagactggtcatcctctgttggaaaaaaacattctaacaggcatcaggtgggttttgtttttatttttctaaggattaataatattgagcatcgtttcctatgctagttatctaaatatctctaaagtatcttctttagggaaatgtctattcatatacttttctcatttttaaccagttattttatttttactgttcacatgtagaacttatttttgtatagtagatattattaaccccttatcagatatgattttcaaatattttcttctattccacatgttgcattttcactgtgtaggttttatctcttgatgcccattttaaatttttatgtagtccaatttaattttttcttcttttgcctgtattttggtgttaaaggtgttagtatttaaatgtctgtaaatattcacttactacgctgagaatgtcacacttcaccttctctctctgatggtggagctaagagtgttacactctcccattttgtcctaggggacagtgaagctaggtgagaacccagtggcttttctgagcttatttgtcttgcatttttggtgacatggattgttgttcacatcagcttcctctggcaagtccacctggaaagcattatatttagcaagaaaaaaggaggctctgaatgatgtcactgtaagctgtttatattccctgttacaaatgtcaaatccgtgaagcataaagggatttactagaggatattaaattccttagaaattgttgaaaagccttaagcaacaggctccaggcaaagcctctggaacaattccaagaatggcactgctggcgcaggttggggaggagctcctgctgcctgagactccacattcaagctgtctcctgcaggaaagagagcagctcttctcactactgccccccgaaggacagctgctccgctatcaactactagagacctgacccctttctctgcagacctgcctgtgttgattacatcttcatttcagtctcatgtagattcatctgttttcatggattcaggggctatttctgcccaagtccaccctgtggctttctatcataaatacacatctttctacactcgaatttctagtcattactagtatcaacagcaacatgctagaacctcacataaagatttcctttacaaagaacatcatgctccccacgtagcattgtgctccccagaatgtggggaaagtccaatctgttcagcccaacaccatgtaggaaaaaaggctcttctctcatgagccgttaatctgtctacttattattaatttgtgggctaaactataaagactggtaaaaatagcacttcgaattcttttaacaaaagggtgtaaagaaaagattaaattatttaacatgcatatatgcatgactcatttcgttattgtcaccagcttctttcatatttattttattctctagtttctggcaatactttctctatggtagagtctggaaaggctactcctcatgtccttggcttcctaagtcccagatgtggtgaagaatgcccatcagctgtgttactacggagtgcttttggattgagatgagggaggggaaatggctgaactcactcaaatgtgatcattttcttggtctaggtcacagccaggcaacacagtcctctgggcacaatatcatcacttgccatgtttctatcaaaatgaaagtatctttcttgactgtggaaaacataggggtgggggcggggagggtcaagtaatagcaaaaggagtacttggagttgcctgagctgccactctggtttccccaaatgttttcaatccatttcattcatgataataaacacctttctgcctaaccagtcataatgacttttctcagatccaactgattcagtgataaacctatagagaaaaaataactacacttctccatgtttaagctgaccaggatgctgtccctggtgtttacacctccatatcccactatgcgtttcatcttctctttgcctcactggtgatccaagtacagggaatgcttcacatgactgtgatccctagaacttcgtcctgatgacggttgaaatcttctctgagttttaccagtggaaatggcaataaatagaaacattccagaaggtcccctaggttccatattttctgtacttcctctctaaaatatgtaaaatcaattatgtttgctcttgcttttatggactctatctatggccccagcacacacgctaatgccctgtcttgacaatttatccagtattttaataaatgtaaatggtcacatgcttatcatatcatttcttccaatttcatggaataatttcacatcaactctttggattaagagccgtcaaccaaaaaaccacagccctgaataaatagaaatagagtatttcaagctgttcatttggcataacaatgatgagtctacagctcattttcaagatataaatattctgtttatgggagtgacagcaccattcatacagttactgtttcagagcctccaccatatctgacaggacagcaattcaatagcacaagggtttgtgtgccagctttgcttgactaataatgggtttttctctgtctatagggaaagcacatgacaagagcatgagctacacttcacttcactttttttgaggttaataagttgcttgatccaaagctatattacagaagaacttcctgactctgatgaaagctcttggaaaatcctcaaataatattttatgcagaaatataaccaaaaaggaaggcaaattcatatataggaaaataaccagtgccctcctcacgttacatgaggtctactagtatcacccgacaccagctgttagtctgagccctgatgtgtggcgcaatgttaggggttcaagagacgtcattcttcttgacaaattaggtgttcagaagagccagtagccctgtatgtctcagttagttgaaactcatattattgagtccccacagggacctccataaccttggttcaggagacaccttggaaacctgggaaaggtgattgactgaagtccatctgttgaatcatcctcattattaaaagcctcctactcattaacggcatttcgattaatattcgcttggaaagcatgtttttattttggctcatttttgaaacgtctagtcatagttcttcctgaaccactttgtctgcaatcatcctgttgcatttcttttaagggctgatgatctgtcaaaagcaacagccaatattattacattgctgttctctttgcaatgttatcatcagatgtaacccttgcagattaaccactgttacgatttttacatttccagggatttcttgacaatggcaatgatgtgacgccatccagcatctatttgtgagaactctatttgacaaatcatcactgtgggtgtgaacataatggagactttcataggatgcaatggttaatattcaacattagtcaaaatttactctagtcctacccttggagctctactgggttggaaaaatattttagataaggacaatcatttcatagagttttaaaaataaaggctaaaataaattttctgtagcaagagtatgaactatatgtagccagcatacccttttttagtggcatataacaaaaattatttaaatgtatttaatttaaataattgtataaatatgcatatataataaacatacttaaatataaatactatacatgtatatttgtagccaacattttatcagataaatatatgtaacttttatgtatcttatatacatatatgcacattttccataaataaggtaaattttaattttttattgaatactagttttaattttgtctttaattttctcttaataacttcataatttaatactaaatgttcacatttataccaccaacttaagaaaaaatcgtgtgtgtaggtagaggtgtaaatactgtatcaggaagcttttatgcattactgattggtaactggttaaatccacaactcagtggctgataacagtaaacatttgttttcgtgttcatggatgctcatgttcacaatcatctggctgatcaagaaagggctcagctgagtggtttctctgcagggcactgagctcatcttcagcctacagatatgaattgtctgaggacgaggctgaacagcagtgactacacatgacacaatattcttatggcaggtcacaggagtgaacaacatcccaaaacaaactgcacagttgaatttaagtccaataacttctaacatagcttcacatattttaaatatattcctttatttcaatgagtacaaattttgaagaaaatgtttactccatttaattatagaggtatttgatcattccatggacaaataattatgctttcaacttttacaattctgaaaatacttgcaaatgtaaatttgcattaataagaaaataaagctggatgtgttttcaacatgtagctttaagtatatatatattttaatggcctcagtgggggaaaatcattttaacttatgtaaatatccctttttgcctctcttgtgtcctataaagttgcccaacaagaggtcctcccataagatttggaaatcagaaaaggatgactcaatattctccattggtacctaaggcagacacaggaacagaggtgagggctggagaaacacctggaaggatgctgcaggaagctgagaacatcaacactcccacccctaagcttccagacaggactgaggaccacatggttagatagcccatacttcaagggcagatgcattctgttttctgagtgagcgccattcaatcctgcttctaatatcaactttcctgactactatatccttggctttgaaaggttgtagtctgaacgttaatcataggcatcggttcattcttgttatacccaaaagagccaagacacccagtggggaaaggcactcagggtgtaaaatattgtttctagaatgcaattgaaataggccctgttatcccatggaactaaggtttatggttttttgaataaacagaaattgactcccccagtcttaaaactcaagatagttacatttgtcttatctgagttcttttttcagtaaaccaaccatcaggcctcgtagatactatcaaggagctgaaacatacatatcactgaatccggacactgagacatcagaaccttcacccattatgattgcataactgacctcttgcttcctgttgaccaaattatcttccttacccctcccaaattcctgttttcccacattttgtccctgttatataaagtcttaattttagttggtcagggagatacattcgcaaatggtgtcccatctcctcggctgcagtacctgattaaagcctgtttcttggcaatacttgttttagagattggctttctgcgtggtgagcagcagggtgtacaatgaatccttggcattttagtaagaaaattctctgcaaccttcactgctttggcttcttgtaacctgaattcacatttaactgcaacttctgagacaacttgatataattgatataattagtgaatcctaattcactttgtccaccactgcttaccagtctgagcttgccagctcccaacccttactagtgccagtgaactttctgaaaatgcaaaaggtaatattttccctttttcataaaacactaaccttctcttcgtacttccaatatattgaagaccactgagttttcctgtgtgtccaatttggcaaacatttctttgcaaataaaacatgaaatttagagattccgctctacattttatttagacttcagtagtttagactctaattttctgtattaagacaattcctgcttagaatatctatagtggtttcttctctgttatttgaattccaaccaaagccctaaactagactccttaggtgtcaagatctctgcctttattaaatcaggagaggcattgttatgtctgtgcagctggggcttacaaagaaaaaggaattgggttgcagaggtgatttcaggtccccctctaccaacaccatcagagtgtggttgcatctgaggaacactctcaggcgatggaggcatcaggaggagcagctggggcagcccagcctcacacatttgcttccctgggggtttttgtttgggtgtgtaacactgtgggagggtaactataatactgttgacagtaataagttgcaaaatcttcagactgcaggcagctgatggtgagagtgaaatctgtcccagatccactgccgctgaaccttgatgggaccccactttgcaaagtggatgcagcatagatcaggagcttaggggctttccctggtttttgctgataccaggctaaataactgctaataccctgactcgcccgacaagtgatggtgactctgtctcctgtagatgcagagaatgaggatggagactgggtcatccggatggcacatctggcacctgagattggaaacataaaaacaaatgtccatacaattaatcatgttgtaagagaacttccctgaagggccaggctgtaccaagcacactgggctgagtaaattcctagtgttctccttccttacctgggagccagagcagcaggagccccaggagctgagcggggaccctcatgtctatgctgtgtcctgacagggtctgactcctgcatgaagtgtgtccagcctattaataagtcttcagggcaggaggttgagcaggggatggggctgactgggcacagctgcagggctggctcatctcagtaactcagcaccagctcagtatccccaggtgtcccaggaaagaccagggtagcacaaatttgtctgtggtgaatgtgtttctactggagagtagtttgttatgagaaacattttttatgtatttttttgaaaatttgaaatattcctcaggagtcgacggagtaatgtatttcattggcacatggggattatttggaatatcttgtttgtaggaaatacatagtaaaatgttaaacagtatgattctcaggacttcaaaagactctcatatgattcgggttagggaaggaggtactttgtcctatacttcaacatttctgtgagttttaacattgttcctttctaaaaatattaaaaataaaatttattgacatgatgctatacatatttgtaagtattaggtaatggtgttatgccattgttcttaccactataagatcaagcaatttactacagatacagagagatgataccgagtttcctcaatgcatgcagcactcacacatccaccattatcaagagctacaggtctctttaatacccagagactaaattcacttcaccttattcttgttttgggcaccttcattgtctaccttcttttctgtcattgagtattactttccaaagttcttctctcttattgagggtgaccactgcatggagcatgtccctgtcatgcaccaacaatgccactttcttcttttacgttttatcagggacatcatcctgacccagacaccatcctccctgttaacatctttaggaaagagacaatcccttatcaagcaattgccaacttacatggagaaatcagctggatccagatgaaactggacatggatttgcagtcattatatctcacatctctactgtgccaaaaatgtcccagcctggcttagtagcaggggacgtggatccaactacatcagcatcagtgggctgcagcctaggactccacaaaattttactgatgcctgactaggggagacaaatcacagtgctgtagcccatgcacaaaccttcctgctgctttgtaagccacctgaattttaagggaacttgcttatattgggagaagggaagaaagctccatttgtcctctaaatgtttgctgaaaatgaactgacaaaagaaagactaataagagaaaaggcaagcaaaattcacttaaagtgcagtgggatatcatagcggtgtgattactcagataactcaatgagatccagttgttcatacttcctttctagcgaagaggtaattgggaagtgtaggcaacctggagagaatagatgaggatagaagtgcatcctcaaaagaacaggtaatagcctgtctggataaagcatcaacttctaatctcttctatttttgattcctattttgtgttaatcttccctgatataaaatttcccaggaagaattttcttgacaatcagtttccttctggagaagctgcttttaagcagataaaggagtgagataaaggagtggagtgagcataccccaacagctaaaactcacaagttagaggatttataagtcagactctaagtctcagattttgtaccgccctcttgcttcataaaaatgctttgttattttttaaattttactttaaagaaggacaattttggagaatatattaatttttggtggaatgaataatgtccccaccccaaaagatatccaggtccttgtctctggaacccaagttttataggagttattaagaaattattttaggcagatagagaggaaaaggcatccttggtaagattttgtttcttttaaagcaactccagacatgtttcttgtctaataggaaagctccggctcttagagccaggctggcaagatttgatatgcaaatgaaggccattagaaactgggtccaccctaacatggctattcctaccttcttcttccttgcccctacatgtgcctggcaacatggctgcccccacatatccccatgtgtgtagaacattatgatgccctacatgtgcatattgaaaggctagggtgggagggccagtttttgctcaggctatgtgaataacatgcctggtcaaaccaatcccttgagccctttgcaaatcagacaccacctccttcattctcctcatataagcagccacttttccaccacagatggagttttctctttgttggaatcccctgtccctctgtctttgtacagggtagctgtttagctgttttattcttccttccttcttacatattaaacttttctctccttaaaaccactccacatctttctgtggcattttatccaaagcagtgtgaaacagcaagaaccctggtgttcctccagtcattggagccatatcataaggattctaccttatgatagatagcaaaaaatgaccttgatagatgtaagttaaggactttgagaataagcttcctggttatccagatgaaatcaatacaatcacaaaggtccttaaaatagaggaggaggattgcagtcagagaggagctgggacaatggggacggatgttgtttgaggaaggaaggggccatggaaccagaaatatgggagcacattgaagataagaagcagagaatccagttctctcctctggagcctccagaaggattacagccccactgacaccttagcattagctcagtgagacttctgacctccagaactacagggtaatacatttatgttgtgtgaagccaataagactgtggcaatttaaacagcagcgttggaaactaatgcaaggggaagagatgtctttcagctcactgagagcatgcttgtcctctgttcttggaaatatttccaccttgttatctggtgtcagacaagagacagagaaaattttttctgagagaagagctcgtacaaaaattctttttagctagaaattctctttggaaaatcccatgattatctcttatacgatctgggtatcacagagtttaggggtcagaactcacagcacatgataggaggaagagggttttgttagtttgttttcatattaggagggaaaattagattttcaggacacaatctgagagggacagactgggacagggatattgtaagagaaagaggagatgtggaaggtgtcagagcaatgaaacatgtgtccctgcttccaaatctaaaataaagtcattgattttagaaggtgaagcaaagctcttcaccttccatcttcttatgaaggatcaaattctacccagagttcctgtccctcctttactcccctgacattgtattgtggagctaatcacatgtgccttaatccctgctcctgtcccgggctgggagaggctcactgtcctcaccatgcccagcaggctagagctcatgccctagacaccaaaggagaagaggatggtttctgtacaggaggtaagagctttaccacatgttacatttcactataattctaagtaaagttgtgtggagagaagagaacatatgggcaactctgtctggtagagttggaagagggcagtttctgagagtgacaatgaattcacatttctaaattttcagatggcaaatgctagctttagcaattgtggaaatgtggactttgagtttaagaacaagacagactttcagatactgcaataaatgaggagacatttggaatagggtccttagcccagggctaaggtcaggctggcagtgcctgagagatgccaggcactggccctgggctgtggaggaagcagctgctctcctgagccacagggctgagaatctgggaggaaccacaggccctggccacagggctgcctggcagggcttcagggaaggaaactgctcacaaattcaggggagctgcattaagcatatatcccccagcctggcaagagtaaaagtctcagagacccagaccttagggctggtgctgggatcctgggctggctgctgtcagctctgccctccctggtgctgaatgactgggaccctgctggagccaaaaacggacagtcagcaaatgtccttaaagtctttactcagccagactctattctgcttggtcagaaaagaaacacacgctacacaaataagcataaaattatatgtatctgtaatatgaatttctattgtgaactttacatattgaatacatatttaagaaataagttgtatttatatatttgtatatactatgtatttatgaataaatatgtgatgcatgtttatatataaagagatataactttggttgctagtataaggtatagttttaaacttaaataaatttaacatgaacattgaaaatgagcactgggtgcaccacctcatggccctcctcactccaggacctgagggtcataaagctcagtaccctcttccatgttccccctgggctgagagaagtgaactgcccgttgctgaggatcatgagtgacctgaggggggtctacggaatcacagaacagcagatgcccaggaaatggatagtgggtctgggccctgaatggagggacgttttgtttccagagctcagcatagacaagtcctcctctggtcatttctgtcaaacaaagcagcatatatggctcagaggctgcattgtcacaggatgaagcccctccatggctcattccagcttcccctctgactggggtgatgtgggatctctgcccagctttcatggctcaccagctgctgggactctgttgacaatggcctatgtctgccccatgcacaagcttctcaatagttgccattttactttctggtctccaataaccacaacttgccaaccatgacccttccacaaagattcatagagtggggtcagaactatgggttcagcaacgtgccggggcatgcaggtaagagacacaaggcgtggccagcccgtgtctgaagtgaggatgaatttgcatcatgaattcagagtaggagatgggagaaaacatcctgacatgctccaggcagtgatgcccacaagatacactagaggtgcccatagaggaggtgggaaggggatttcaggcagaggggatgcgaatttagagatgtcccccagcctgttcccctgagaagatttcagacacttagtagcccctgggcactttgagagaccgaggagaaaggaccatgtaaggccaagaatttgatgccagcctgggcaacacagggagaccccatgtctacaaaacacacacacacacacacacacacacacacaatttgttaaaatgtgtgaaaaatagcatcacaaagtgattatgtatgaacatttgctcagaaaattagaaaacaaagcaatgtcttctgagctaacaatactataataaagatgtcaattttttagctatagtaatacagagaacatgatattgtctatcttaaccatttctaagagtgtagtgcaatgccattaaatatattcacattgctctgctattattactgatactaaatccagaaccattttcatctgaataaaattaatatctatatcctttaaacaatactcccccccatttcctctatccctaccgccagcaacctccattccagttctgtctctatgtcattgacatatttgaagcaggttcactctgcactggttaccaacatacttgagtgtggggaacacaacacccccacacagcaagttacatgaaatgggtttattatttacagataagcagcaagggaacaccacaaaagtcttggacttattatgggtcagtccctcaaggcacaggaaagccatgtggagctgatggagttgactatgtgtaccccacatgcaccacagctcaggaatccaggaaagcagccactcagggttttatatcctgagctaagaagacacacagggctaaagtgctaacggacatcctattctatgggaaactggtatagagcacaggtaggttgttctgctcagttcctctccatctcaggatgttacgattccagcaaattctacaattattcttgagaactcataaaataagcaagaaagtggagagaactaagtcagtccagggtcattggagaactgttttgcaattaccccaccacctagacatcccccttagcaaagctagcatatttcatatgcccaccaacttcccttgaactggaggcagaagtttatcttttcagattgatgaagcaccttgactaacacaacttcaatgcagattatgaagccatagtgagagtacatttcactgggccacgaaaagctagtaccactggtgtagggtccagccctgtggggcttagtgggggttctccccatgtgcagagatgagagattgtaataaagaaagacacaagacaaagagataaagagaaagcagcttggcctgggggaccactaccatcaagacgtggagactggtagtggctctggacggctgggcacactaatatttattacatacaagacaaggggggcagggtaaggagggtggatcttccaagtgattgataaggtgaagcaagtcacgtgatcataggacagggggcccttcccttttaggtagccgaagcagagagagagaagacagcatacgtcagcattttcttctacgcacttataagaaagatcaaagactttaagactttcagtatttcttctaccgctacctactacgaacgtcaaagaggaacccggagtatgggaggaacatgaatgtggacaaagagtgtgaccattgaggcacagcaccacagggaatggtttaggcttccggatgactgtgggcaggcctggataatatccagccttccacaagaagctgggggagcagagtgttccctgactcctccaaggaaaggagactccctttcgcggtctgctaagtaaagggtgtcttcctagacactggcattactgcttgaccaaggagccctcaagtggcctttatgcaggtgtgacagagggctcacctcttgccttctaggtcacttctagcaatgtcccttcagtacctgacactatactcttaggttattcctaggttatattagtaatgcgacaaagagtaatattaaaagctaatgattaataatgtttataatagtgattgataattgtccatgatcatctctatatctaatttgtgttatgactattcttattctaactattttctttattctactgaaacagttttgcctgcagtcttttcctcggcacctacgtaatctttcacacacacactggcaggagggtaagactccccaaagcagtgactaagatgttaagaagtgaaagggggatctttcagatgccctattctctgcagccagtgggcctgctttaggatcacctctacttgtatttctagaatacccgaggtgtttatccaggcacagcaggtagtattgggtgttggtaattgcgtggaaagtctccgttgggttcctcaagaatgtgcccattgtcatgcggattgggcggttgtttcttggtcagagtgaagtctcatggggtatccaaaaacatgacataaattcctttcaaaggtcaccatggtagccccagcatctaactgagtgacatacatttagctgtccaggaagcaagctatggccatagtccttttccctacacaggggatcctttaatagttctgccactcagttgctattttcctgaccagatggctgggttgttggcaatggcccatgatttagtggaaatggagcaaaatatagtgttgggggcagcctgcatggctactatcattgcatgaagtttggcccactgggcagaatgtccatgttcagtgtcagtcaaaagatgccatcccctggctggatggtggcctcacccagtggacccactggcatgtattttgtacaatcatcagggccccatgccatactgacataggcatgtctctgaatcgttggctcattgtggccaaaggaaaaacaaaattgtcccctatgggtcatttgttcccttctaggaagcttgctatttgtttatgggcattcatccatttgcacatggatcctgtgggaactgggttagggcgaattctgactgtaccagttccatttaataatttggatctgttgggcctgtccagttttattgattgtgtttgtaggcaccaaagtgagaatgggtagttaaggtagcagcgtcatccctgatgctctagctatgagataatcagcccctatcagtttcctacagcaagaagttgccattcaaaagaggcacaactggtggcttctgttgccacaggctccagtcagcatatatagaaatagtggacacctggatttccattgagcaagcagcctctgaaggtcttaaagaagtgcctcagtcatgccttgttgaacagattccaagggtgattttgactaacatgaccaaaagaacacccaggtaaggtttctactgtccccagtaccccaaaatacctactagcttctgggtctccatcttattagtggacgccaccaggaccagcaatgattaaatatacctgggatacctcctaggtttctttttcaggtggccttggcattcagccttcaacaatccatcattggtctgccaaactgggttgttccattgtgacaccaggctttgtgacattttaatctttttgtagcaactattaaatttactaggtagtgttccgatcttcactgaatatgcagtcctgctttgtgaacaacactctgggacacgggaagcttaggtggcaggcaggagtggatatgccccactgtcgtgtcttgaatacttagctatgagtgcggatagcccctcaggcagcagtgatgttttgtggcacagcagcaaaatgtcagtacctctattgcactctgcagtgagaaccatggtcaccagcacccaacatagcccaaagggtgtggtccacatgcagatcagcacacaagcacatactcaccatggggtcctcatttgtcttgacaccttctgatgtcttcagtttatttttttccagggaggacctggtaatattgtcaggtggattgcagcatacaaaaatcccagaatagtctgaattcttttttttttttttcaccttttatcttgagaggaatatagggctggtagcctctggtggagaccttggccctgttcctacctgtgccattcagacagacatttgggtctgcaatgtggcttaaccaaacaaacacaccgaccaggctgcataagacttccctcgtgtttttccatgtctcttttatagagagtgagcctccttttctgtgatggccattgttgttcattttggttccttatcagatgcttcagggaccattgagattatctttcttgtgtcatcttgggtgactcagggtccatctgattacccatgtcttgagctctcttgcctcaggaatgagcaatcatgcaactgtctaacaactagaaaattgtgtaccccattcctatttccacattcttttttctatgtctcaattcagtcagccagctgatccatattaatgggaggaggacaaatgtcctgtttatcctccctcctcattaaacatccatctgcatgtccagcccttgcatctccaggctgatatctctgtcctgggccaggtactggagagtattgttcctccaacttcaccataagccatagttctctcaaatcaaaccttctcactgcaccaattttgccaagaaggtttgctgtgcactggttgccaacttacccaaatctagtgagacagaacacccatgcacaaccagttacatgaagtggattactacttacagagagtcagcatgagagagcacaaagctgtcagggcctgattgactctagaccatacatacccaacaaggactgcagctgagggaccctggaatgcagtccaccctgggttttatgtcttagaatcacatgacacactgggctagagtgttgagggaattcctctttgtagtagggacagaaacagagcccaggatattttggccaatcttgttctagctcagaatgctacatttccagaacattctacagttattcctgaaaactactagcaagaaagggaaggagactgggttgattcatgactaaatggaaacttttctgcaaataccaaagtgaaatcataactcggtatttttgagactgggttatttcacttagtgtagtgtcctctagttttatccatgttgtagcgtgtgtcagaatttccctcagtaatgtgcttttgtatgtatataccacatatggattaccaattccttcctttgtgaacatttgagttgcttctaccttttggctactatgaacaattcggttctgaatgtgggtatacaaatacgtcctcaagttaatatcttcaattacttgggtatgtgtccaaaagtgtaattgctgagttatatagtatttctatttttatttctttgaggaattgccatcttgtttcccacagcaggtgggccatttacatcaccaagacagtgtccacaggagttccagttccctaaattctcaccaagactggtcattttctgttggaaaaaaatcctaatatgtgcaaagtggggtttgtttttatttttctaaggattaataacattgagcatcttttcttattctagttatctaattatctctaaagaatcttctttagggaaatgtctattcatgtacttttctcacttttaatcagttattttatttttactgttgacatgtagaaattatttttgtatagtagatattattaaccccttatcagatatgatttaaaaatatttttttctgttccacatgttgcattttcactgtgttgattatgtcttttgatgcccattttaaatttttatgaagtccaatttatcttcttttctacctttgcctgtattttggtgttaaaggtgttagtatttaaatgtctatacatactgacttactatactgagaaggtcacactccaccatctctctgatggtggagctaagagttttacactctcccattttgtaccaggggacagtgcagctatgtgagaacccagtgactttcccgagcttatttgtcttgcatttttggtgacatggattgttgttcacattggcttcctctggcaggtccacctgaaaagcattatatttagcaagaaaaacaggaggcagtgaatgatgtcactgtggattgtgtatattccctgttgcaaatgtcaaattcgtgaagcataaagggatttactagggatattaaattccttgcaaattgttgaaaagtcttaaggaacatgctcctggcaaagcctctagaacaattccaagaatggcactgctggtgcaggctggggaggagctcctgctgccttagactccacattcaagctgtctcctgcagaaaagagagcagctcttctcactactgcccccagaaggacagccgctctgctatcaactactagaaaactgacccctttctctgcatacctgcctgtgttgattacatcttcatgtcagtctcacatagattcatctgttttcaaggctgcagggtttatttctgcccaagtccatcctgtggctttctatcataagtacacatctttctacacttgaatttccaggcattactagtatcaaccacaacaggctacaatctaacataaatattttctttacaaagaacatcatgctaccaatgtagcactgtgctccccaaaatgtgaggaatctccaatctgttcagcccaacaccatccaggaaaaaatgatcttctctcatgagccattaatctgtgtacatattatttaatatgtggtctatattataaaggtggctaaaaatagcactttgatttttttaaagaaagggtgtattgaaaagactaaattatttaacatacatatatgaatggctcatttcgttattgtcaccagcttcttccgtatttattttattctctagtttctggcaataatttctctatggtagagtctggaaaggctattcctcatgtccttggcttcctaagtcccataggtggtgaagaatgcccatcagatgtgttactacagagtgcttttggattgagatgagggaggggaagtgcctgatctcactcaaatgtactcaatttcctggtctgggtcacagccaggcagcacagtcttgtgggcacagtatcttcacttgccatgtttctatcaaaatgagagtatcttccttcactgtggaaaacacggggtgggcagggtgagggaatagcaaagggagtacttggagatccctaagctgccactggtttctccaaatgttttcaatccatttaattcatgataataaacacctttctacctaaccagtcataatcgcttttctcagatccaactgattcagtgataaatctaaagagaaaaaataaatacacttttccacgtttaagctgaccatgaatgtttccacctccatatcccactatgcgtttcatcttccctttgcctcactggcgatccaagtgcaagtaatgcttcacatgactgtgatccctagaacttctacctgatgactgttgacgtcttctctgagttttaccagtggaaatggcaataaatagaaacattccagaaggtcccctagggtgcatattttctgtacttcctctctaagatatgtaaaatcaattccatttgctcttgctttatatgaactagacctatggccccagcaaacaaactaacaccctgtgttgacaacttatccagtattgtctttaagtctaaatggtcacatgcttatatcatttcttccaatttcttgggataattgtcatgtcaactctttggattaagaatcatcaaccaggccaggcgtggtggctcatgcctgtaatcccagcactttgggaggcagaggcaggcagatcacgaggtcaagagatcaagaccattcctggcccacatgttgaaaccccgtttgtagtaaaaatacaaaaattagctgggctacaggtggtgtaccccctgtagtcccagctactcgggaggctgaggcaggagaatagcttaaacctgggaggcagaggttacagtgaagccgagatggcgccattgcactccagcctggcagcagagtgagagaccgtcttaaaaaaaaaaaagaaccatcaaccagaaaaccacagccctgagaaaacagaaatagagtatttcaagctgttcagttggcgttaacaatggtaagtctacagctcattttcaagatatatatattctgtttaagggagtaaaagcacccatcacggttaatgtttcagagcctccaccacttctgatcgtatagtaattcaacagcacaagggtttgtgtgacagctttgcttgactaataataggtttttccctgtctatagggaaagttgcacctgtgcacaagacaagatcataagctacacttcgctcttcttttttgaggtaaataacttgcttgatccaaagccattttatggaagaatttcctgattctgatgaaagcacttggaaaatcctcaaataatattttatgcagaaacataaccgataagaatggcaaattcatatataggaaaataaccagtgctttccttatgttacatgaggtccactagtatcacctaataccagctgttagtctgagccctgatgtatcatacaatgttaggggttcttcttgacaaattagatgttcagaaaagccggtagccctgtaggtctcagttagttgaaagtcatattattgagccccccagagacctccataacattggttcatgatactccctgggaaagctgggaaaggtgactgactgaagtccatgtgttgaatcatcctcattattaaaagccccctgctcattaatggcattttgattaatactcacttggaaagcatttttttggattgtggctcatttttgaaacatctcatcatagctcttccagaatggctttgtctgcaatcatcctgttgtgtttcttttaagacctgatgatctgttaaaaccaaaggccaatattataaaaatcctcttctctttgcaatgggatcatcagatgtaaccttacagtttacccacggttaggatttttacatttccagggcttccttgacaatggcactgatgtgactccatccagcatctattgttgtgaggactctatctggcatatcatcattgtgggcatgaacataatggagattttcacaggatgcaatggttaatattcaacgttagtcaaaatttcttctagtcctacccttggagctctactgggttggaaaaatattttcatgtaaggacaaccatttggtagagttttaaaaataaaggctaccaataaattttctgtagcaagagtatgaactatttgtggtccagaatacaattttttatggaatgtaacaaaaattatttaaatgtattcaatgtagataataattttacaaataggcttatattgcatatataatagaagaaacacaattaaacataaatactatatatatgtagccattttaacaaataagtatatatttatttatacatatcttacatacatttatgcatatttttccacaaataaggtaaattttaattttttattgaaatattagttttaattttgtcattaattttcttttaataactttataatttgattactaaatattcacatttataccaccaatttaagaaaaaatacatgtgtgtatatataggtagaggtgtaaataatgtatcagggagcttttatgcataatgattggtaactggctaaatacacaactcagtgactgataacagtaaatatttgttttcatgttcatggatgctcatgttcacaatcatctggctgatcaaggaagggctcaggtaagtggtttctctgcatggcactgagcttgtcttcagcctatacatattaattgtcttaggacaaggctgaacagcagtgactacccatgactcaagattcttctggcaggtcacaagagtgaacaacatcccaaaccaaactgcacagctgagtttaagtccaataatttctaacatagcttcacacattttaaatatattcctttatttcagtgagtacaaatttttaagaaaatgttcactccatttaattatagaggtgtttgatcattccatggacaaataactatgatttcaacttacagtattgaaaatatttgcaaatgtaaatttgcattaataagaaactgaagctggatgtgttttcaacacgtggctttaaatataatatacttaaatggcctcatgggagaaaattcattttaacttacataaatatccctttttgcctctcttttgtcctatagagttgcccaataagaggtccttccatgagatttggaaatcagaaaaggatgactcaatattctccattggtacctaagacagacacagggacagggatgaggacaggagaaacacctgaaaagatgctgtaggaagctgagagcatcagcacccccacccctaagcttccagacaggactgaggaccacatggttagatagcccatactttaggggcagatggattctgttttctgagggagcaccagagaatcctgcttctaatgtcagctttcatgactactatatccttggccttgaaaggttgcagtgtgaacgttaatgtaggaattgggtcattcttgacatacccaacagagccaagaaaccaggagggaaagacactcagggtgtaaaatattgtctgaagaatgcaattgaaataggccctattatcccatggaagtaatgtttatggttttttgaataaacatagaaattgacttccccagtcttaaaactcaagttagttacatttgtcttatctgagttcctttttcaggaaacccaccaagaggcctccagatactatcagagagctgaaacttacatatcactgaatcaggacagtgagacgtcagacccttcacacattgtgattgcctcactgaccttctgcttcctgttgacaaaattaacttcattacccctccctaattcctgtttgcccacatttcttccctgctatataaccccctaattttagtttgtcagggagatacatttgagaatggggtcccatttccacagctgcagcacctgattaaagcctgtttcttggcaatacttgttgtcttagtgattggttttatatgtggtgagcagcaggatctacaccaaatccctggcatttcagtaacaagattctctgcaagcttcactgctttggcctcttgtaaccggaaatcaaattcaaccccaacttctgaataatttaacataattctaggattcagtttgtccatcagtgcttaccattctgagcttgccagctcccaaaattttctggagccaataaactttctcaaagagcaataggtaacattttccttttttcatgaaactctaagcttctctttgttctttcaacatattgaagaccattgagtttttctgtatgccccatttagcaaatatttcttagcaaataaaacatgaaatttgagattcatctctatatttttatttagacttccatagtttatactctatttctctgtatcaagacaattcctgcttagaatatctatagtggcttcttctctgttacttgaattccaactgaagccataaactagactcctcaggtgtcatgatccctgccttttttaaatcaggagaggaactgttatgtctgtgcacctggtgctgagaaagaaaaagaaattgggatgcagaggtgacttcacatccccctctaccaacaccatcagagtgtgcctgcatctgaggaacactctcagctgatggaggaatcaggaggagcagctggggcagcccggcctcacatgtctgcttccctgggggtttatgttcaggtttgtaacactgtgggagggtaactattaagctgttgacagtaataagttgcaaaatcttcaggctgcaggctgctgattgtgagagtgaattctgtcccagatccactgccgctgaaccttgatgggaccccactttgcaaagtggatgcagcatagatcaggagcttaggggctttccctggtttttgctgataccaggctaaataactgctaatgccctgactggcccggcaagtgatggtgactctgtctcctacagatgcagacaggaaggatggagactgggtcaactggatgtcacatctggcacctgagattggaaatataaacacaaatgtccatagaattaatcatgttgtaagagaacttccctcaagagccaggctgtacggaacacactgggctgagtaaattcctagtgttctccttccttacctgggagccagagcagcaggagccccaggagctgagcggggaccctcatgtccatgctgtgtcctgactgggactgactcctgcacaggtgtgaccagcctattaagaagtctttagggcagggggtggtgctctgggaacaagcaaatcggcagggggtggggcaggctggatacagctgcgtggctggcttatctcagtaactcagcacaggggcagtgtccccagtgtcccaggtcagaccagggcacctagatttgcctgcagagaatgtttcttcctaaaggatattttgttaccaagtacatttttgagcatttattggcaaatctcgaagtggttgtgagaactagatggaataatatatttcaatgccgtattgggcataagtaggagaatatccttgtttgtagagaattcttaataaagtcttagagagtggggctatcaggtcttcaacacactgtgaaattgttccagttgggagcgatactttgtgacatacatactacatttttgtaagcatgaaattgatctttttttaagtaaaaaagaacacttagtcatgagcaagtaaaatgttctcaaaagcattttgtaatggccctaaaccaatgttattaccagtctaagctgaagaggtttactgcagattgacaaagaagatgatattgggattccttaaagcatatgacatccacagttcctgcattgtccagagctataagtctctttaatgctcgagttttaatgggattcattttattctctgcttggggacccccatattctacccccttttctgtcattgtgaattatttcccatggtccatcagcataaaagtctgactagcaatgctaaatctgattactttaaaacaattttttttcttcttctactacaggagccttgattagcataaacttgaatctttgtgttagtttgcttaggataatggcctccagcaccatccacagtgttgcaaaagacatgatctcatttttcatagctgtatattaagtattccatgttgcatatgtaccacattttctttatccaatctacaactgatgggcatttaggttgcttccacgtctttgctattaggaatagtgcagtgatgaacatacacatgcatgtgtctttatggtaaaatgatttatattccttagagtatatatccaataaagagattgctgggtcaaatgatatttctgttttaagttctttgcaaaattgccaaactgctttttataatggctgaactgatttatattcccaccagcagtgtataagcattctcttttctccataaactcactagcatctgtcatttttaagtttttaataatggccattttaactggtgtaagatggtatctcactgtggttttgatttgcatttttttaataattagtgattttgagcactttttcatacgctttttggccgttaatatgcttttttgaaaagtgtttggtcatatactttgtccactttttaaaatagtttttttttgcttgttaatttgcttaagttagttggaggttttttaaggaaaaaaccagaataagagaaaaagaggaaaatataataccacagaaaacacagactgtggtaagtattgcctcatggatatatatgtgtgtgtgtgtgtgtgtgtgtgtgtgcatatatatatatatatttatgatacatgctgtgtttatgtgtataatgatgatccagaaactaaagggtgactggtttaaggactgcctatgttgcactgaggcttccttcttttcaaattatgaactaaagggtacagcagtacttgcatgactctcaaaaattctagcagcatgagatagaggtagaggagatttactgagatagatgcattggaagctgtagaagctcgtcctgtgctgttgtggatgttgtgattgtagtagttgttgttagtacagtgggagtaaaagcagcttgaagatttacaagctcttctcttcctcatacttacaactccctctagagatgcatcagtgattgtacaggcatctctgacacctctggagaaatcttgttagctcaatccagaatcttacctgataaatgttttgagtctcaaattatgtgaaactagggtgtagaaaaaggactagagcaagggaaaataatgttcatgcctgcacagtggttgtagacaggtaaatggggggctttataagtgtgatgatgtgccaaacctctgtcaccacggggagagaagcatcaaaccaggatcacttctggaagaatcattaggttattttagatggaaggaactgtgaattccttgccaaatagatttttaaaattcaaagctactcattacgtgttaatattatttaacttctttaaatataccatgtggtagagggcacatccactatttcaattcagggtttgtatgcctatgtgaattacaccattaaaaacacagcaaattccatattggttggggaagaatgtttgaacagtaatcaatttcgtgaagaagaggtttatgtcacagcactttccacagtattacatacaaaaacagtgaatgatctcatatccacaagaaccagcatttctcatgtgccacatatgccctcccagaaagaattgaagcctgtgacaagttgatgaaaggggtagaaaaaagaataaaaccccaaaacacagcactataaatggaaaggggaaaatcattgcagagcctatgattataaaaatacaaaaggtggatattctgagtatttttatggcaactagcttgacagaagtaacaataactttgtattataaatttacccagaacgaaatttccaattttatatctgcctgactggtgtcttgataccttatcaaaattacacaaattttcaagagattcaaaaagaataaatactcccaaacttatcatatgagatcaccatatactccagtccaaaaacaaacaaggacgtaacaaacggagaaattaaatgctggtatctcttgtgaacataaacacaaatattctgaaaaatagggaaagaaggaaaatataatcatttttatacctatatgtttgtgaacacacatggttaagtgtattacagtttttatgctaagaacacttgatatgtaattacaagttctaaaaaattgatatgaaacggaagatgtgacagttccattttcctaacttttaaaagaatatttcatcttatttaaatattatttttatttttgtatgactttttgttttgcttagacttttagttgaaatgaataatgaatgtgtattaaaagcctaccattttgatttaatctatgaagggtatttaaattctcattctatagaagaaaaatccaaactccttagaaaagagagatcttgccaagagctacacagttcttgtttcggagctgagattttctctcagatattctggctcatacaattttcagtacactacagatagaagatgcaaagacaacattacccaattggtcttgcacttactttgttcactgttaactaagtttactgaaaaaaaattacaataaaatacactgtcaaagaactgtcacaaataaatacatctgcagaaccacctccaaaatccagacatagaacatttctataactcccaaaagttttgacctactcttttggaatccacttgctttccaccacacagatcagggaattcttgatctgcttattgtcagtgcagattccaatttctttttaagggtttcatataaatgaaatatagcatgtgctcttttgcatctggtgaattttgtgcagcataactgcttctcagattcattgagatgtcatgtgttccagttatgtgctcctttttatttttgagtgttatttaactgtttggtaattttataatggatcctttcacctgttgattgccatgtaagttgtttccactttgggctattacggataaagctgctatgaatgttcttgaacaagactttgtatgaacatatctctttatttcttttgggctaattcctaggcgtgtagttgctgggtcttacagtaagtgtttaatactctgttcaactttttccaaagtggctgaaacattttacatgtccaccaataacttattatagctccacaccctccaactgctgttttgattttttttttaagatttcacctaattgtcactcaacagtaaccagaatagctagtgattattaagctatgtttttctgactattttcttgtcaattttggtggttgatgtgtttcaggatattgagaatagaatcaatgccatccaagctccttttcaaataattttatcaagccataatatttaagatggtaacaaggtatatacaaggtgtgttgggagtagtaataagtgttttcaacatttattattatcgtactccataaggcaatatgtcttcaatgaaatagtgtttaactagacttaggatagaaaggttctcatctcaaccctagtattcaatattaggaaaagtttaaggaaaaaaaaaaacatccaggaaaataagtcagagagtgttttgctagtcaagaaaaactgcaacactgatgctcttttaatgccagaccttcacaataatttccactcagatcatttggtggcctccttgccttgttctccttatgggacttcattctgagggcatgtgacatcacagagggagcagtgcacttgggtacagaaatatggcttaggggattgtctggccttagaggtggctgcaatggaatatacattttcaaggaagttccctgttaaagctgataaattgttagttaaggcaaggtgcaggggcttatgcccgttatcctagatgtttgcaaagtcaaggatggaggacagctgaaagccaggagtccaagaccagcctcgaaaaaataaggagatccccctgtctgtagaaaaaaaagaatgtttggtaagatgtggtgtgaacaatgacatctataagagattatttattaacatttgctcagaaaactagaaaatagaatgatgtcttataatccatcaatatcataataaaaatgctaagtttttcaactatggtaaatatagagaacataacattgcccatcttagccatttttaagtgtacagggcaatggcattaagtaagtcacattgttgtgctatcatcaataatagcaatctccagaactctttccatcttctaaaactgaaactctatttcaattaaatgacaaccctctccccatttcccctgcttcaagttcctggcaacctccattcaagttctgtctctatgacagtgactactctgaagcaggttcactgtgccctggttaccaacttatcagagtccagggagacagaacaatcatacacaacaagttacaagaatctggtgtagtatttataggtggccaacaagggactgcagaagcctaggatgtattgtgggtctgtcccctgaggcacaggcatgtgggtctgatggaatcttgactgtgtgtaccccagttggaccacaactcagcaaccccagaaagaagatgctctgggtttttaatcctggtgtcacaggacacatggagctaaagtactggaggactaaagtactggaggacagtactaggagaagctggaacaggggcaggctcttctgaccagtctctccctatttcagaatgttacatttccagcacattctacagttgttcttgagaagtgtaagaaagagagtggggagaactaactgagtcgagaaccattagaggactgtactggagtcacccccaacccaaacacccccgttagaaagccattccattttatatgcctactaataaccctgaactggtggcagaggtgtgtcttgtttgactgatgaagcccctcgacgaacacaatgtcaaagcaacatcatagagccagagccagaatagatttcactgggccaatgaaaactactaccagaggcaggatgatcaggcccacctgaagcagttatgtagcccaggatccaatgatccacagaagaagttgctaaaggggtgaaagaagaatccttcaggtgggaccattttcttcaattacgagcctgtttccagatctcctctcttgaatttctaggatacctgaggtgtttgtccaggtacaacagaaagtgttggaaattgtatacaatcctcccagttgggattttaaaaaagtctagagcaacactgttatctaaaacatccatcccgatggagttaagggatgtctgctgggctaccaaggcagtggctatggaggaggagccatatctgccatggtcagggacacatttcttatcatttctcttttttacatgagcactgactcctatacatagtaccaaaaatatcacaaaagacataaacccatagtctgttataccttctggcaggtccctagtaagtctgaggtacagctttgggctgcaggctcaatggttcacctaattccaaggagtaatatccagagacaagcccagcatgcccaacatgcagaatctcaccatcccacagttatccagagatggcatcacacatcctgcattttgttcactcccagaccattcacagagaaatatgtagcccttgggtgcatacagccccctttctcccattttattgtttaatcacccagtcatggttatgcaggtattggtgtgttcattagccaagtctcactgatggcagagttgaaggagcaaagttttgctcagacaatattgttcatagacagagggtagcattagtcctctccttgtttttgtctttgccattggggcatttcttatctatgcaatcaaagaaatatggtacatcaaaatatcagtccaccaatgttttttttagttgtggtcatgacatttgccacagagtcaatttagttaaatggggggcctccagttttctcccatgtggtaggtatcacatcctcagttggtaggccagtgcccgggtcctgttgatgtacaccatgatatcagtaatgttggtgtcatttgccttcagtagaatgaaaggaaacctctagttagtgacagaacgaggtcaagaatggcagattcagtattttgaaagattacactcggtgacttgcaagaagctaacaaagatgttatgcttctaggcctttgctgcctcattcttgccaaaatgcagtgtgacaggttagtgcatcatctctcacccatcccagggtctcaggtgtctcctacccatctacaagggttaggctgtgttggtgtaagaatgcggcctggctgtccttgctctgtgaaaaatccattgcctttgtcacttgacccagacatttcagtcctgattgtccactgcaggaagggagattatgccctgtaaaaacttgacatatttcataatatcaccaatactaaaggaaggataagatggccctggcaccagaagagggcccctagctccctgatatttcttagtcttgtcatccatcctgtgggatcttgtagaaaagaggcatttagaggaaacataatccccatattagagttagggggcctgtctggggtaagatgatggcctgaattgaaaatcaccccagggcatgcattctaaaggaaaaaaagaaaaagaatggttaggaacactgaaatagctttcacaggtccagactaataaagggtctgcctggtctaccttcgtttccactcagcattatgttccttaacattcattatttcccttgttctggagtgcgatatttaatgcccatattgctctagtaagatggggtaccaccccattagcagactttctagatgtcctttctagatgttgctgtgtgagtccattgttctagcattcactagattcattggcctgtggatgcagggtgcatggaaagttcatcgtgttccatgagagtgtgcctattgtcatgttgcttgggcagtgaaagatgctccttggtcagtgtgaagtgtcattgggtatccaaaaatatgatgtaagttcctttcaagggtgaccttggtagtcccggcatccaattgagcatcgtatctctttttcctgcaggtggaaagctgtggccatagtcctttcctccacaccagggattctttaaaagtccagtctctcagttgccattttcctgaacagatgttgaggctgttggcaatggcccatgatttagtgggaatgtggcatggtacgatgttggaacagcctgcatggccattaccactgaatgtagtttgacccactgggttgaaatcccatgctaagtttcagttaaaaaagtggccatccattggctgaatggtggccacacctggtggacctgtcagtttgcgttttcctcagccatcagtgactcctgccatatggaaatctctgaatcttgggctcgacatgggtaaatgaaaatccaaattatcacctacaagtcatttggtcccttcaacaacctctccatttgttcatggagccacagatcctgtggggtcctgactaagcctgatcaagaatgtgccatttccatttgataacctgactctgttgagattgttactgccttgaaagccaggcaggcgcttctcaactctgtgattcttcccaggaaatacgtgagaacttccatctgggttcatatctcaaacacaacccaccagtctctcacttgctgccctctgctcaaaatcttcacattgtaatttttcatggggtaaaaagttagcttatatattatcttgtattcattcaaattctgtttaaataacatacatatgttcctttattctttcgaactttgtccttatttttgaaacccagctttggagttcagaaagctacttttgtacttcaatatgctgtgagtgagactgtgcaaacactttagcaactaggtctttatttttgcatacatttgccacaacatatctagtaattaaaaaatctagactgtgaagagttttatttggcttctccctgaaaaaagtaggataaaatacagtgcttgctgctgttctggtcaagggtcggccttacaaaaagtggaggggggaggtggaggaggggagggaaactgatttaatatcaccagatcttatcaatgtacatgtactctggtaactgctaaaccaaatcaaaagaatgtgttagttttgtgttgccagtaatcagtctcaattaggtgcctgttatgcagaatgaatttagttgatgaatgaacatagggaaggaagagaggattagaatgagctctcattgagccttctcttctcttgtgtctcattgctcagagggcacgtggacctcctccatactgcagactctgtcatgcaaaggctgctgcagctgacgggaccttaaaatgtggtgcctgaggtgtagccaagaaatttatggtcatgagccctcagctgcaccaagtcctctgagttctccaacatcttggtctttaggcatctaagagaatccacagtgcctgctctccacagaaacagcacatctgggcagctaggccacagcaagtgggggggtttgtgttcaagactataccattgtgggaggataatgtgtactttgctggcagcaataaaccccaacatcctcagcatccatcctcctgatttcagcatgaaatctgtccccaacccactgccactgaacctgtctgggactccagggtcgtgattggaaaccaaatagattgggagccaaggaggctggcctgtcttctgtaggtaccagttgaaatagatgtatccattactgtgaagggggctgtgactagacctgcaggagatggaggctggctctccaggggtgatgggcagggagagtggaggttgggtcatcacagcatctccattggatcatgaaataatgagagagaagtgcaaggttatgtgcaaacattgtgagtcattttaatcattttctgtctgttatttatgttttgctcaattatttttgtgtgtgtgattttgattaatcctcccaaaacatacagatttaaaaagaaccaatatttacatatccttgctccttctggaatcttcctcactctcacagatctagacatcacatgccccatcctggaggacaagacacatctaacacgaggacaggacacacatgggaggtggcggggtccacagagttcaccctcccaccccatcatcctccctcatttcccttctgcccttaccagggacccagagcattagcagccccaggagctgagcagggagcctcactgtgagaaggtgaactgaggagtcctgatcagtcaaggcaaggttagagtgagctttcgtctcagactcacaaggaaagtcctccctaggggacagtatgcaaatcccctggtgggtgcagtggggtggaaagagccaaggagaaggtgggggcgtctcttgtgagcaaaatgacataaatatattttatgtttttaaggaaatcaatagaggtaaaatctgtgttgcctgagtggcagaagggacgtatttagattttcctgctgtttcctctactagacttctagttctttaggactttctcgggcatgttttatgtttctttttaataagcttgatctttcataaatatttgatgattcttatttctttgtttaggtttatttaaaagagtctaggtttgtttattttattttattttattttattttattttattttattttattttatctaaggtaaaacacacagtgcaaagggtgcaactcttaagggtgcaaatgaatgtcaagatccagatcatttcatatcatgatccacatagaaacgcagaaggtttccaattctctcgctgctttcattatgcaccttcccagtcaaaaactgctgctcaaaacacaatcaatgtaaatgatattctgacatataattgttttagtcctggacttaatctttatatcaggtaaagtaaacattttttgtagcttctttctaacttttttcattttttgaggccttggttccttcttgtcaatttgagttgctgtctgctgtcattctctgttattctgaagaattttctcttgaatctcttacaaggcatatatgctattaatgaattaatctttgtgtatgaaggaatatttctaccttgcttttatatttaaacgattgtttttctggatatagaatttgtggctgagaatttgtggctcagtatttaaaaatatcattccactgtcttctcacctccatttgtaatggtgaaaatttagccaatgattttaatattgcttcttagtataaagtaagtcggtattttagtgatgcatttcaaattctctgggtctttgtctttcaacactggtactataatgtgtatagttatgaattgtactgtgcttatcctaaaagggtttcactgagtttctttcatgtatagattaaggtgtctcatcactgtaaaaaatgtttttcattatttctccatttttttctttttcaatttttattttaaaatcagagcatacatgtacagatatgttacaaagttattttgcatgatgctgggatttggggtatgactgaacttattaaacaggtagtgagcactgtaccccataggtattttttcagcctctgcccttcctccctttgtctcccctctagtagttcccagtgtctattgtgcccatcaaccgtggattggataaaaaaaaaaactgtgtatagatacaccatggaatcctatgcagccataaataagaagaaaatcatggtcctgcagaaacttggatgcagctggaggtcatttacctaagtgaactaatgcagaaacaaaaaaccaaataccatgtgttctcacttataagcgggagctaaacatggggtacacatgggcgtaaagatgagaacacagtttttagcctcttcctgtcttctcctttgtgattcctaatacaaatttgttggtattgttcacagggacctataatgtctgaggttttattcattcttctttataatttttcccttctttatatgaggtcatttctattgacttctttttcagatcactgactctcgcgtcatgttaaattgctgttgagtctatctaatacatttttcaattgagttgtacctttcatttttcggattcccagtaggtctgttttcatagttttgtgtctgtttgagagcctctatttgttgaatcattgtctttacaaattcctttttaagtcttttattataggttaaaataattatttgaacatatatttgataagggtggagcacacagacaccatggagatggaccataaggcagggagctcagaattggattagttgaatttggagtctctgactagatggtgctcttgtgagatttaattattttccatgtttcatgtttctcacaatacaaatagcttttattttttaagatggtaactatgaacagaaattcagcttataaattcctgggaattcctaataggaaaattgatgaaaaaatggtttttcttaggcccccacacctgcctctgcctgggacctgactttgtctctgagccggcggaatctatgatgaggttttgagttgggcagtgaaatcatggcagggcaggctgtgctctgggtgctgtggagaacaaggggacactcctgcagggttagtgatgctgggagttcaaggggagactcagcatggagctgcctgttgagtcaccccagcaatcctgtctggacagtgatcatctcacaagtgtacttggatgccagtggatggcccaaatgtgggttcaggttggacaaggacaaagctttagggatgaacatatggggctcatttgatagtctgaagtttcagcacaagcgtaatgaatcatatgggaaaagaaaggagtcacaaggttgtgacttttcatttgatattaaaatatattccctctgctcatttttccctacagaatgtaactactgttacatatttaaccaaagtcattgtttttaattttcattttagtaactgacagcctgtgtgcagagttcctaaataactggaaagccaggccgtcattcctatggctgaagccaggaagtgactgtggatatgaagaaatgtgagtttcatgtacatgtctctaaagccacgggccactgatctggtgggaacctgcagtcatttcactttctcatacccagatgagaggacaccttgatctgtgttcatctgatgatctgatgaactctaaaaactggaccatattctgaaggtctagttcacacttcttttctgtgctagagggactctactcacatgtattgtacactctgcataggacagtctgtgatacatacaagtttttttctgctaaatactcatcaatcttgtcatttatgcatcttctatagttgttacctgacctatggctatggggtcttccaaaagaatgggccagaggtggagctgtgaaactgtagctgaataagaagtgtaagtgtcaagatagggtaaagaagtgttgataataataatatttcaaattagtctgggctcttggctgtgattactggtaagtgggaaagagtctaggtttgttttttttaagttttattttaattgataaagtagccagggtaaagtgcacaaatcttcaatgtgcaactgaataaagtttatgtgtaattcattgtccaggtggaatgatagaatatttcacatactcttgtgcttccctcatggacaatctttgtcagttttcgcccctcccacccagccatagtaactgttattctgacatctaacacaatcacttaggttttcctgtcttgaacttcacataaatagcattaagtgtatttttctctttttagccttggtattgctccttacaatgtttgaggccttcatttcttccagtggactcaaggtcctgtctgatgtcatttcctgggattctgaaggattttctctcaaatgtcttataagacatagctgctatgaatgaatgtacttttttatcaaagaaaatttttttttgctttttctttagatgtgaaggtattttcactggatatagaattcctagtgacttttttctcctttcagcatctaagtatgtcatttcactgcttctaatctctattggtcctaatgaaaacttagccaataacaatatgttgtttctgtgtattggttgggagatgatgtttgacagtgatcagtttgtgaagcagaggcttgtgtcacaatactttccacagtactacatttaaaaatggcgaatggcctttcattcttgatgcagtgaagattttctgtctttcaacattttaatataatgtgttcagttattaatttctattatctaaaagggttttattgaattttttcatctaagaatattttttattacttttgaaaagtttttgtcattatttctccaaggatttttttttcagccactttctctgtctctcctcctttgtgactctcattatacttttgttggtatccttcactctgagctataaatctctgacgtcttcctccttttttttaaacattttatttagactcaataagttctattcctttattttcaagttaactgattattctgccatctcaaattgctattagacctagctaatacgtatttaaattggattattttacttttcatttctagagttccaatttggtcattttttatattttccatatcttttcttgaggccctacttgccaaatcttcttaatattttcttttttatgtcaatgatcatagttttaaaaataattatttgaaaatctttgtagtctttactaaatccgataattacggcaagttagaatcagctttcgttgactattttctgttgtcattattgtagttgctttatttttgttcctttaatattggtcattcttctagtttttttcccaggagctgttaaactgacaattttacatttttgataatacagtacctctctttagattatgggttttttaattttaattttaattttttagaaatagggtcttactctttcacccaggctggagtatggtggtgtgatcatagcttgctgcagcctcaacctcttggggtccagtggttctccagcttcatccacctgagtagctgggactataggggcatgccattactctctgctatttttttttttttaaatagtaagatattttgcccacccagcctggtctcgaactcctggcatccagtgatccttctgcctcagcctcccaaagtactgggattacaggcttgagccaccacgtcaggcctggaatttgttttgtttttctgatcattttttaattttcttcttagttacttgggtgaacttactgatagtacctgacttatgatgcttggagttataactttttgactttcagatggtatgaatgtgatatgcattcaagtagaaatagaaattctagtatttatacaactattctattttctctttcaatatagtattcaataaatgacatgaggcattcaacactttattggaagataagctttgtgtaagataatgtcgcccaagtgtaagctaatgtaagtgttttcagcacatttaggataggataggctgagctataatgttaagtggattagatgtattaaatgcatgttcattgcatgatattgaaaaatctatctcacgtggtgtttgaccactgatatcactgcttccttttattcttaatattaatatttagtttgaatttataggaactgcacatgtatctgcatagtgaagtggtcaccaatgatttgagacgttttgcttaaatatctagaggttataaatctatcttctgtcaacccatctgtgtgtagtttaaaaagcaaactgcatgcaaaatgcagctagttcttgaatccttctggttttactttgcaccggaaactccttgttctcatcactcatatctatatcttctaggtcactaggaatgtgtgcagagattatttcagcaatatgggtctatctcatccaggaatctgctatttactatcagcagatgtactacttgcctcaaacaggtcatcatcttggacttgtaaagctgtgagatttttctgttcatttcctatggagttctgcatgtttagctggaaacactgaataattttttttccactccttggctttactcaagtccacccactttggcagcaagctgctagttttttttgctacgctcatattggtaaaacttcagttctgtaattcatgctgattgagctgggggtagaaggctgctgtcacaggcaaaaggctacagacattttctgtccttactcaaagcactggtactttttttttctataaagaatatgcatccttaattattttatacttcaccaattttcagagtgctgaaatagttttgatacttcagctttatatttaaatgtgtgtttgttgtttatttttgcaccgaagatttattaaactctttgtgatgccataaacagagatgccttctaaaatgcatttagttgaacataatagccacggtgaaatggtacgatgcaatggactaacataagtaattttggacttgacaacttgaactccaaaatggccaaatagagctgagatgctaacactgagtggccaccccactagctgtctgtaaaggaagcagctggtataataatctagtaaacactgatggtcttgttggggtttttgtttcatgtggaatcactgtgggaggccagttgctacgctgctgacagtaataaactgcaaaatcttcaggctctaggctgctgatggtgagagtgaagtctgtcccagacccactgccactgaacctggctgggatgccagtggccctgttggatgcatcatagatgaggagcctgggagcctggccaggtttctgttggtaccaggctaagtagctgctaacactctgactggccctgcaggagagggtggctctttcccctggagacaaagacagggtggctggagactgtgtcaacacaatttctccggtggtatctgaaattggaaataaaacagaaatgcactcatgtaatcaagatcaaaccaactgtctttgagtagagccaaaattgttgatatactttgaattttaattatatttcttgctgagcagaggtggcaagagttttcactaatgtgcaaaaccacctcatgttcccctcacctgggagccagagtagcaggaggaagagaagctgagctggggcttccatggttccctctgggtcctaactgagcagttcctccccagggctctgacacaggcattgatatgggctctggaaggtagggcagctgggagggacatgcaaagcagctgggtgggagctgagcttccagctgcagagaccacctgcttcttcctctctgcactgagcatcctgcgccaccctggttgtcaggccagaaaagtctgttggctcagtctgagtgtagaacttctcccttgtgctcagagaatttcattcctatgtctttcttctcctcaatcacctaaattcacccagatgatgtttggcacaagcctgttaagaacaatataaaaggctgtgttttcatttctctcttcctatcctcaatatgcccagtcatctccctaagtgcattattggatcgatggaaatgaggagtctgttagaacttaatcttccagatacacctttcatttgcttgttagtaatgttttctgagggtcctgaaactttccattaacccagacacataccctctttgagttaaaaagttaaaacttctgtttacagtcacatgtcctggcagccctgacatagatgctccatggcttgccgattgcttgaaattgaccaactaacttaacttccctgtgtctcagtttccatatctgtgtaactgtgacaatactggtgcctaccttacagtgctgtagacagtttaaagaaaataagataaaacatttacagtagtactcaggacattatgtatgcggcaattatttttgtttttattgattaaatatttagcactacagtcatcatcattatcataaatatacttacttggcacagaaaagagtcttcaatctaatccaagaatgttttatcaacagtcaaattaaattctagggctttttcttcactaactgtacacaactcttaaaatcctaatgatttggtcttaatctgtgctaaaatgctcagaccttcaatcattcccgcccatctctgtctaacgcattaattctcatcatccattatcaaaatgttatcctatgaaagtttcccatgtcctgctgctttccttctttcttacataatctttagtctaccttgttatcttttgtcttatttttgccccaggactgacaataaggaaaagctaccatcattacttgtggacttgctccagtataattttgtcaggcttgttatcttggaagtgaggactatgtcttgcaaagaaacatattcattgggtcaatgtgttatcaaataaaagattttatctacttatcatccaataattaatttagactgacttgaacagattttttttaaggacgaaaaggagaagatgatataagaggaaaatacaatacaatatcaaatgctagctattatgactcttgcttcatggatttttacatatatattagacacatggtgggtatatgtgtgcaatgatgatccaaaaactgaatgctgactggcataaggaatgcctgcattacactgagtcttgtctacttttccaattatgaacagaaagctgcagtagtatttgtatgagtatcaaaacttctagctgcctgagatagaggtagagcagatttactgaaataaaagccttggaagtaggagaggttcgtcctgtgatgatatggctgttgctctggttgctgttgttaggaaatacagtgggagtgaaagcaagtagaagattgacaagctctgctcttcctcatactcacaaccccctctagagatggacagatgctggtacaggaatctctgacacctctaaggaagtctctttgctttttccagaatctttcctgacaagtattgtatgagtcacagatgaggtggaagtgggtgtagaagaaaggactagagcgagggaagaagttttcagtcccaggtagttgttgttgccacggggaaactgaatttttcaaagatttgtgccacacttctatcgtgttggggagagaggcatcaaaccaggctcactcctgagagaatcattacattattttagagagaaggaactgtaaatttcttgtcaaatagatgtttaaaattcaaagctatcgagaccatcccggctaacaaggtgaaacaccgtctctactaaaaatacaaaaaattagctgggcgtgctggcgggcacctgtagtcccagctacttgggaggctgaggcaggagaatggcatgaacccgggaggcagagcttgcagtgagcgagatcgcgccactgcactccagcctgggcgacagagcgagactctgtctcaaaaataaataaataaataaataaataaataaataaatataaaaacattcaaagctactgattttgttgttgttgttgttgagatggagtcttgctctgtcacccaggctggagtgcagttgcatgatcttggctcactccgtttcccaggttcaagcgattctcctccctcagcctcccaagcagctgggattacaggtgtgtgccatcacacctggctaaattttgtatttttagtagggacggagttttgccgtgttggtcaggctggtctcgaattcctgacctctggtgatctgcgcgcctcggtctcccaaagttctgggattgcaaacatgagccactgccccggccctactgatgtattactattattcatcttcttgaatacagcaagtggtaaggtgcaaatccacaatttaaacttgagatttctactcctatgtgaattataccagtgaggaacagaaaaattctgtattgtttgggagatgatgtttgacagtgatcagtttgtgaagcagaggattatgtcacaatacgttccacggtattacatataaaaataacgaatggccttaaacccagaagagtctgcatttctcatgagccatactaccaccaagaaagaattgaattgaaactcgtgactacttgatgaagggtgtataggaagagggaaagaaaaaggacacaaaacataatattgtaaatggaaatgagaaagtcattacacagcctattagagtaaaaaaaataaagagaggctaaatgagtaactttttggcaactaacttgacaaaagtggtgcaatcttcacctcctgggttcaagcaattcttgtgactcagcctcccaagtagctgggattagaggcgtgtaccaccacttatggcccttttttttttgcatttttagtagagacatggtttcaccatgttggccaggctggtcttgaactcctgacctcaaacgatctgcccacctcagcctccgaaagtgctgggattacaggtgtgagccactgtgcccggccttaaagcagtattttcatttagtaaagtgtagaagaaaaaacataaataaagtgacaacaagaaaacaaaatgccattatgaaaaatggtaactttagggcagaaaacaagaaaaggcaaaccaagattctcataaggtaagcctccaatccacaatcctaggaggaatgtcaatgctgaaaaccctggagcatccagggagtggccaaaaatactaaatgctgaaaacccagagtacccgagtatcagcctatgagtgtccccacaccaaatgccaggaaaccctggaatatccaggggctgaccagtgcagaaaatcctggagcctcagttgggtggccaacagtgagccccaaaggcctgattgggaccacagaacaatgtgactctggcttcttacggccaacagaacaggagaattcttacatccaagtgtcctgccttaaacaattgcacaaacacaattagcagggagccaaagccaaaactgcaaagcaaacacatatatcagggcagaaaataagataaaatggctgatggataaataaaatggcattagaggagaaatgactaagagaaggaccaaggaggatgtagtcaggtgtgctatggaggacttcaaatggactatcgagtcaaaggccttattccctggatcatccaatataggtcaggtgggcagaggggacacttacaggtgtgcaggagccaaaatggtgccaagcagtctctaacgtggggcctgcgtgaaaatctctccaggctccccagcttgggtgggttgggctcctacggggaactggagcacggagcggctggcctgcatgaagcagtggctctgtggccacttgcccatccccagggctccaccgcctgtcaggaaagatgatggctcttaaaacagcctttggctagtgttaacagctctgcaatgttagcaactctgtagctttgatcgctgtagcactgatcaccgtctcaccctctctcactgatctctgtcttcccaattctccaatagctgtcctgctcattgctgaccgctatgtccatcttctcacaaaatcccatctcttgctgtctcttgttgtcttgctttctctgctgtttctgctgtctcactgccacatcagacgctgcctctcaccatctctagagttgagtggctggcttaatcctgatgcaaggcaagttcttggatttgctcgggaaagaacgttagagtaagccggtgattgaataaaacagctttattgatggggcagcagtgttacagctctgtgactaagcctgtggagcaggcataattcataggcagagggccaagagtagcagccaggtgcagttttacagtcacatttatacccacttttaatcatgtgataattaaggggtgggttatcgagaaatagctcgaaaatgggtcgtgttgccccaacttcccggtgttgccatggcagggcagcaatttccaggtgttgccatggcaaggcgctgcgacttctggatgttgctatggcaatggtaaactgtcatggtactggtgggtatgtcttacggagaggtgttttcagaatcctattcctgttttggccagcctcacatctggtccagagtgaagtgctgcctacctcttacctcaaaagtaacaagaaatctgtaataacaagttacccagaaaaaactccaaattttatttggtggttagtgacatggtacttatcaaaattacacaaactttcaagggaataaaaaaaatactcagaattattataggaggtcataatgtcctccagtccaaaaattaatgaggacataacaaaaaaaggatattaaaggctggtatctcttatgaacatagacacaaaaatcataagaaaaaataaaaatggaatccatctgtgtatctacacatttagtgaacacacgttgtaaaaagtgttacagtttttacgataagaactcttgataggtaattttaatttctgaaaaatttatatgaactataaggtatgttggatctctttccctaacttaaaaaatatttcctcgcatttaaatattttccaatttttaataactttttattacttagacttttagttgatataaataagaaatgtgtattaaaagcctaccattttgatttaacctatgaaacacatttaaattcttggaaaaatccaaaaatacctagaaaagtgagctcttgctagaagatacacagttctttagtgtcaggctgagattatctaccagaaataacttttggctcatgtagctttcagtacactgcaagaataaaagatgtgaagacaacattacttaattggatttgcaattactcactattcactattaaccaattttattgaaaaaaaatgattccaatcaaatactctgattttaaatgtactgttgaacaagtacactcgtgtaaatgcctccaaaatcaatacacacaacatttctataactccaaaaagttttgtcctgctcttcaggaatcaacttgctttccacctcacagaacagaccatccttggtcagcttattgttagtatagatttcactttctttttaagaattttacataaatggaatatagcacgtgttcttttgtggctggtgactttcatgcagcataattgtttcctaggctcattcatgtcgccctgtgtcctcatgatgtgttactcttcacttttgggtactatttaactgtgtagtaatttcacaatgtatcccaccacctgctgatagatatgtgggttgtttccactttgggctattatggataaagctaccaagaatggtattatacatggctttgcatgaatatttctttatttcttttaggcaaatacccaggagtgcagttactgggtcttacagcaagtgtttaatactccaccaaactgttttccaaagtagttgtaccattttacatctcagcccagaattgatgagtgttctcaatgtttcagctacttgtttttaagaatttttcttaatcttcactcaacagtgaccagaatggctaatcatcattaagtcatgttttccttacaattctcttgacttttatgggtgcttgacttgtattaggatattgaaaacaggatcaatattgtctaaaccccctttcaaacacttttcctaagtcatgatatttaggatgataagaggagatctaaagggactgctggtagtagtaacaggcattattcaatatttattatcatactccataaggcaatacattttgagtgaaatagcattcaattagactcaggataaaaagcttctaatctcagctttagcattaaatattaggaaacctttgagaaaacaatccaggaagacaaatcagagtgttttgctagtggagaagtgctgcaacacctaaaccctattaatgccagatctttgcagtgatttccactcataaagttgggttgactccttgccttgttctcctatgtgtctgtgtgacttcatgctgaggggatgtgacatcacagagggagaagtgcacttgtgtacagaaacatggcttaggagattggctttggaggtggctgcaatgaaatatacgttttgaagaagttccctatgaaatgtcttataaactgtttcttctggccaggtgctcgggctcacacctgtaatctcagcactttcagtgaccaaggagaaaggatcaggatcatgtaaggccaagaatttgatgcaagcctgggcaacatagggagaccccatgtctacaacacacacacacacacacacacacacacaatttgtgaacaatgtcatcacaaagtgattatttatgaacatttgctcagaaaagtagaaaataaaacaatgtcttctgagctaacaatactataataaagacgttagttatttaactatagtaaatacagagaatataagattgtctatcttaaccatacttgagagtgcagagaagtggcattaagtatattcacatgttctgccattattactgacataatcagtaaaaatcttttcatcttataaaaattaatatgtataccccttaaacaatactccacccattttctctatccctacctccagcaacctccattgcagttctgtctttatgtcaatgacatgtttgaagcaacttcgctgtgcactggttaccaacgtacttgagcgtgggggaagagaacaccccccacagcaagttacatgaagtgggtttattattacagataagcagcaagggaacacaaaattcttggactcattatgggtcagtcccccaaggcacaggaaagctatgtggagctgatggagttgactatgtgtaccccacatacaccacagtgcaggaactcaggaaagcagccactctgggttttgtatcctggggtaaaaagacacacagggctgaagtgctaatggacattctattctatgggaaactggtatagaggacaggtaggttgttctgctcagttcctgtctatctcaggatgttacaattccagcacgttctgcaattgtacttgagaactcttaaaataagcaagaaagtggagagaactaagtcagtccagggtcattgcagaacggtcttgcagttatctcatcccccttagcaaagctagcatacttcatatgcccaccaacttcccctgaactggaggcagaggtttatcttttcagattgatgaagcaccttgacttacacaatctcaatgcagattatgaagccatagtgagagtacatttcactgggccatgaaaagctagtaccactggtaggaggataaaactccccaagcagtgactaagatgttaagaggtgaaagggggatcttttgatgtcctattgtctgcagccagtgagcctgctttatgatcacccctacttgtatttctaggatatctgaggtgtttatccaggtacagcagccagtgttgggtgttggtaattgcatggaaagtccatttgtttccatgagagtgtgcccattgttatgttgattgggcagtgaggctgtttcttggtcagagtgaagtctcatggaatatccaaaaacatgacataaattcctctcaagggtggccatggtagccccagcatctaatagagtgacatatatttagctgtccaggaagcaagctattgccatagtccttttctccactcatgagatcctttaatagttcagtcactcagttgctattttcctgaccagacagctgggctgttggcaatggcccatgatttagtggaaatggagcaaaatatagtgttgggggcagcctgcatggctactatcatttcatgtagtttgtcccattgggcagaatgaccatgttcagtgtcagtcaaaagatgccatcccctggctggatggtggctgcacccagtggatccactggcatgtgttttgtacaatcatcagggccccatgccatactgacacaggcatgtctctgaatctttggctctatgtggccaaaggagaagctaaattgtcccctatgggccatttgttcccttctagcaagcttgccatttattcatggggcacatgggtcctgtgggatcctggttagggctgattctgactgtatcatttccacttaatgatttggatctgttgggcctgtccagttttattgattgtgtttgtaggtaccaaagtgagaatggttagttaaggtcgcagcgtcctgcctggtgctctagctctgagatactcagcccctatcagtttcctacagcaagcaaggagctgccattcaaaagaggcacaactgttggctgcttcaggaaattttgtgtccaaaatctgagtctggtgcacccagtgacagtagaatcacctgacatcagatgttagtctgagccctgatgtgtgatacaatgtgaagggttcaggaggggtcattcttcttggcaaattaggtgttcagaagagccagtagcactctaaatctcggttgggggaaactcaaattattgagtccccacagagacctccataacattggttcatgagactcccagggaaagctgggaaagatgactgactgaagtccatgtgttgaatcattctcattattaaaagcccctgctcattaatggcatttcgattagcatccacttggaaagcatttttttttttggattatggctcattttaaaaacatctagtcatagctcttccacaatgactttgtctgtaatcatcctgttgcatttcttttaaggcctgatgatctgtcaaaaccaacagccaatattattaaaatgttattctctttgcaatgtgatcatcagacataggccttgcagtttacccactgttttgatttttacatttccagggcttccttgacaatggcactgatgtgactccatccagcatccattgttgtgagaactctatttggcatatcatcattgtgggcatgaacataatggagactttcataggatgcaatgattaatattcaacattagtcaaaatttcttctagtcctacccttggagctctactgggttggaaaatattttcggacaaggacaatcatttggtagagttttaaaaataaaggctacaaataaattttccatagcaagagtatgaactatgtgtggtccagaatacaattttttatggaatgtaacaaaaattatttaaatgtattcaatttagataataattttacaaataggcatatattgcatatataatagaattaacacacttaagtatgagtactatatatatagccaacattttatcaaataatatattgacttgtatgtatcttacatacatgtatgcacattttcccataaatatggtaaattttaattttttattgaaatattagttttaattttgtcattaattttctaagtttataatttgattactaaatatttacatttatgccactaatttaagaaaaaatacatgtgtgtatatataggtagaggtgtaaatactgtatcaggaagcttttatgcattaatgattggtaactggctaaatacacaactcagtgacagaaaatagtaaacatttgttttcatgttcatagatgctcacgttcacagtaatctggctgatcaaggaagggttcaggtgagtggtttctctgcatggcactgagctcgtcttcagcctacacatatcaactgtctgaggacaaggctgaacagcagtgactacccatgactcaagattcttctggcaggtcacaagagtgaacagcatcccaaaccaaactgcacagttgagtttaagtccaataatttctaacatagcttcacacatttcaaatatattgctttatttcagtgagtacaaatttttaagaaaatgtttactccatttaattatagaggtgtttgatcattccatggacaaataattatgttttcaacctttacaatattgaaaatatttgcaaatgtaaatttgcattaataagaaaataaagctggatgcgttttcaacatgtggctttaaatataatttatttaaatggcctcatgggggaaaatcattttaacttacataaattctcattttgtctctcttgtttcttatagagttgcccaataagaagtcctcccatgagatttggaagtccgaaaaggatgactcaatattctccattggtacctaagacagacacagggacagacatgaggactagagaaacacctgaaaagatgctgtaggaagctgagagcatcagcacccccacccctaagcttccagacaggactgaggaccatatggttagaaagcccatacttcagaggaagatgcattctgttgcctgagggaggatcagagattcctgcttctaatatcagctttcatgactactatatccttggctttgaaaggttgtagtgggaaacttaatcttaggaatttggtcattcttgtcatacccaacagagcaaagaaaccagtggggaaaggcactcagggtgcaaaatattgtttctagaatgcaattgaaataggccctattatcccatggaactaatgtttatgtttttttgtataaacatagaaattgactcccccagtcttaaaactcaagatagttacatctgtcttatctgagtttttttttgtttgtttgttttttcagtaaaccaatgaacaggcctcccagatactatcaaggagctgaaacttacatatcactgaatcgggacagtgagacatcagaaccttcacccattatgattgcctcactgacctcctgcttcctgttgaccaaattatcttccttacccctccctaattcctgttttcccacatttcttccctgctatataaactcctaatttcagttggtcagggagatacatttgagaatggtatcacatctcctaggctgcagcacctgattaaagcctgttccttggcaatgcttgttgtcttagtgattggctttctgtggggtaagctgcagagtcttcactgaatccctggcatttcagtaacaaaattctctgcaaccttcactgctttggcttattgtaacctgaaatcaaatttgtccacaacttctgagataacttgatataattctaggattcattttgtccaccactgcttaccagtctgagcttgccagctcccaacccttcctagtgccaatgaactttctcaaagagccacaggtaacattttccctttttcataaaatgctaattttctcttcgttcttccaatatcttgaagaccactgagttttcctgtatgccccacctggcaaatatttctttgcaaataaaacttaaatttagagattcatctctacattttattttgactttagtagtttactttaattctctgtattaagacaattcctgcttagaatatctatagtggcttcttctgtgttatatgaattcaagctgaagccataaactagactcctcaagtgtcatgatctctgtatttatcaaatcaggagatgcattgctatgtctgtgcagttggggctgagaaagagaaaagaattagggtgcagaggcgatttcacgtacccctctaccaacaccatcagagtgtggctgcatctgagcaacactctcagccaatggaggcatcaggaggagcagctggggcagcccagcttcacacatctgcttccctgggggtttatgttcgggttggtaacactgtgggagggaaactgttagcctgttgacaatagtaagttgcaaaatcttcaggctgcaggctgctgatggtgagagtgaaatctgtcccagatccactgccgctgaaccttgatgggaccccactttgcaaactggatgcagcatagatcaggagcttaggggctttccctggtttctgctgataccaggctaaccagctgctaataccctgactcgcccgacaagtgatggtgactctgtctcctacagatgcagacacggaagatggagactgggtcatctggatgtcgcatctggaacctgagattggaaacataaaaacaaatgtccacacaattaatcatgctgtaagagaagttccctgaatagtaaagcagtactcagcacactgaccgagtataatcctagtgttctcctttcttacctgggaaccagagcagcaggagccccaggagctgagcggggaccctcatgtccatgctgtgtcctgactgggtctgactcctgcacagggtgtgatcagcctgttaataagtcttcaggtcaggagactgtgctctgggaacatgcaaatgagcaggggatggggcaggctgggcgcagctgcagggctggctcatctcagtaactcagcaccagctcagtgtccccaggtgtcccaggtaagaccagggtagcacaaatttgtctgcagagaatgtgtttctactgggaactattttgttgtgagtaacattttttggtttctttttgacgatttgaaatattcctcaggagttgatggactaatgtatttcattggtgtatggggattatttaggagaatattgttgtttgtaggaaacacatagtaaaatgttagacggtacaattctcaagtcttcaaaagactcttatatgattccggctagggaagggggtatttgtcgtatacatgcaacatttctgtgagtttaacattgttcctatgtaaaaaaattaaaaataaaatttattgacatgatggtacatacatttgtaagtatcaggtaatggtgttatgccattgttcttaccagtatgagatcaaactatgtactatagatacacaaagatgataccgtgttttctcgatgcatgcagcagtcacagatccacaattatcaagagcgacaggtctctatagtactcagacactaaatgggttgcaccttattcttgttttgggcaccttcatagtctaccttcttttctgccattcagtattatttcccaaagttcatctctcttactgagggtgaccactgcatggagcatgtccctgccatgcaccatcaatgacactttcctcttttactttttatcagtgattggggaaatcatcctgacccaggcaacagcctccctgttaactgctttaggaaagagacactgaatctcttatcaagcagttgcctatgtacatggagaaatcacttggatccagatgaaactggacagggatttgcactcgttatatctcatatctctaatgtgcccaaaaatgtcccagcctgactcagtagcagggaaagtggatccaactacatcagcatcagtgggctgccacctaggactccacaaaattttactgatgcctgactaggggagccaaatcacagtgctgcaggctgtgcacaaaccttcctgctgttttttaagctgcctgaattttaagggaacttgcttatattgggagaaaggaagaaagctccatttgtcctctaaatatttgctgaaaatgaatggacaaaagaaagattaataagagaaaagacaaacaaaattcatttgaagtgcagcagaatatcatagcagggtgattacccagataactcaatgggatacagttgtttatatttcttttctaaggaagagggaattgagaagtgtaggcaacctggaaagaatagatgagaacagaagtgcatcctcaaaagaacaggtcatagcctgtctggataaagcatcaacttcagtctcttgtattttagattcctcttttgtgttaatattccctgatgtaaaaattctcaggaagaatttttttgacaattggtttccttctggagaatctgctattatgcagataagggacatttaggaaaagtctttttgtgcatttggtgctttctaaatgtctttggttttacataatcatcataccagtgcagcgtagtttgagatgttattttctggattcctttacttgcaacccacctgccaagatcctgttccagagagatgcagctacagattgaatgagcagttgacccttgaacaacatggaggtttgggcactgaccatgggtgcagatgaaaacctgtgtagaacttttgcatttctaactccaggcatcatcttgaaagtggagaaagcagaccttaacctgcccatgtcttgatctttaatttcccattctccagaactgtaagaaaataaatttctgttccttatgaattacatagtgacaatgaatctgttatagcagcttgaaatagaacaagagagacagcgcacaatcagtgaggacacgatgaggtgtatacataccccagcttcctcatctctcaggtggaatagcccagaggaacttagtccatgtttccacatgtggttgatctttggttatcctgagtcaggtaggttgttgatgtgtctttttccattcatcttctgttctcttcctcactttcctcctttcctcccagtgtaaatttgctgcctaaacagggatcctcattgagggtggacccaaactaagatagttaaaaaaaaaaattgttaatcttttgtaagaggggtatttctcatctgaattctgataatttctttttctttgacatgtaggaatattcaggaggcacttaatttttttttttttttttaccaatctgttttacattcaatttgtgaactgattttgtttttctgtgtgttaaaaccaaaaattaagttgtaagccaccaacctgctgaatggactcctcttttgtaaagagcacttcaaagaaatttgaaaaactaggttaggccatgactggcaggtgggtttagatgtgcctcattatactttggagttcagacacaactgaccaacattgtcattacaacagagatctttgggctgacaaaacagacgctttgtagcattaagataccatattccaacatgacagataataggccctgaagaaaatctaaatattttaccttaaaaatatttcttcatcatattctgaagtggttctgcaaagctgccagttgtgggggaaatttgcattctatagagaatctcctccccttactaagtcttttttaaagtctgacattttttaaagctctgataagcaacattcaccttgtactttatctgctactgataggattcatctacatgacaagaaccttggcttccacatccccttttctacactcaagcatttctttatgatgaattcaactctttagacagaccttaactctttcaaccagtagccagtaaggaaagctttgaattcacctatgacctggaagcccctgcttcaagctatcccacctttccaggacaaactaatgtatatcttatatgtattgatttatgtctttccctgtatttctgtgtttccctaaagtgcttaaaaccaatgtgtaatccaaccgccttgggcacatgtttacaggaccttctaaggctgtgtcacaggccataagccttatctttggcagaataaccctgtaaattgattgagacctgtctcagatactgttttgtttatactgggtcacaaaatttaaaaatcctctaaaactatctacacatcaataaatctacattagagacagtggagtgagcataccccaacagataaaactcacaagttagaggaacctgagtctaagattttgtccacctcccttgattcataaaaatacttcgtgattttttaaattttactttagagaaggacaattttggggaatatgtttatggtcggtggaatgaataatgtcccaccccaaaggatgtccatgtcctcatctctggaacccaagtgttataggagtttttaagaaattattttaggcagataggaaaaggggtccttgggaaggttttgtttcctttaaagcagctctagaaacacttcttgtctagccagaaagccctggctcttagagccaggctgggaagctttcctatgcaaatcatagccattagaaactggattcacccaaacatggtgattcccaccgttttcttccttgtcaacacatgtgcctgggaaaaacctgaaagatgctataggaagctgagagcagctgcaaccccacccttaagctttcagacaggactgaggaccacatggttagatagcccatacttcagtggcagatgcattctattttctgagggagtaccagagaatcctgcttctactgtcaacctgcctgactactatatccttggctttgaaaggttgtagtgtaaaagttaatcataggaattcggtcattcttgacatacccaacagagccaagaaaccaggagggaaaaccactcagggtgcaaaatattgtctgaagaatgcaattgaaatagaccctattatcccatggaactaatgtttatgattttttgaataaacatagaaactgactcccccagtcttaaaactcaaggtagttacatttgttaatctgagttcttttttcaggaaaccaaccatcaggcctctagatactatcaaggagctgaaagttatatatcactgaatggggacagtgagacatcagacccttcacccattatgattgcctaactgacctccagcttcctgttgactaaattatcttccttacccctctctaattcctgttttccacatttcttccctgctatataaacgcctaatttattttgtcagggagatacatttgagaatggtgtcccgtctcctcggctgcagcacctgattaaagcctgttctttgacaacacttgttgtcttagtgattggctttctgtgtggtgagccgcaggatctatactgaatccctggcatttcagtaacaaaattctctgcaagcttcactgctttggcttattgtaacctgaaagcaaatttacccacaacttctgagataacttaatataattctaggattcagtttgaccaccactgcttaccagtctgagcttgccagctcccaacccttactacagccaacaaaatttctcaaagaacaataggtaataatttcccttttaataaaactctttgctcttccaacatattgaagaccattgagttttcctgtatgccccatttggcaaaaatttcttagcaaataaaacattaaatttatctgtacattttatttagacttcaatactttagactctaattctatctattaagactattcctgcttagaatatctataatggcttcttctctgttatatgaattctaaccaaagccataaactagactcttcaggtgtcatgatctctatctttattaaatcagcagaggcattgtaatgtctgtgcagctggggctgagaaaagaaaaagaaattgggatgcagaggtgatctcatatcctcctctaccaacaccatcagagtgtggctgcatctgaggaacactctcagccaatggaggcatcaggagaagcagctggggcggcccagtctcacacatctgcttccctgggggtttatgttcgggtttgtaacactatgtgagggtaattattaaactgttgacagtaataagttgcaaaatcttcaggctgcaggctgctgatggtgagagtgaaatctgtcccagatccactgccgctgaaccttgatgggaccccactttccaaactggaggcatcatagatcaggagcttaggagctttccctggtttctgctgatatcaggctaaagcactgctaatgccctgacttgcccggcaagtgatggtgactctgtctcctacagatgcagacagggaggatggagactgggtcaactggatggcacatctggcacctgagattggaagcataaacacaaatggtccacacaattaatcatgtagtaagagaatttccctgaatagccaggctgtactgagccccctgggctgagtaaactgctagtgttctccttccttacctgggagccagagcagcagaagccccaggagctgagcggggaccctcatgtccatgctgtgtcctgagtgggtctgactcctgcaagaagtgtgaccagcctattaagaagtcttcagggcaggaggttgtgttctgggaatatgcaaatgagcagaggatgggcaggctgggcacagctgcagggctggctcatctcagtaactcagcaccagttcagtgtccccaggtgtcccaggtaagaccagggtagcacaaatttgtctccagagaatgtgtttctactgggaactattttattatgagagacattttttaggttttttttgacaatttgaaatattcctcaggagttgatggagtaatgtatttcattggtgtatggggattatttaggagaatattcttgtttgtaggaaatatataataaaatgttagacggtatgattatcaggtctccaaaagactctcatatgatcccggttagggaaggggttactttgccctatacttggaacatttctgtgattttaacattgttcctttctaaaaaaaatcaaaaataaaatttattgacatgatgctatatatacatgtcagtattcggtaatggtgttatgccattgttcttaccactataagatcaagcaatttactacagatccacagagatgatgcctatgtacatggagaaagcagtttgatccagacaaaactggaaatgatttgcaatcattatatcgcacatatctaatgtgcccaaaactgtcccagcctagctcagtagcaggggaagtggatccaactatattagcatcagtgggctgcagcctagggctccacaaaattttactgatgcctgagtaggggagccaaatcacagtgccatagcccgtgcacaaaccttcttgctgctttgtaagccgcctgaattttaagggaacttgcttatattgggagaaaggaagaaaactccatttgtcctctaaatgtttgctgaaaataaactgacaaaaggaagattaataagagaaaaggcaaacaaaattcatttaaagtgcagcaggatatcatagcagggtgattacccaaataactcaataagatccagtagttcatatttcctttccagcgaagacggaattcggaagtgtaggcaatctggagagaatagatgagaacagaagtgcatcttcaaaagaacaggtaatagcctgtctggataaagcatcagttcccagtctcttctatttttgattcctgttttgtgttaatcttccctgatataaaaattctcaggaagaagttttttgacaattggtttccttctggagaatctgctttttggcagataagcgatgtttaggagaaggctttttgtgcatttgctgctttctaaatgcctttggttttatgtaatcctcatacgaatgcagcatagtttgagatgttattttctggattcctttacttacaactcacctaccaagatcctgttccagagagatgcagctacagactgaaagagcagttgacccctgaacaatgtggaggttggggcactgaccacaggtgcagatgaaaacctgtgtagaacttttgcatttctaacttaagtactaatagcttacttttgactgctagccttaatgataaaataaatagttgattaacacttttttaagttatttatatcatatactctattattccaataaactatgctaaagaaaaaaatgtaattaagtaaattataaaaatgagaaaatatatttactacttattaagtacttgcttacaggtgacacacacagaagaaaatacaagtggatctgcaaatttcaaacccaatttattcaagggttaactgtaccaggatgaatataggagtctctatctgtattctagggctttctctttgctgtacctctgctcacttccaatggcaatatacatgtcttatgttctttacagtcttgggcagagaactctgcctgcatgcattgctgaccaaatgacctggaatgtgtatctcttaggaaagtgctatggtttcactgtgtcctccagaatccatctgttgtaaagttaattctcagtgtaatggtattgccaattggggcctattgggatgtgtttagatcatgagtgtggtgccctctagtggaatacattaatgccagtataaacagcaattgtggggctgggatctctctctcttctgcttgtctgtcatgttaagacatggccttccttcctttgaaggaccccaaactccaggcatcatcttgaaagcaaagaaagcagaccttaacctgcccatgccttgaacttaaatttcccattctccagaagtgtaagaaaataaatttgtgttctttatgaattactcagtgaaaaggaatctgttacagcagcttgaaatagaacaagagagacagctcacaatcagtgaggacaggatgaggtgtatacatacttcagcttcctcatctctcaggtggaacagcccggaggaatttagtccatgtttccacaggtggttgatcttcagttctcctgagtcaggtgggttgttgatgcgtcttttacaattcatcttctgttcccttcctcactttcctccttttctcccagcgtaaatttgctgcctaaacaggaatccttattgcaggtggacccaaactaagacagtaaaaaaaaaaaaaaaaaaaaaatcgttaatcttttgtatgaggggtatttctcatctgaattctaataatttctttttctttgacatgtaggaatattcaggaagcacttaatttttctttaccaatctatttcagattgaatttgtgcagtgattttgtttttctgtgtgttaaaaccaaaaattaagttgtaggtcaccaacctgctgaatggactcctcttttgacagaaagcacttcaaagaaatttggaaaactagattaggccatgactggcaggtttagatgtgcctcattatactctcctccctttggagttcagacacaactgaccagcattatcattacaacagagatctctggactgatgaaacagatactttttagcaataagataccatactccaatgtgacagataataggccctggagaaaataaaaatattttatcctaaaaatatttctttgacatattctgaagtggccctgcaaagctacctgttgtgggggaaaattgcattctatagagaatctcctccccttactaagtcttttccaaagagtctgacatttttttctaaggtctgataatcaacattcaccatctactttatttactacccataggattcatctacatgacaagaaccccccattttctagactcaagcatttctttatgatgaattcaactctttaggcagagcttaactctttcaaccagttgccaatcaggaaagctttgaatccacctatgacctggaaacccctgcttcaagctatcccacctttccaggacaaacttatgtgtatcttatatgtactgatttatgtctttgcctgtaatttctgtgtctcctaaagtgtataaaaccaacgtaaaatccaaccaccttaggcatatgtttgcaggacctcctaaggctgtgtcacaggccataagccatatatttggcaaaataacctgtaaattgattgagacctgcctcagatagtgttttgcttacactaggtcacaaaattttaaaatgcctaaaccgcagcagcccggcattcctccaggacctcctcccccgggatcttgcttcaagtgctggaaatctggccactggaccgaggaatgcccacagcctgggattcctcctaagccgtgtcccatctgtgcaggaccccactggaaattggactgtccaactctcctggcagccactcccagagccactggaactctggcccaaggctctctgactgactccttcccagatcttctcagcttagctgctgaagactgatgctgcccaatcgccttggaagcctcctggaccatcacagacactttgggtaactcttacagtggagagtaagtccatccccttcttaatcaatgtggagtctacccactccacattaccttcttttcaacgacctgtttcccttgccgccataactgttgtgggtattgacggccaggcttctaaatctcttaaaactccccaactctgttgcgaacttggacaacattcttttatgcactcctttttagttatccttacctgcccagtttccttattaggtcgagacgttttaacaaaactatccacttccctgactattcctgggctacagccacacctcattgccacccttttcctcacttcaaagcctcctttgcatcctcccctgtgtctccctgccttaatccacaagtatgggatacctctactccttccttggcaactgatcatgcaccccttaccatcccgttaaaacctaatcactgttaccactagagcctgttatcacccacctgttacaacatggcctcttaaagcctacaaattctccttactgagggaagagagagaccctctcatattgttttatattgttttatactcagtacctgttttaagagtaaaaatcaaggaagtgaaatcagagacaggcagcccggcgccaggcctgggcctgcctggcctaaacctagtagttaaaaatcatctcatgacttagcaaccaatgttatccatagattccaagcattgtatgaagaacattgtgaaactccctgttctgttctgtttgactctgactaccagtgcatgaagaccctgttacataacccctagattgctcaatcaatcacgaccctttcatgtaaaatctttagtgttgtgagcccttaaaatggacagaaattgtgcactcaaggagctccgattttaagacagtagcttgccgatgctcccagctgaataaagcccttccttctacaactcggtgtctgagaggttttgtccatggctcatcctgctacattacaactcccctatcctacccatccaggaaccagacaaatcttacaggttggttcaggatctttgccttattaatcaaatcgtctttcccatccaccttatagtgccaaacctctacaccctcctatcttcaatacccccttccacaactcactattttgttattgacctcaaagtcaccttctttactatccccttgtatccctcctctcagcctctttttgcctttacttggactgaccgtgacacccaccaatcccaacaactcacctggactgttctgccccaaggcttcaggaacagcccacactactttggccaggccctttctcatgatctgctttcttttcacctgtctgcctcccaccttattcaatattttgatgatcttcttctttgcagtccctcttaccaatcttcccagcaggacactaccctgcttcttcaacatctctatttaaaggggtaccgagtatccccctccaaggcacaaatttcttcccctagtgttacctatctcggtataatcctccatcagcatacacatgcccttcctgcagactgtgctcagttaatctcccagacccgaatccccaccacaaaacaacaactcctttccttcttaggcattgttggatatttccgactctggataccaggctttgctatcctaacaaaaccactttacaagctcacaaaaggtaacttaactgatcccatagaccctaagttttttgcccattgttctttttgctctctcaaaaaggccctggagacagctcccacactagcactccccaactcgtcccatgctttttccttacacacagctgaaatacaaggctgcgctgctggagtcctcacacaggagccaggcccatgacctgttgcctttctatcaaaacaacttgacctcacaattctggtgcagccctcatatttgcgtgcagcagcagctgctgctgtaatacttctggaagccctcaaaatcacaagctatgctccacttaccctctacagttctcacaaccttcaagcattaatatcctcctcacacctttcacacttactgtctgcccctcgactcctccagctctattcatcttttattgaaaccccaacagtaactattggccatgggcacgatttcaacccagcttctcagttagtaaccaacacaagtcctgaaccacgtgactgcatttccctaatacacataggatcttcctcctttcctcgtatttctattcttcgaattcaaaatccagaccacccaatcaattttcaccaggtaagctggatatgctgtcatgtcccacatctctattattgaaactgctgcacttcctccctccaccacttcccaacaagccaaactgattgctttaactcatgtgctctctctcgctaagggaatgcacattaacatttatactgactccaaatatgctttccacatcttccataaccatgctgccatctgggctaaaagaggcttccttaccacacaaacctcttccattatctatgcctccctaataaaggtcctccttaaggctgctctcctgctggccaagcctggagtcattcattgtaaaggacaccagaaacctactcatcttattgcaaaaggaaatgcctatgccgacaggacagcaaaagaaatagccaatgcctccacacccgctaatattccagctcccactccagaggaccagtatttttcttccttatctatcactaccacctactcttttgaaagcctgctctactagtcttttccaactcagggaaagtgcttcttaaatcatggaaaattcattcttcctgcctcacaagctcagtccatgctttctttccttcatgaccacttccatgtgggatacaagcctctggctcgcctcctgcagcccctcatctccttctcttcatggaaatccatccttaagacagtcacctctcaatgctcgtctaccatgccaccagcccccaaggctttctcagccctcctccttttcctacgcatcaggctcatggatttactccaacacaagattggcagattgacttcactcatatgccccatatctgtaaatttaaatatctcctggtttggattgacaccttcactgggtgggttgaggcatttcccactatctctgaaaaggctactgcagtcatttcttcccttctaacagacataattccctgatttggcctccctacttctattcaatctgacaatggtttggcttttattagtcaaatcctccaagctgtctctcaagctcttgatattcagtggaaacttcataccccctaccatcctcagtcttcaggaaaggtagaaaggagtaatggtcttttaaaaacacacctcaccaagctcagcttccaacttaaaagggactggacagtatttctaccacttgcccttctcagaagtagagcctgacttcaagatgctacagggtacagtccatttcaacttttatatggacttactttcttgcttggccccaaccttgttccagacaccagccctctggacaactatcttccagtcctccagcaggctagacaggaaattcgcccgactgctaatcttctctttcctactccagattcccagccatatgaagacaccctagctgaatgatcagttcttgttaagagtctgagccctcaaactctacagcctcgatggactggaccctacctagtcatctatagcaccccaactgctgtccatctgcaggaccctccccattgggttcaccattccagaataaagctgtgtccattggacagcaagcctgatctctcctcttcctcctggaagttgcaagtactctccactacttcccttaaactcactcacatttctgaaaacagtaataacccttatgaacctaatatgttccttcattctattaggtctattcatccttactctactttttgcaacagggctttacacagtcacccccactacttggactgtgccccaaaacttgtcatccctactatcttctgtctagtcatactcctattcaccattctcaactactcataaatgccctgctcttgtttatactgctggtttacactgtttctccaaaccatcacagctgatatctcctggccctattgccaaaccaccactcttgacttcctcttggagtggatagatgatctttgctggcagggcacactccaatattttcaccatgatgaagtcctattctttatttttatactcactcttattctcattcccattcttatgccaccctctccctctccccaactatctccactacactatcagtctcactcactctctccaagccatttctaatccctccttagcgaacaattgctggctttgcatttccctttcttcctgcgcttacaaagctgtccctgccttacatacctactgggcaacatctcctgtctccgtacatctccgaacttcctttaacagccctcacctttaccctcctgaagaacttctttactttctagacaggtccagcaagacctccccagacatttcacatcagaaagctgctgcccttcttcgcacttacttaaaaaacctttctccttatatcaactctactccccccatatttagacccctcacaacacaagctgctattcctgtggctgctcctttatgtatctctcggcaaagacccactggaattcccctgggtaaccttgcatcttctcgatgttccttcactcttgatctccaaagcccagctacacataccactgaaacaattgtggctttccagctccatattacagataagccctctatcagtactgacaaacttaaaaacattagcagttattattgcttaggaagacattaccctgtatttcactccatcctttgctgccttccccttgctcttcagactctcctcccaggccctcttcttgtttgcttatacccagccccgtaaataacagtgaaaggttgctcatagacactcgacactttctcttacaccatgaaaatcgaaccttcccctctatgcggttaccccatcagtccccattacaacctctgatggctgccgcgctagctggatccctaggagtctgggtacaatacacctcttttagtactccttctcatcttttcactttgcagctccggtattgccttgcacaaggtctcttcttcctctgtggattctctacctacatgtgtctatctgctaattggacaggcacatgcacactagttttcctaagtccctagattcaatttgcaaatgggaccaaacagcttcctgttcccctcatgaaaccgacacgataaaaaagtgttattccactaattcccttacttgtcagtttaggaatttctgcctccactattgctctcggaactggaatagcaggcatttcaacctctgtcacaaccttccttagcctttctaatgacttctctgctagcatcacagacatatcacaaactttatcagtcgtccaggcccaggttgaatctttagctgtggttgtcctccaaaactgccaaggcctcgacttactgctgaaaaaggaggactctgtgtatttttaaatgaagagtattgtttttacctaaatcaatctggcctggtatatgacaacataaaaaaactcaaggatagagcccaaaaactcaccaaccaagcaaataattatgctgaacctccttgggcactctctaattggatgtcctgggtcctcccaattcttagtcctttaatacctgtttttctccttctcttattcagaccttgtgtcttccgtttagtttctcaattcatacaaaaccgcatccagaccatcaccaatcattctatatggcaaatgctccttataacaaccccacaataccaccctttacccgaaaatctttcttcagtttaatatcttctacactatgttcccatgccacccctaatcccactcgaagcagccctgagaaacaatgcccattctctctccataccaccaccaaaaatttttgccaccccaacacttcaccagtattttgttttttcttattaatataagaagataggaatgtcaggtctctgagcccaagttaagccatcatatcccctgtgacctgcatgtatgcatccagatgacctgaagcaactgaagaacaacaaaagaagtgaaaatagccagttcctgccttaaccgatgatattccaccattgtgatttgttcctgccccaccctaactgatcaattaaccttgtgacattccttctcctggaaaatgaatctcaggagctcccccacaaagcaccttgtgacccctgaccctgcccacaagagaacaaccccctttaactgtaattttccactaccctacccaaatcctataaaactgccccaccactatctccctttgctgactccttattcggactcagtcagcctgcacacaggtgattaaaaagctttattgttcacacaaagcctgcttggttgtctcttcacacacacatgtgtgacagattacagccctactgacaccttaacattagctcagtgagacttctgacacggggtactatattttatttgtgtgaagccaataagactgtggtgatttaaacagcagcattggaaactaatgcaaggggaagagatgtctttcacctcactgagagcatggttgtcctctgttcttggaaatatttccaccttgttatctggtgtcaattatgacatattttctagtatttaaagaaaagatctgctgccctaaaatcctatgtccagtaaaattattatttagaaatgaaggacaaattgagaagtcctcagttgtagaaaaactaagagtatttgctgccagcagatccactttaaacataggcaaaatgagccctaggaagataaaactaaagataaagagaggatgttaaataatgttagggacaaaaggctacaaaaatgagaagatagatggatataatgcattgctaaatcatgtgtgatagttgtatcaaagttgtaatactgttttgttcctaatatatgcagataaattacttttaaaaaacaatctatttacaatgggggaggaaacatgacataaaaaaggtaaaattctatatttattttaaatggtaatatattgatgccaacatactgtgagaagctatgcatataaaggaaataccatgacaaccaatttgaaaatcattataaaaagagataccccaaaattaggtaaaattaaaatgaaattgtgaagatgttcaagtaacccaaaagaaggcagcaaaaagaaaacagagaagcaaaaaaagatatagcaaaaaagtagagtgcagacttaaattttaatatatcaatatcaatatattaaatatgcaaattatgaaactttgaaaaagacaacaattgatgaataaaaagaaatgtcccaactgtatgttatctacaagacactcacatcaaatataacagtataagtagattgaatataaaaggaaggaaaatggtatactatgcaaacattaataaaaagaatcagtagcaaatactaatatcagataaagtagactacagagccaaagaatgttaccaggggcagaaaggtacattacataatgaagaaagtcattttggaaagaagacagagcagttctaagtgcgtagacaccaagcaacagagcgatatagtgcatgtggcagaaactaacaaaacaattgcacacagagacttcaaaaacccctttttaatcttcgataggacaactggacagaaaatcagcaaggatttaggactcaacaatatcatcaacccacgagatctaactgacatttatagaacactccaacccataacaatagaagttcacatttttttcttccaagtgcccacaacatataccaagataggacatatcctgcccacataacctctcaacatatttgcaataattaaaatcacagtgaatgtgttctctgaccatggagggatcaaactagaaatcaatattgaaaatgtaacccccaaattttcaaatatatgggaactatacaatattgttctttccaaagaaccagcctttggcttgcctggtgttcagtgtcactttttctgtttgcagttttattgatttctgccctaatatttattatttattttgctcatgttctacttcagatataaattgctcctctttatgtagtttcataaggtggaagctgagattattggttttatcccttttattttctgaaaaatactcatatgcatatgtttatctacgtgcatacacatgcataaatatgtgcagatgcatatgcatacacgtggttttaataccataaattaccctgtaagtgctgctgaatacctatgcgtattttcttttctctgagctcaaactccactcacttgcaaacctgcccacttaatctgcatgttcattggtgtctcaatctagaattgagcaaaaataacaaactcctttcattttatctcaactttcttgaccgctaatacatttaacatcagtaagtcagaatctatctaatagattaaggccaaagctgccaggtcactcctaatctgactcttctcacaccaaggagtgtaaatgacattgatttaaaaatatggtatcatctgcctatgtctccaacaatcttcactgccccaaaactagtttatgccaggatccactttgcccagataagcatctcttctgcttctcacagcccaattcgagtcattactttgctaaaaaataaatatgaccatgggggtactttggttaaaaaaattcccagaatgtcctgctgtacttacaaagcatttgctccccaaacagaaaatgaaggccttattaatttcacatcagtcacatgtggtgatctttaagacactgagagaaaatggctctgacctgccccctcacgaactttctcttttttacctcggttggttaagtcactctcctcatagtgcctttctctgtccttcacacgttcatactgtattccttctaagcgccttgattgtcatgaacctcagtgcccttcagaaacttctcttcaggtcagttgttctcctcatccaggtcagtcacctcctcagaaaaagtagcctctacctccctaactaactgactccttttcctcattaaccacttcctcttcccttgccatttttttcctttatgacccttaactttttctagaatctttttgttgatttatgtttaattagacatggcctttttttcaccagaaaagatataggtaaatgagagtcagacactgactttctcaggggtgcagcctagatacgttcctggtccagcatagttgctcaattaacactttattgaatgaatgaataatgaaaagttagtaagaaactctccaagacataatcaacactcataacctatacacgttgaaaacaacccactgaatgtaaaacatggattattctgagtaatgagaagtttgaatagcagtgtgctgctcttcatagtcagctcttcatagtcagtgtgctgctcttcatagtttgtattttgctggggagataaggaagacatccaaagtccatgataatcaggtaagagtattcttatcttttttaaaaaacaagcaaatagactttgcagtcacaaaaaaattgcaataaatgggactacactatcacttaactctattggctcctgttcacaaaaacaggttgtattattaactcttctttgaaaacaaaccagctccaaacaaaatgccataaaatgagtatgtgcagtcctccctcagtatccatgggaaatagtttccagggcaccctgcagatattccaatttttggagactcaaaacctttatgtaaaatgcacaatatttgcatataacctacacatatcctcccgtacatttcacaccatctctagcctccttatagtacctagtacgatgtctacacatgacttaacttgtgtagattcatccaagtgttactcagcacatggcaaagtcaagctttgctttttggaattttgtggatttttttttcaaaatatttttgatccaggattagttgaatccatggatgcagttcccatggatagagagctgactgtacagctccttataattctgagggtcagctctgtggttcttccattctgggctggctggactgatctctgctgagtccgctcttgtgtctgcagttaccctgtggttcatttgcgactggatggtctgatgtgacttctttaacctatctggaagctggtttgatgtgcaggttggacaacttttggtatcggtttacatgggtcaggaagatgggtcctattccccaatctgtattaggtttgttcccagatcaactctggggttcaagtctattcattgtgggttgtttgggagaaattctacatgaacaaagctgaactgctgtcatttattgctgttagcagttattgttatcctctgaaatgcatcttatataaccaagatctccccagggtggcccaacagtacagctcagctcagcccatcctgtcacttcgctggatgactgcaggtgtgagaaaggcaatatgctcagtcacaggaaaggcaggggcccaccctggggctgaaacctgcagacacagcgttcacacagcttctttgcaaaatacgaagacttcattttctttatacttaagatagttatacatttttttctataatgtccctatgctatttaactatttttaattttcagaactggttgtatttattatttctgtgttaggtgctcttagtcacttatggcaagagtgagttaatagagacaacatacagagtagccatggaacaatagagaagtgtgtgtattcagacaggataaagatcaaaggggtgacaaatacattcttttgagaagcagattctcatagatcaccacaagtcaaggtccacattcaaggtgcagtggcgtgtcagtcacattgtgcaaatggtcagctctgcacattaaacttggctagcacattgcaggaccaaaattacctgtaaaggtatggggaaaataaaccatcatggaaataacaatttgaaggagttctcaattatttatacttggatataaagcagaacgctacaatgaatgaacctacaacctaaaacctttaagccttttaaagaggtttctttttgtcagggtatttctcagcaaataatgataaaaaatttatggataaactacttgcacaattagccacaataaatcccttccctgtactcatcctttggttggcctcattctaaatggatgcaggtgttgcccatgtgtcttgctcaggccaataggataatagcagatgtgacacaagtggagtcttggaaagggcttgcacatcgaagctttcctctctctcacagtgcttggaaaccctaaggtcacaatgagaataagcctgtgcccatctacagtcaatgtcagtggcatggctgctcttcggtctactatttgttcttaaaatgtgtgctaagtttgttatggccatgtaacaaattaccacaaatttatcagcttaagactacacccatttatcatctctcaatttctgagtcagcagttggcacatggctttgtcgggtcctggccattggatttcacaagactgtgccacagtgtagattgggcttcattctcacctgtgagtcccctgagaacatagatactttagagctctttcaggtagttgcagagctcattccttagcatttctatgactcagggcttcaatttctaactggctcttggctcaaggctgctcttaggtccaagaggctgtggacaattccctgccatgtgatgctcacacaggcaatgcccacatggctggttgcttgttcatggtcagcagaaggtttcagagagtgtctctttccagtctgctatgacagaggcttatagaatacaatcattggaaagacatctcataacctatgacatatcatatggattagaagcaagtctaggttccgcttgctctctgtggaggtagattatacaattgtgtgattcactggggagagggttctgctagggtgttctggcatctttagtttcctcaaatatcaggtacttgtactgagtgtgaaatctgtcctgtacttactggcattgactagtcctgtgacccctgggaacatcttgggaagcatactttgtaagagaggttttagggtaacctagctattggaagcataacatttgcaaaatatcctaatctttgtgatttctaacatgtcctcaaggttccttaattgcaattatcataagccaattatctctaaatatccgcaaaatttatatttaatagtaggaaaatgatttattaaggagtctattaaacaagactcagggaaatgatgtcaacacccaattgctgctgcccactgctagactatgtgagacaattttcatgaacaatagaacagatactgcatgctagacacttctgtgagcaccactggcctgctacctctagaaatgtttgcagaacaagggcaattgctatgagtctcaaaatatatatttttttattatactttaagttctagggtacaagtgcacaacgtgcaggcttgatacatagggatatatgtgccatgttggtttgctgcacccatcaactcatcatttacattaggtatttctcctaatgctatccctcccactgcccccgaccccatgacaggccccagtgtgtgatgttcctcaccctgtgtccaaatgttctcgttgttcaattcccacctatgagtgagaacatgaggtgtttggtttcttttccttgtgataggttactgagaatgatggtttccagctttatccatgtccctgcaaaggacatgaaatcatcctttttatggctgcatagtattccttggtgtatatgtgccacattttcttaatccattatatcattgatggacatttgggttggttccaagtcttgctattgtgaatagtggcatgataaacatatgtgtgcatagtaccatgatttataattctttgggtaggtacccagtaatgggattgctgggtcaagtggtatttccagttcttgatccttaaggaattgccacactgtcttccacaatggttgaactaatttacactcccaccaccagtgtaaaagctttcctatttttccacatcctcgccagcatctattgtttcctgacttcttaatgattgctattctaactgacgtgagatgatatctcactgtggttttgatttgcatttctcttatgaccagtgatgatgagcatttttcatgtgtctgttggctgcataaatgtcttcttttgagacgtgtctgttcacatcctttgcccaatttttgagggggttgtttggtttttttcttgtaaatttgtttgagttctttgtagattctggatattagccctttgtcagataggtagattggaaaaattttctcctattctgtagattacctgttcactctgatggtagtttcttttgtcatgcagaagctctttagtttaattagatcccatttgtctatgttggcttttgttgccattgctttggtgttttagtcatgaagtccttgcccatgcctacgtcctgaatggtattgcctaggtgttcttctagggtttttatggttttagatctaacatttaagtctttaatccattttgaattaaattttgtataaggtgtaagtaagggatccagtttcagctttctacatatggctagccagtttttccagcacgatttattaaatagggaatacttccccatttcttgtttttgtcaggtttgtcaaagatcagatggctgtagatgtgtggtgttaattctgaggcctctgttctgttccactggtttgaatctctgttttggtaccagtaccatgctgttttggttactgtagccttgtagtatagtttgaagtcaggtagtgtgatacctccagctttgtttttttttgcttaggattgtcttggcaatgcgggctcttttttgattccatatgaactttaaagtagttttttccaattctgtgaagaaagttattggtagcttgatggggatggcattgaatctataaattaccttgggcagtatggccattttcactatattgattcttcctatccatgagcacggaatgttcttctatgtgttttgtgtcctcttttacttcgttgagcagtggcttgtagttctccttgaagaggtccttcacctcccttgtaagttggattcctaggtattttattcactttgacttaatctgtgaagtgtatttaaattctcattctagagaagaaaaatccaaagtacttggaaaagagaaatcttgccatgagatacacagttcttcagtttcaaagcagagattatctctcagatattctggctcatacaattttcagtacactgcaagacagaagatgtgaagacaacactacccaattggccttacacttgctttgctcactgttaactaagttcactgtaaaaaaaaaaaaaaagattacaataaaacacattgtcaatgaactgtcacaaataaatacatctttagaaccacatccaaaatccagacatagaacatttctatagctccaaaacattttgacccactcttttggaatcaacttgctttctgcctcacagatcagggaattttgatctgcttcctgtcagtacagatttcattttccttgtaagagtttcacataaatgaaacataggatgcgctcttttgtgtctggtgacttttgtgcagcatgactctttctcagattcattcagatgtcctgtgttctaattatgtgctcctctttatttttgagtattatttaactgttcagtaattttatgatggatcccttcatctattgattgccgtgtgggttgtttccattttgggctattatggataaagttgctgtgaatgttcttgaacaagactttgcatgaacatatgtcttcatttcttttgggctaataccaaggcgtgtagttgctgtgtttatcagtaagtgtttaatactctgtccgactttaccgaaagtggctataatattttatatgtccaccaataacttattatagctccacaccctccaaaatatttcaattttttttttaagatttcacctaattgtcactcaacagtaaccagaatagctagtgattattaagctatgtttttcttcccattttcttgtcaatttggggaattgatgtgttacaggacattgagaacagaatcaatactgtcctagttccctatcaaacacttttatcaagccataatatttaggatggtaacatgatatataaagggagtgttggagtagtaataagtattttcaatacttattatattccataaagcaatatatcttcaatgaaatggcatttaactagacttagcatagtaaggttctcatctcaaccctagtattcagtattagcaaaagtttgaggaaaaaaaatatccagcaacataagccagagagtgttttgctagtcaagtagcactgcaatactgatgctcttctaatgccagcccttcacaataatttccactcagaacatttggttgcctccttgccttgttctccttatgggacttcatgctgagggcatgtggcatcacagagggagcagtgcacttgggtgcagaaatatagcttagtagattgtctggccttagaggtggctgcaatggaatacacattttcaaggaagttccctgttaaacctcctggtaaactgatagttaagaccaggtgcggggacttatccccgttatcctagatgtttgcaagatcaagtagggagggtagcagaaatctaggagttcaagaccagcttggaaaacacagggagactccctcatctctagaaaaaaaacactgtttgttaagatgtggtgtgaacaatggcatctctaagtgattatttattaacatttgctgagaaaattagaaaatagaacgatgccttctgatccaataatatcataataaagatgtgaagtttttaaactatggtaagtatagagaacataaaattgcccatcttagccattttcaagtgtacaggacaatggcattaagtatagtcacattgttgggctagcatcaataatatccatctccagaactctttccatcttctagaactgaaactccatagccattaaatgacaaccccctccccgtttcccctgctcccagtccctggcaacctgtaatcaagttctgtctctatgacagtgactgctgtgaagcaggtttgctgtgccctggttaccaacctgtcagagtccagggagacagaacaatcatacacaacaagttacaagaatctagtttagtatttacaggtgaccagcaaggcacggcagaagctgaggatttattgtgggtctttaccctgaggcacaggtaagtggggctgatggaatcttgactgtgtgtacccctcttggaccagagctaaggaaccccagaaagaagatgctctgggttttaaaccctggtgtcacaggacacatggagctaaagtactggaggacttaagtacaggaggacagtactagagggagctggatcagaagccagtctgttctgacctgtccctcgctatttcagaatgttacatttccagcacattctacaattattattgagaagtgtaagaaagagagtggggaaaatcaagtgagtccaggaccatcagaggactggagtgaagtcgtcccccaacacagacatcctccgtagaaagctattccattttatacgcctaccaaccaccgtgaactggaggcacaggtgtgtcttgtcagacggatgaagcaccttgactgacacaatctcaaagcaacatcattgagacagagccagaaaagatttcactgggccaatgaaaactactaccagaggcagaatgatcaggcccacctgaagcagttatgtagcccaggatcccatgatccacagaagaagttgctaaaggggtgaaagaagaatccttcaggtgggattttctgaatctgcagaatccattttctgcaattatgagcttgtttccagatctcctctacttgaatttctaggatacctgaggtgtttatccaggtatagcagggggtattggaaattgtatacattcctcccagttgggattttttaaaggtctagagcaacactgttatcttaaacatccatcccgatggagttaagggatgtctgctgggttaccaaggcagtggctatggaggaggagcaatatctgccatggtcagggacaagttccttatcatttcactttttttcatgagcactgactcctatacatagtaccaaaaatatcataaaagacataaacctatcatctgttgtaccttctggtaggtccctagtaagtctgaggtacagctttgggcttcaggctctatgatttacctaattccaaggagcaatatccagagacaaccccagcatgcccaacatgcaggatctcactattccacagatatccagagatggcatcacatatcctgcattttggtcactcccaaaccgcttacagagaaagatgtagcccttgggtgcatacagccccccttttcccatttttcttcaatcactctgtcatggttatgctggtattggtgcgttcattagccaagtctcactgatagtagagttgcatgagcaaagttttgctcatacaatattgtctgtagacagagggctagcattagtccagtccttgtttttatcattgccattgggatgtttctcatctatgcaatcaaaaaagtatggtgcatcaaaatattagtccaccaatgttttttttaattgtggtcatgacattcgccagaggcaattaagttaaacaggggtcctccagtttcctcccatgtggcaggtgtcagattctcactttgtgggccagtgcttgggtccttttgatgtacaccttagtattaggaatgttggtgtaatttacccttggtagaatgaaagggaacctctagttaatgacagaatgaggtcaagaatgggagattcactattttgaaagatcaccctggtgacctaaaagaagctaacaaagacattgtgcttctaggcctttgctgcctcattcttgtcaaaatgcagcctcacaggttaatgcatcgtctctcacccatcccagggtctcaggtgtcccctacccatctacaagggttgggccgtgttggtgtaggaatgcggtctggctgtccttgctctgtgaacaatccattgcctttgtcacttgatccagatatttcagtcctgattgtccactccaggaagggagattctgccctgtaaaaactggacatatttcataatatcaccaacactaaagggaggataagatgtccctggcaccagaagagggcccctagctccgtgatatttcttagtcttgttatccatcactgtgggatcttgtagaaaggaagcacccagaggaaacataatcctcctattagagttagggggcctgtctggggcattgtaatggcctagattgcaaaccaccccagagcatgtattctaaaggaaaaaaagaaaaggaatggttaggaacactgaaatagctttcacaggtccagactaatataagtgtctgcctggcctacctttacttccacccagctctgtgtttctcaacatgcactatttccctttttgtggcccaggatctttaatgtacatatttctctagtcagatgggataccaccccattaacagactttgtagatgtcctttctgcatattgctgtgtgattccactgatctagcattcactaggatcattggcctgtggatgcagggtgcatggaaagttcatcgtgttccatgagagtgtgcctattgtcacgttgcttgggcagtgaaagatgctcctttgtgagtgagaagtctcatggagtatccaaaaatatgacataaattgcactcaagggttacctaggtagtcccagcatcaaattcagcatcatatttctttttcctgcaggtggaaagctgtggccatagtcctttccttcacactggggattctttaatagtccagtctctcagttgccattttcctgaacagatggcaaggctgttgacaatggccgaggatttagtggatatgtggcatggtgcgttgttgggacagcctgcatggccattaccactgaatgtagttttgcccactgggtagaaagcccatgttaagtttcagttaaaaaagtggccatccactggctgaatggtggccacacctagtggatctgtcagttagcattttgctcagccttcagtgactcctgccatatggaaatctctgaatcttgggctccacatgggcaaataaagagccaaattatcacctacaagttatttggtcccttctagcaagctccccatttgttcatggagccacagatcctgtggggtcctgactaaacctgatcaagaatgtgccatttccatttgataacatggctctgttcagattgttcagttttactaatggtgtttgtaagtatctaagtgagaatggacagctaagggaccagtgtcacagtcacacatggtgctgaagccttaacatgttcagtctccatcagtgcctaatagcaagcaaggagttgccattcaatataaacacattcagtggctgattcaggcaacttatgtgtcctaagattgagaggctggtgcactcattgatagttttctgttgctatacgctccactgagtatgcatagaggttgtggatacctggacttccatctggttagcaggctgtaaaaatcttagagaagtgactgggccaggccttgttgaacagattccaaggctactgttgcaaaacgcctttttcaaagttggcaactttgttcatgattttgactaagggaaccaaaagaacacccaggtgaggtttatgccgtctcccattcgcaaaggggcctacctgccactgagtctccttttattcagtgggtgccacagcgaccaatgtttccagctgttcagttggcataataattaactatgagtacacagctcactttcactatacatatattccttgatggaagttacagcatcatacatgattagcgtgtcagaaccttcaccacatctgatagggtatcaattcaattacctagggtttgtgtgtcagttttgcttgactaagaatatgttttctcctttctatagagacggctgcacctgtgcaggtgataagatcatgaactgcaccctttgccttacttttttgttgtaaataatttgcccgattcaatgccatattatggaagaatttcttaactgtgatgaaagcacttggaaaatcctcaaataatatttcatgcagaaatataactgaaagaaagacaaatgcatatacaggaaaacaactgctgctcttctcatgttggatgaggcctgctaaaaacacctgacaccagctgttagtctgatccttgatgtctggtacaatcttgggttattctccttggaaaagtggatgctcagaagtgccagtatccccatgagtcccagttaactgaaattcatattgttaagcccatgcatggatagtcatgacatcagttcatgagattccctgggaaagctgggaaaggtaactgatgaagtccatgttttgaattattttaattattttgagctcctgcttctaatggcctttagataaatattcacttggaaaggatttattttttctactggtccttttttggaaggtccagtcatatctcctccagagtgactttgtgtccaatccttcagatgtgtttcttctaaggcctgatgatctgtcaaaaccactagtcaagatagtgatattgttggtaatatccagagcggggagaggacaatagtactcccaatattgcgggaggtgtacacccctctttgtgttattgttcttaatatccagggggaaaacaggatgacgttactaccaatatcgtggggggtttacaccctcccttgtgagattcttcataatatccggcaggggggtggataggactatattattcccaatatcgtggggggtgtacacccctcttgtgatattattcataatatcctggggggagacgacaatattactcccaatatcgtggggggtgtacaccccttattttgatattgttcgtaatatccagggttggagaggacgccattacccccagtattgtggggagtgtacaacccccttgtgatattgttcgtaatatccagggagagaggaagatattactcccaatatcgtggggagtgtacacccccaacttgtgatattgttcataatatccaggaggggagaggacgatattactcccaatatcgcccgggctgtacacgcccccttgtgatattgttcgtaatatccgtgggggaagggaagatggtattacttccaaaatcgtaaacacattgtgtgtacacccccctgtgatattgttcgtaatattcggggtgggggggagaggatgacgttactttaaatatcgtaaacacgttgtgtgtacacccccccaccccacgatattgttcataatatccagggagagagaggagatgatattactttcgatatcgtaaacacgttgtgtgtacacccccctgtgatattgttcgtaatatccgggagaggagagtatgatattactcccagtatcacggagggtgtacaccccccgtgatattgttcataatgtccagtgggggagaggagatgtattactttcaatatcgtaagcaacttgtgtgtacaccctcctttggtattgtccataatatccagggtgggagaggatgatattactggcaatatctcggtggctttacacacccctgtaatattgttcgttaaggagttaagaggatgatattactcccagtatcgcgggggagtgcacgcctctgtgatattgttcataacatcttgggagagacaggaggaaattactcccaacatcgcggggcatgcacagccccctgtgatactgttcgcaatatccagcggggaataggatgacattactcccaatattgccggggatgttcaccccactgtaatatttttcttaatattcaggggggaaggatgatattaatcataacactgcggggggtgtacacccttctgtgatattgttcattgtatccagggatggttggagatgatattactttcaatatcgtaaacaccttgtgtgtacacccccctgtgatattgttcctaatatccagtgggggaaaggataatattactcccaacatctcgggaagtgtacacgtccctgtgatatttttcataatatccaggggggcagaggatgatattactcccaattttgcggggggtgtacaacccactgtgatattgtcgtaatatgaagtgggagagaggatgatgttactcccaatatcgccgggagtgtacacccccctgtgatattgtttgtaatatccagggggggattggaggtgatgttagtttcaatatcgttgacaccttgtgtgtacacccgcctgtgatattgttcgtaatattcagagggggagaggatgataatactcccaatattgcggggagtgtacaccaccatgtgatattgttcataatatccagagaggggagaggatgatattatgcccaatatcgtggggggtgtgccccccctgtgatattcttggtaataatcggggggagatgacattacttccaatattgtggggaatgtacacccccttttgatattgtttgtaacatttggaggggagaggatgatattactcccaatatagtggggggtgtaaaatccccctgtgatattgtttttaatatccggggggatttgagatgatattactttaaacatcgtaaacaccttttgtgtacacccccctgtaatatcgttcataatatccaggtggggagaggatgatattacgcccaataccacggggttgtacatacccctgtgacattgttcctaatatccaggggaggaggggttgatattattcccaatatctcagggagtgtacacctccctgtgatattgttcataatatccaggggtgattggagatgatattactttcaatatcataaactttttgtgtatacacgcccctgtcctattgtttgtaatatccaggaggggagagtatgatattactcccaatattgtggggggtgtacaccctcttgtgacattttttgtaatatctgggagggagaggatgatcttactcctagtattgcaggtggcgtactccctgccatgatattgtttgtaatacacagggctgccaggatgatattactcccaatatcttggcattgtaccctggcccagcatgatgttgttgttcgtaatacccaggcagggagaggatgatataactcctaatatcacatgcagtgtaccccctctgtaatattgtttgtaataccctgtggtggagaagataatattattctccatatcaggggtgatttactcctcttttgtgatattgttcctagtaccctgtggtggagaggatgaaattgctcccaatatcaccaccgatgtgacattgttcataatactcagggcaagtctttcctgtgtttgtcccatgatagggaataagtctcttgagatctgatggttttatgaagaggagttctgcacaagctctctctctttgccttttgccatccacgtaagttgtgtcttgctactttttgccttctgccatggccgtgaggcctccccagccatatggaagtgtaacttaattaaacctcttttttttggtaaattgcccagtctcggatatgtctttattagaagcatgaaaatgggcaaatacagtcaattggcaccaggagagtgggccgctattgaaaagatacccaaaaatgtggaaatgactttggagctgggtaacaggcagaggttggaacagtttggagggctcagaagaagacaggaaaatgtgggaaagtttgaaactccctaaagagttgttaaatggctttgaccaaaatgctgataatgatatggacaatgaaatccaggctgaggtggtctcagatgaagatgaggaacttgttgggagctggagcaaaggttattcttgttatgttttagcaaagagattggtgacattttgctcctgccctacagattggtggaactttgaatttgagagagatgatttagggtatctggtgggagaaagttctaagcagcaaagcattcaagaaatgactcaggtgcttttaaaggcattcagttacataagataagcagagcataaatgtccagacaatttgcagcctgccaatgtgatagaaaaggaaatcccatttctgaggagaaattcaggccagcagcagaaatttaaaaaagtaatgaggagcccaatgttgttaatcctcaagacaatggggaaaatgtctccagggcatgtcagaggtcttcatggctgcccctcccatcacaggcccagaggcctgggaggaaaaagtggttttgtgatccaggcccagggccttcatgctgtgtgcagactaaggacttgttggcctgtgtcccagctcttccagccatggccaaaaggggccaatgtagagctcaggctgtggcttcagaggccccaagccttggcagcttccacgtggtattgagcctgcaggtgcacagaagtcaagaattggggttgggaaaccttcgcctagatttcagaggatgtatggaaacacctggatgcccaggcaagaagtttgctgcaggggtggggtgccatggagcactgctagggcagtgccgaagggaaatgtggggttggagccaccacactgagcccctactggggcactgcttagtggagctgtgagaagaggggcactgtcctccagatcccagaatggtagatccactgacaacttacaccgttcacctggaaaagccacagatgctcaacgccagcccttgcaagcagccaggagggaggctgtactctgcaaacctacagggacagagttagtcaagtccacagaaactcacttcttgaatcagtgcgacctggatatgagacatggagtcaaaggagaccattttggaactttaggtttaactgccctcctggatttcagacttgtctggggtctgtagtccctttgttttggccaatttctcccatttggaacagctgtattaacccaatgcctgtacccacaattgggcctaggaagtaactatcattcttttggtcttacaggctcataggttgaagggtcttaccttgtctcagataagactttggactgtgaacttttgagttaatgttgagatgagttgagactatgggggactgctggaaaggcatgattggttttgaaatgtgaggacatgatatttgtgaggggccaggggcagagtgatatggtttggctgtgtccccaaccaaatcccatcttgaattctcacaggttgtgggaggtacccggtggttggtaattgaatcaggagggcaggtcttctctatgctgttcttatgatagtgagtaagtctcatgagatctgatggttttataaagaggagttcccctgcacaagctctctctctttgcctgccaccatccacgttaagatgtgacttgctcctccttctgccatggttgagaggcccccccagcttatggaatcgtaagtccattaaacctctttttttgtaaatttcccagtctcaggtatgtctgtttcagcagggtgaaaacagactaatacaggattcagacagatttagaattttaatggcttcttgatggatttaccaatttataattataaaatgtccattttatctcttgcgttaaagtcatgacctagtttctgttgctcagttttacatgatatgtacttttcatcctttcattttcaaagccattctatattcttactatagtgtgtatttaatgattaacatacatctttgattttaatcctgtctgataattttatgatttacttggaaaaatttgtttatttacgatgcaattattgtaaagttagggttaaacctaccgtcttgtttcctctgattttcttgattcatgctttcatttgaattagtttaattatagattttttcttatattaacttgctaaatatgcaagattattatacagaagatatcctcaacttattaatgcctaatacacatatagtgtattaaaatttctctctcaaattatttctaggtaagtgacacaagcagaatcaaccttcggaagatcatctatttcctgctgggttgacctggaatgtgtgatatgacctaaggtaacctttgagtcaccacacagacctagagctctgtgtgatgcagcacttcctcaggagcttgcagtggcatcagggcccagccttgaatgccaggcaggggtctctcgactctgtgattcttcccaggaaatacataagaacttgcatctgggttcatatctcaaacgcaacccaccagtctctcacgtactgacctctgctccaagtcttcagatggttatttttcatggggtaaaaatatggcttacatattatcttgtaattctgtttaagatggcatacttatgttcctttattctttcaaacttggtccttattgttgaaacccagctttggagttcagaaaactactttttacttcaacatgctgtggttgagactgtggaaagacttttggcactaggtctttatttttgcatacatttgcagcaacatatctagtaacttaaaaatctagaccgtgaagagttatattttggtactccctgaaaaaagtaggaaaaaatacagtgcctgctggtgtcctggtcaggggtctgccttcggaaaagtggtggggggaggtggaggaggggagggaaactgttttaatattaccaaaccttatcaacatacatatactctagtaactgctaaaccaaatcaaaagaatgtattagttttgcgttgccagtaatcagtctcaattaggtgcctgttacgcagaacgaatttacttgatgaatgaatgtagggaaggaagagaggcttagaatgagctttcattgagctttctcttctctcgtgtctcattgctcaaaggggaggtgtacctcctcctttttgcagactctgtcatgcaaaggccgctgcagctgatgggaacttaaaatgtggtgcctgaggtgtagctgagaaatttatggtcatgagccctcagctgtaccaagtcctctgagttctccaacatcttggtctttaggcatctaagagaatccacagtgcctgctctccacagaaacaacacatctgggcagctaggccacagcaagcagggaggtttgtgttcaggactgtaccattgtgggagaataatgtgtactttgctggcagcaataaaccccaacatcctcagcatccatcctccttattttaaacatgaaatctgtccccgacccactgccactgaacctgtctgggactccagggtccctgttggaaaccaaatcaatcaggagccgtggaggctggcctggcttctgtaggtcccaattcaaataggtgtatccattactgtgaaaggggctatgactggatctacaggagatagaggctggctttccaggggtgacgggcagggagagtagaggctgggtcacacagcatctccattggatcctgaaataataagagagaagtgcaaggttatgtacaaacattgtgagccattttaataattttctgtctgttatttatgttttgctcaattattttttgtgtatgattttggttaatactcccaaaacatacaggtttaaaaagaaccaagatttgcaaagcacaaataagcctctagaagtcacctatcccatccccctctttctgtgtcacagctttcactaaagtacatgtccttgctccttctggaatcttcctcactctcacagatctagacatcacatgccccatcctggaggacaagacacatctaacacgaggacagaacacacatgggaggtggcagggcccacagagttcaccctcccaccccatcatcctccctcatttcccttctgctctcagcagggacccagtgcattagcagccctgggagctgagcagggagcctcactgtgggaaggtgaactgaggagtcctgatcagtcaaggcaaggttagagctgagcttttatctcagactcacaagggaaggtcttccctaggggacagtatgcaaatcccctggtgggtgcagtggggtggaaagagccaaggagaaggtggggacctctcttgtgagcaaaatgacataaatatattttatgtttttaaggatatcaagagaggtaaaatctgtttcctgagtggcagaagggacatatttagatgtttcctgctatttcctctacccaatttctagttcgttaggactttctcaggcatgttttacacttctctttaataaggttgagctttcataaatatttggtgattcttatttcttggttcaggcttatttaaaagagcctaggtttgttttattttattttatttaaggaaaaacacacagtgcaaaaggttcaaatcttaagggtgcaaatgaatgtcaaaatccagatcatttcatgtcatgatccacatcaaaatatggaaggtttccaattctcttgctgctttcattatgcaccttcccagtcagcaactgctgctcaaaacacaatcaatgtaactgatactgtgacatctattataattgtttttttttcctgtacttaatcttcatatcaggtaaacattttttgtagcttctttcttatttctttcattttttgagggcttgattccttcttatcaatttgaattgctgtctgctctcattccctgttattctgaaggattttctcttgaattttccacaaggcacatatgctataatgaattagtctttgtgtatgaaggaacatttctaccttgcttttatgtttaaatgattgttttgctggatatagcatttgtggctgacttttctcccccagcatttaaatatatcattccactctcatcccacctctattagtaatgatgaaaatttagccaatacctttattattgcttcctagtatagagtaagtcagtattttagtgatgccttccaaattctctgtgtctttgtctttcaacattggtactataatgtgtattgttatgaactgtattgtgcttatcctagaagggtttcactgagttactttcatgtacagactaatgtgtttcatcattgtgaaaaatgtttttcattatttctccatttttttctttttcagtttttattttagaatcaaaccatacatgtacagatatgttacaaagttattttgcatgatgctgaggtttggggtatgacagaaattattaaccagttagtgaacattgtacccataggtagtttttcagcccctgccctttctccctttgtgttccttctagcacaatgtctattgtgcccatcaaccagggattcaataaagaaactgtggtatatatgcaccatggaatactatgcagccataaataagaacaaaatcttgcccttgcagaaacttggatgcagctggaggccattttcctaagtgaacagatgcagaaacaaaaaaccaaaaaccacatgttctcacttataagtgggagctaaacatggggtattcatgggcataaagatgggaacacatttttagcctctttctgtcttctcctttgtgattcctaatacaaatttgttggtattatacacatggacctataatgtctgaggttttattcattcttctttataattttttccttctttatatgagaccatttctattgacttgtttttcagttcactgattcttgtgtcatcttaaattgctattgagtctatctaatacatttttcaattgagttgttgtacttttcatttctagatttcccagtatgcttgttttcatagttttgtctctgtttgagagcctctattggttgaatcattgtctttacaaattcctttttcagtcttttattataggttaaaataattctttgaacatatatttgataagggtggagcacatagacaccatggagatggaccataaggcagggagctccgaattagattaggtgaattttgagtctctgactatatgatgctcttgtgggttttaattatttcccatgttttatgtttctcatattacaaatagcttttatttttaagatagtaactattatagaaattcagcttataaatccctggaaatttctaacagaaagattgatgaaaagagggtttttttaggcccccacaccagcctctgcctgggacctgactttgtctctgagccagtggaatctgtgatgaggttttgagttgggcagtgaaatcaccacagggcaggctgtgctctgggtgctttggatgacaggaggacactccttcagggtcagtgatgctgggagttcaaagggagactcagcatggagctgcctgtgagttatcccagcaatcctgtttggacagtgatcatctcacaagtgtgctcggaagccactggatggccaaaatgtgggctcaggttggagaaggacaaagctatagggatgaaaatataagactcatttgatactctgaaatatcagtacaaccatcatgaattatatgggaagagaaaggagtcacaagattgtgattttttatttgatattaaaatatgtcacctctgctcatttttccctcaaggatgtacctactgatatacatttaaccaaagtcactgtttttaattttcattttagtaactgacagcctatgtgcagagttcctaaataacgaagccagaccatcattgctatgggtgaagccaggaagtgactgtggatgtgaacaaatgtgagattcatgtacacgtctccaaagacagaggccactgatctggggagaacctgcagtcatttcactttcccatacccagatgagaggacaccttgatctgtgttcatctgatgaactctaaaatctggaccatattctgaaggtgtagttcacacttcttttctgtgctagtgggactctctcactgacgtgtattgtaccctctgcataggacagtctgtgatacatactacttgttttctgctaaacacccatcaatcatgtcatttatgagtcttccataggtgttacctaacctatggctatggggtcttccaaaagaatgggccggaggtggagctgtgaaactgtagctggataaaaagtgtaaatgtcaagaaagggtattgaagtggtgataataataataataatccaaattagtctgggctcttggctgtgattactggtaaatgtgaaagagtctaggtttggtttttattagttttatttcaactgataaagtagccagagtaaagtgcataaatcttgaatgttcaactgaatacagtttttgtgtaattcattgtccaaatggaatgatagaatatttcacattcccttgtgcttccctcatggacaatctttgtcagttatcacccctcccacccagcaaaattaactgtctttctgacatctatacaatcatttaggttttcctgtcttaaactttatataaatagcattaagtgtatttttatctttttagacttggtattgctccttacaacttttgaggccttcatttctttcagaggattcaaggtcctgtcttatgtcatttcctgtgattctgaaggattttctctcaaatgtcttgtaagagacatagctgctatgaatgaatgtattttgtttatcaaataatttttttgctttttctttagatttgaagggtattttcgatggatatagatttcctggttgcctttttttttcctttcagcatttaaatatgacatttcactccttctagcctctattggtcctgatgaaaactcagccaatggctatgttgttgtttttctgtatatagtatctgctttcattcttgatgcaatgaagattttctctttgtctttcaatattttaatataatgtgttcagttattaattcctattgattatctaaaagatttttattgaattttttcatctaagaattttttattacttttgaaaagtttttgtcattatttctccaaagatttcttcagccactttctctttctctcctcctttgtgactcttattatacatttgttggtattcttcactctgagctataaatctctgaagtcttcttttttttctaaactttttctttagactcaataatttctatacctctattttcaagttaactgattgttctgccatctcaatttgctattagacctagctaacaaatatttaaattggtttattgtacttttcatttctagagttccaatttggtcattttttatattttccatgtcttttcttgagcccctacttgccgaatcttctttttttttttaaatattttcttttttatgtcaatgatcatagatttaaacataattatttgaacatctgcatattaactgctttgtagtctttgctaaatccaataattgggacaagttagaattagctttcattgactattttctgttgttattattgtagctgctttatttttattcctttaatattgttcatacttctctgcttttttccagaagttgtgaaactaaaaattgtacatttttgatagcatattatagtagctgtctttagattttgggcttttttattttaattttaacttttttagaaatagggtcttactttttcacccaggctggagtgtggtgctgtgaccatagcttgctgcagcctcaacctcttggggtccagaggttctgcagcttcatcctcctgagtagctgggactataagggcatgccaccactctctgttatttttttttttaattgtaagataagagtgtcactattttgcccacccagcctggtctcgaactcctggcatcaagtaatccttctgcatcagcctcccaaagtactgggattacaagcttgagccaccatgtcaggcctggaatttgttttgtttttctgatcattttttaattttcttcttagtttcttgtctgaacttactgatagtacctgacttatgacagttggagttataatgttttgactttcagatggtgtgaatgtgatatgcattcaagtagaaatagaaattctagtatttacacaactattctattttctctttcaatatagtattcaataaattacatgaggtattcaacactttattgtaagataagctttgtgtaagataatgttgaccaacagtaagctaatgtaagtgttctgagcatatttaggataggataggctgaggcataatgttaagtggattagatgtattaaatgtattttcaatgcaagatatagaaaaatctgtatctcatgtggcgtttgaccacagatatctctgcttctttctgttcttaatattaatatttagtttgattttataggaactacacatgtatctgcatagcgaagtggtcaccaatgatctgagacattttgctcaaatatctggaggttataaatctatcttctgtcaacccatctgtgtgtagtttaaaaagcaaactgcatgcaaaatgcagctagttcttacctccctctggttttactttgcaccggaaactcctagttctcatcactcatatctataacttctaggtcactaggaatatgtgcagagattatttcagcaatgtgggtctatcttatccaggaatctgctatttactatcagcagatgtactacttgcctcaaacaaggcatcatcttggactagcaaggctgtgggctttttctgttcatttcctatggtgttctccctgtttagctggaaacactgaagaattatttcccactccttggcttcactcaagtccacccactttggcagcaagctgccagttttatttgctatccttacatgggtaaaactccagttctgcaattcatattgactgagctgggaatagaagggtgctgtcacaggcaaaaggctacagacattttctgtccttactcaaagcactagtactttttttttctataaagaatatgcatccttaattattttatgctttgccaattttcagagtgctgaaatagttttgatatttcaactttatatttataggtgtgtttgttgtttattcttgcacagatttattaaactctttgtgatgccataaacagagatgccttctgaaatgcgtttaaatgaatgtaatagccacactgaaatggtatgatgtaatggactaacataagtaattttggacttgagaacttgagctccaaaatggccaaatagagcagagatgctaaaactgagtggccaccacactagctgtctgtaaaggaagcagctggtataatctagtaaacactgatggtcttcttgaggtttttgtttcatgttgaatcactgtgggaggccagttattatactgctgacagtaataaactgcaaaatcttcagactgcaggctgctgatggtgagagtgaactctgtcccagacccactgccactgaacctggctgggataccagtggccctggtggatgcaccatagatgaggagcctgggagcctggccaggtttctgctggtaccaggctaagttgctgctaacactctgactggccctgcaggagagggtggctctttcccctggagacacagacagggtggctggagactgcgtcatcactatttctccagtggtatctgaaattggaaataaaacagaaatgcactcatgtaatcaaaatcaaacccactgtctttaagtagagccaaaattgttgatctacattgaattttaattatatttcttgctgagcagaggtggcaggagttttcactgatgtgcaaaaccacctcatattcccctcacctgggagccagagtagcaggaggaagagaagctgcgctggggcttccatggttccgtctgggtcctaactgagcagttcctccccagagctctgacccaggcattgatatgggctctggaaggtagggcagctgggagggacatgcaaagcagctggggtgggagctgagctttcagctgcaaagaccacctgcttcttcctctctgcactgagcatcctgcgccgccctggttgtcaggccagaaaagtctgttggctcagtctgagtgtagaactcctcccttgtgctcagagaatttcgctcctgtgtctttcttctcctcaatcacctaaatccacccagaagatgtttggcacaagcctgttaagaacaatataaaaagctgtgttttcacttctctcttcctatcctcaatatgcccagtcatctccctaagtgcattattggatcgatggaaatgaagagtctgttaaaacttaatcttccagatacacctttcatttgcttgttagtaatgttttctgagggtcctgaagctttccattaacccagccacataccctctttgagttaaaaagtgaaaaacttctgtttacagtcacatgtcctggcagccctgacatagatgctccatggcttgccgattgcttgaaattgatcaagtaacttaacttccctgtgtctcggtttccatatctgtgtaactgtgacaatactggtacctaccttatagtgctgtagacagtttaaagaaaataagataaaacatttacaatagtattcaggacattatgtatgcggcaattaattttgtttttatttattaaatattcagcactacagtcatcatcattatcataaatatacttacttagcacagaaaagagtcttcagtctaatccaagaatgttttatccacagccaaatttaattctaaggcttttccttcactaactctacacaactctttaaatcctaatgatttggtcttaatctgtgctaaagtactcacaccttcaatcattcccacccatccctgtctaactcattaattctcatcatccattatcaaaatgttactctataaaaggttcccatgtcctgttgctgtccttctttcttacacaatctttattctaccctgttatcttttgtcttattcttgccccaggacaataaggaaaagctaccatcattacctgttgacttgctccagtataattttttcaggcttgttaccttggaaatgaggactatgtctggcaaagaaacatattcatcgggtcaatgtgttatgaaataaaatattttatctacttatgatccaataattaatttagacctacttgaacggtttttttttaatgaacgaagaagaagatgatataagaggaaaatacaatacaatagaaaacacaagctattataactcttgcttcacggatttctacatatatattagacatatgctgggtatatgtgtgcaatggtgatccaaaaactgaacgctaactggctgaaggaaagcctgtattacattgggtcttgtctatttttccaattatgaacagaaagctacagtactatttgtatgagtatcaaaccttctagctgctgtgatggaggtagagaagatttactgagactaaagccttggaagtactagaagtttgtcctgtgatgttatgggtgttgctgtggttgttgttgttaggaaatacagtggaagtcaaagcaagtagaaaatttacaagctctgctcttcctcatactcacaaccccttctagagatgacagatagtggcataggaatctctgacacctctaaggaagtcttttttgctctttccgggatctttcctgacaagtattgttttgagtcacagatgatgtggaagtaggtgtagaagaaaggactagagcaagggaagaagttttcaatcccaggtagttgttgtaggcacagggaaatggaatttttcatagatttatgctacacttctatcatgttggggagagaggcatcaaaccaagcttattcttgaaagaaacattacattattttaaagagaaggaactatgcatttcttgtcaaatagatgtttaaaattcaaagctacaatttttttttttgacagtatcttgctctgtcgcccaggctgtagtgcagtggtgcgatcttggctcacggtaacctccatctccctggttcaagtggttctcctgccttagcctcccaagtagatgggattacaggcatgtgccaccacacccagctaataacaggagggagtaaagggccacacaagcatgtacacaagagacaacttttcttcttttttacagaataagtctaaatgtaaaatagcgttataatgtatggactcatgtttaagacaagtctcttggttttctaatttgtgttgaacccaagcagtgttgtgatagaaaatgagtttctttttctttaagctgaatttgaatttgctccaatagcctaatagacaccctagtggtaagtcctctgtgatgctcgccattgtccccatgtctaacaaggatttctactggacatagaagtttttctaagtccaacaagagggaaagagactgggccatcattgttctcatctcagatttccacttcctgcatagaaggtatacatataggtagccagacgttatgaaaatggattgtaagcatttgttagtgaacaaaatatgactcaaacagtatttttattttttatttttaaatttctattgcttattatttgagacagactgtcactctgtcacccaggcaggagtgcagtgggtgcaatcttggctcactgcaacattcacctcctgggttccagtgattctcaagcctcagccacccaagtagctgggattacaggtgtgtgtcactacgtccagctcatttttttttttgtatttttagtagagacagggttgcactgtgttggccaggctggtcttcctgacctgaaatgatccgtccatcttggcctccaaaagtgctgggattacaggcgtgagccaccgcactgggatttaagcaatatttttattaagtaaagtgtagaagaaaaagtgtaagtaaggtgacaataagaaaacaaaatgccgtaatggaaaacgataactttagggcagaaaacaagaaaaggcaaaccaagattcctgtagggcaagcctccaatgcacaatccaaggaggaatgtcaagggtgaaaactctggagcatccagatagtggcccaaaataccaaatgctgaaaacccagaatacccaagtaacagcctatgagtgtccccacaccaaatgccaggaaaccctggagtatccaggggctgaccagtgcagaaaatcctggagcctcagtggggtggccaacaatgagccccaaaggcctggttggggccataaaacaatgtgactctggcttcttagagtcaacagaacaggagaattcttacatccaagtgtcctgccttaaacaattgcacaaacataattagcagggacccaaagaaaaaactgcaaagcaaacacatatatcggggcagaaaataaaataaaatggctgatggataaataaaatggcattagaggagaaatgactaagagaaagaacaatgaggatgtagtcaggtgtgctatgggggaattcaaatggactatctagccaaaggccttatttcctggatcatctatataggcaggtggatagatgggacacttacaggtgtgcaggagccaaaatggggccaagcagtgtctgacatggggcctgcatgaagatctctccaggcttcccagctcggatgggttgggctcctatgggggaactggagcacggagcggctggcctgcatgaagcagtggctctgtggcctcttgcccatccccagagctccaacacctgtcaggaaagatgatggttcttaaaacagcctttggctagtgttaatagctctgcaatgttaacaactcagcataaagtcacacagacacacagacactgtagctttgatcgctgtagcgctgatcaccgtctcatcctctctcactgatcgctgtcttgccacttctccaatagctgtcttgcccattgctgatcactgtgtccatcttctcataaagtgccatctcttgctgtctcttgctgtcttgcttctccgctgtttccactgtcttactgccacatcaaatgctgcttctcaccatctctagtggtgagtggctggctcaatattgatgcaaggcaagtcctcagctttgctcaggaaggaatgtaagagtaagccagtaatagaagaaaacagctttattgatggggcagcagtgttacagctctgtgactactcctgcggagcaggggtaattcataggcagagggccgagagtagcagccaggggcatttttacagtcacatttatacccacttttaatcatgtgataattaaggggtaggttgttcagaaatagctagaaaatgggtggtgttgccccaacttccaggtgttgctatggcaggggcaggaatttccaggtgttgccatggcaagcgctgtgacttctggatgtttctatggcaatggtaaactctcatggcactggtgggtatgtcttatggagaggtcctttcagaaccctgttcctgttttggccagcctcacatctggtcctgagcagagtcctgcctacctcttgcctcaaaagtaacaagaaatctgtaatgaaaatttacccagacagaaaactccaattttatatttggtagttagtgacatggtacttatcaaagttacacaaagattcaagtgaataaaaaatactctcagaattattataggaggtcataatgtcctgtagtccaaaaattaatatgcacataacaaaacaaagaaattaaaggctgatatccattgtgaatataaaaataaatatcttaagaaaaaaagaaaaatgcaatcccactgtatatctgcacatttagtgaacacacattgtaaaaagtgttacagtttttataaaaactcttgataggtaattttaatttctgaaaaatgtatatgaactataaggtatgttggatctcttcccctaacttaaaaaatatttcttcacatttaaattctttaccaatttttaatgactttttattgcttagaattttagttgatataaataagaaatgtgtattaaaagcctaccattttgatttaacctatgaaatatatttaaattcttggaaaaatccaaaaatacctagaaaagtgagctcttgccagaagatacacagttctttagtgtcaggctgagattatctcccagaaataacttttggctcatatagcttccaggacactgcaagaataaaagatgtgaagacaatgttacttaattggatttgcaattattcactattcactgttaaccaattttattgaaaaaaaagattccaatcaaatacactgattttaagtgtactgttgggtttaataaataaatacattcttggaagcaaaatcaatacacacaacatttctgtaactccaaaaagttttgtcctgctcttcagcaatcaacttgcttccacctcacagaacagaccatccttattcagcttattgttagtatagattccactatctttttaagaatttcacataaaggaatatagcacatgttcttttgtggctggtgactttcgtgcagcataattgtttcctaggctcattcatgtcgccttgtgtcctcgtgatgtgttactctttacttttgagtactatttaaatatgtagtaatttcacaatgtatcccatcacctgctgatgaccatgtgggttgtttccactttgggctattatggataaagctaccacgaatggcattatacaaggctttgcatgaatatttctttatttcttttaggcaaatacctaggagtgcagttactgggtcttacagtaagtgtttaatactctgtcatactgttttccaaagtggttataccattttacatctcagcccagaattgatgagagttctcaatgtttcagctacttgtttttaagactttttcttaatcatcactcaacagtgaccagaatggctaatgatcattaagtcatgttttccttacaatttccttgacttttgtgggtgcttgacttgtatcaggatattgaaaacaggatcaatattgtcttaaccccttttaaacactttttctaagtaatgatatttaggatgataacaggagatctaaagggaatgttgggagtagtaacaggcattatccaatatttattatcatactccttaagacaatacattttgagtgaaatagcattcagctagactagggataaaaaggttctaatctcagctttagcattaaatattaggaaacctctgagaaaacaatccaggaagacaaatcagagggtgttttgctagtggagaagtgctgcaacacctaaaacctattaatgccagatttttgcagtgatttccactcataaagttgggttgactcctagccttgttctcctatgtgtctgtgtgactttatgctgaggggatgtgacatcacagagggagaagtgcacttgtgtacagaaacatggcttaggagattggctttggatgtggctgcaatgaaatatatattttgaagaagtcccctatgaaatgtcttatacattgtttcttatggcagggtgctcgggctcacacctgtaatctcagcactttgagagaccaaggaggaaggatcacgtaaggccaagaatttgataccagcctgggcaacatagggaaaccacatgtgtacacacacacacacacacacacacaatttgtgaacagtggcatcacgaagtgattatttatgaacaattggctaagaaaattacaaaataaagcaatgtcttctgagctaacaatactataataaagatgtcaattatttaactgtagaaaatacagagaacataaaattgtctatcttaaccatatttaaaagtgcagtgcagtggcattaagcatattcacatgttctgctattattaccgatactgtctccagaattcttttcgtcttataaaaactaatatctataccccttaaacaatactccccccgtttcctctatccttatccctagcaacctccattccagttctgcctctatgtcagtgacatctttgaagcaggttcactgtacactggttaccaacgtacctgagcgcgaggaacacaacacccccacacagcaagttacatgaagggggtttattattacagataagcagcaagggatcacaaaactcttggactcattatggatctgtcccccaaggcatacgaaagttatgtggagctgatagagtcgactgtgtgtaccccgcttgcatcacagctcaggaatccggaaaagcagacactctgggttttatatcctggggtaatgagacgcacagggctaacgtgcttaaggacattccattctatgagaaactggaatacagcacaggtaggctgttctggccagttcctctctatctcaggatgttacaattccagcacattctacaattattcttgagaactcttaaaataatcaagaaagtggagagaactaagtcagcccagggtcattggagaactgtcttgcagttaccccaccacctagacatcccccttagtaaagctagcatatttcctacacccaccaatgtcccccaaactgaaggcagaggtttatcttttcagattgacgaagcaccttgatttacacaatctcagtgcagattattaagccatagtgagagtacatttcgctggtctaaggaaggctactaccactggcaggagggataagacccccaaaagcagtgacctagtctaggatcccatgatcaagaaattaagatgccaaagaggtgaaagggggatctttcagatgccccattgtctgcagccattgagcctgcatcaggatcacctctacttatatttctaggatacctgaggtgtttatccaggtacagaaggcagtgttgggtgttggtaattacatggaacatccgttatgttccacgagaatgtgcccattgtcacgctgattgggcagtgaggttgtttcttggtcagagtgaagtctcatggagtatccaaaatatgacataaattcctctcaagggtggccatggtagcccgagcatctaatagagtgacatatatttagcagtccaggaagcaagctattgccatagtccttttctccacacaggggatcctttagtagttcagtcactcagttgctgttttcctgaccagatgactgggttgttgaaagtggcccatgatttaatggaaatggagcaaaatatagtgttaggggcagcctgcatggctgctatcattgtatgtagtttggcccattgggcagaatggccatgtttagtgtcaatcaaaagatgccatcccctggctggatggtggccacacccagtggacccactggcatgtgttttgtacaatcatcagggccccatgccatattgacataggcatgtctttgaatctttgactctatgtggccaaaggagaagctgaattgtcccctgtgggtcatttgttcccttcttgcaagcttgtcatttgtttatggggcacatgggtattgtggcatcctggttagggctgattcttactgtaacatttccatttagtaatttggatctgttgggcctgtccagttttattgattgtgtttgtaggcaccaaagtgagaatctgtagttaaggtagcagtgtcactcctggtcctctagctctgagatactcaggccctatcagtttcctacagcaagtaaggagttgccattcaaaagaggcacaaatggtggctgcttcaggaaacatttgcctccaaaatctaagtctggtgcacccagtgacaattttacattgccacagactccagtcagcatgcctagaaatagtggacacctggatttacatcgagcaagcaggctctaaaggtcttaaagaaatgccttggacatgtattgttgaatagattcgaaggctaccgttgcaaagggctccattcaaagttgtcaaatttgttcatgcttttgactaaggtgaccaaaaaaaaaaaaaaaaaaaaaaaaaaagactcagggggacagtgcagctaggtaagaatccagtggctttcccgagcttatttgtcttgcatttttggtgacatggattgttgttcatatcggcttcctctggcaggtccacctggaaagcattatatttagcaagaataaaggaggctgtgaatgatgtcactgcggactgcgtatattccctgttgcaaatgtcaaatccatgaagcaaaaagggatttactagaggttattaaattccttacaaattgttgaaaagccttaaaaaacaggctccagtcaaagcctctagaacaattccaagaatcgtactgctggcacaggtcgggggagcatctcctgcgcctgagactccacattcaagctgtctcttgcagcagaagagagagcagctcttctcactactgcccccagaaggacagcagctctggtatcaactatcaactgctagaaatctgacccctttctctgactgcccatcagatgtgttactacagagtcgttttggattgagatgagggaggggaaatgcctgatctcactcaaatgtgctcattttcctggtctgagtcacagccaggcagcacagtcctgtgggcacaatatcttcacttgccaggttcctataaaatgggagtatctttcttgactgtggaaaatatggaggcgaggagggtcaagcaatagcaaaaggagtacttggagttgcctgagcttccactctggtttccccaaatgttttcaatccatttaattcatgataataaacacctttctgcctaaccagccataatcgcttttcttaggtccaaatgattcagtgataaaactaaagagaaaaaataaatacacttttcaacgttgaagctgaccaggtgtctgtctctggtgtttacccctccacatcccacgatgtgtttcatcttccctttgcctcactggagatccaagtgcaagtaatgcttcacatgactgtgatccctagaacttcatcctgatgactgttgaaatcttctctgagttttaccagtggaaatggcaataaatagaaagattccagaaggtcccctagggtccatattttctgtacttcctctctaaaatatgtaaagtcaattatgtttgctcttgctttatatgggctagatctatggccccagcacacatctgaacgccctgtgttgacaacttatccagtattgtattgagtctgaatggtcacatgcttatcatatcatttcttccaatttcatgcaataattgtcatgtcaactgtttggattaagaaccatcagccagaaaaccacagccctgagaaaatagaaatagagtatttcaagctgttcagtgggcatagcaatgatgagtctacagctcattttcaatatataaatattctgtttatgagagtaacagtgtttcagagcctccaccacatctgacagcataacaatgcaatagcacaagagtttgtgtgccagcgttgcttgactaataatgggtttttctttgtctatagggtaagctgcacctgtgcacatgacaagatcatgagctacactttgcttcactttttttgaggtcaataaactgcttgatccaaagccatattatggaagaaattcctgactctgatgaaaacacttggaaaatcctcaaataatattttatgcagaaacataaccgaaaaagaaggcaaattcatatattgcaaataaccagtgccttcctcatgttgcatgaggtccactagaatcacctgacaccagctgttagtctgagccctgatgtgtggtacaatgttaagggttcaagaggcatcagttttcttggcaaattaggtgttcagaagagccaatagccctgtacatctcagttagttgaaactcacattactgagtccccacagggaccttattaacattggttcatgaggctacctggggaagctgggaaaggtgattgactgaagtccatgtgttgaatcatcctgattattaaaagcccctgcttgttaatggcatttcacttaatattcacttggaaagcattttttttattatggctcatttttgaaatgtctggtcatagcttttgcagaatgactttgtctgaaatcagcctgttgcatttattttaagacttgatgatctgtcaaaaccaacagccaatatttattaaactgctgttatcttgcaatgggatcatcagatgtaaccattgcagtttacccacggttaggatttttacatttccagtgcttctttgacaatgacactaatgtgactctatccagcgtgcattgttgtgagaactctatttggcctatcatcattgtgggcatgaacataatggagactttcataggatgcaatggttaatattcaacattagtcaaaatttgctctagtcctaccctcggagctctactgggttggaaaaatattttaggtaaggacaaccatttggtaaagttttaaaaataaaggctacaaataaattttctgtagcaagagtattgcatacataatagaataaatgtgcttaaatatgaatactatatatatttgtagccaacattttatcaaacaaatatatattcacttctatgtatcttatatatatgcacatttttccataaataaggtaaattttaattttttattgaaatactagttttaattctgttcttaattttctcttaataacttcataaattgatcactaaatattcacatttataccaccaatttaagaaaaaaatacatatgtttatatacacgtagaggtgtaaataccgtatcaggaagcctttatgcataatgattggttactggttaaatacacaactcagtgacagaaaacagtaaacatttgttttcgtgttcatggatgctcacgttcacaatcctctggctgaccaaggaagggctctgatgagtcgttcctctgcagggcactgagctcaccttcagcctacagatatgaattgtctgaggacaaggctgaacagcagtgactacacatgacacaagattcttgtggcaggtcacaggagtgaacaacatcccaaatcaaactgcacagttgaatttaagtccaataatttctaacatagcttcacacattttaaatatattcctttatttcagtgagtacacattttcaagaaaatgtttactccatttaattatagaagggtttgatcattccatgaacaaataattatgttttcaaactttacaatcctgaaaatatttgcaaatgtaaatttgcattaataagaaaataaagctggatgtgtttccaacatgtggcttcaaatataatttatttaaatggactcattggggtaaaaatcattttaacttatgtaaatatccctttttgctgtgcttgtgtcctatagagttgcccaataagagttcctcccgtgagatttggaaatcagaaaaggaagactcaatattatccattggtaactaagacaggtacaaggacagaggtgaggactggagaaacacctggaaggatgttgcaggaagctaagagcatcagcacgcctacccctaagcttccagacaggactgaggaccacatggttagaaagcccttactttaggggcggatgcattctgttttctgagggagaaccagagaatcctgcctctaatatcaactttcctgactactgtatccttgtctttgaaaggctgtagtctgaacgttaatcataggcattggttcattcttgttatacccaacagagccaagaaacctagtggggaaaggcactcagggtgcaaaatattgctgctggaatgcaattgaaataggccctgttatcccatggaactaaggtttatggttttttgaataaacttagaaattgtctccccctccctgtcttaaaactcaagatagttacatctgtcttacctgagtcctttttttcagtaaaccaaccatcaggcctcccagatactattaagaagctgaaacttacatatcactgaattgggacagtgagacatcagaaccttcacccactgtgattgcataactgacctcctgcttcttcttgaccaaattatcttccttacccctccctaattcctgttttcaacatttcttccctcctatataaacccctaattaattttgtcagagagatacaattgagaatggcgtcccatctcctcggctgcagcacctgattaaagcctgttccttggcaatacttgttgtcttcgagattggctttctgtgtggtgagctgcaggatctacaccaagtccctggtatttcagtaagaaaattctctgcaaccttcagtgctttggcttattgtaacctgaaatcaaatttatccacaatttctgagataacttgatataactctaggattcactttgtccaccactgtttaccagtctgagcttgccagctcccaacccttcctagtgccaatgaactttctcaaagtgcaataggtaatatttccctttttcatggaacactgactttttctttgttcttccaacgtactgaagaccactgagttttcctgtatgcctcatttggcaaatatttctcttcaaataaaacattaaatttagagattcatctctacattttatttagacttcagcagtttattctaattctctgtattaagactattcctgcttagaatatctatagtggcttcttctgcattatgatttccaactgaagccataaactagactcctcaggtgtcatgatctctgtttttattaaataaggagaagcattgctatgtctgtgcagttggtgctgagaaagagaaaagaattagggtgcagaggtgacttcatgtccccatctaccaacaccatcagagtgtggctgcatctgaggaacactctcagctgatggaggcatcaggagaagctgctggggcagcccagcctcacacatctgcttccctgggggtttatgtttgggtgtgtaacactgtgggagggtaactattatactgttggcagtaataagttgcaaaatcttcaggctgcaggctgctgatggtgagagtgaaatctgtcccagatccactgccgctgaactttgatgggaccccactttgcaaactggatgcagcatagatcagggacttaggggctttccctggtttctgctgaaaccaggctaaataattgctaatgccctgactcgcccgacaagtgatggtgactctgtctcctacagatgcagacagtgaggatggagactgggtcatctggatgtcacatctggcacctgagattggaaacataaaaacaaatgtccacacaattaatcatgttgtaagagaatttccctgaatagtaaagcagtactgagcaccctgggctgagtaaactgctagtgttctccatccttacctgggaaacagagcagcaggagccccaggagctgagcgaggactctcatgtccatgctgtgtcctgactgggtctgattcctgcacaaagtctgaccagcctattaataaggcttcagggcaggaggttgtgctctgggaacatgcaaatgagcaggggatggggcaggctgggcacagctgcagagctggcgcatctcagtaactcagcaccagctcagtgtccccacgtgtcccaggtaagatcaaggtagctcaaatttgtctgcagagaatgtgtttctactggggactattttgttatgggaaacattttatggtttctttttgacaatttgaaatattccttgggagtcgatggagcaatgtatttcattggtgtatggggattatttaggagaatattcttttttgtaggaaacacatagtaaaattttagaccctacaattttcaggtcttcaaaagactctcatgtgatttctgttagggaaggtggtacttatcatatacttgcaacatttctgtgagtttaacattgctcctttctaaaaaaaaattaaaaataaaatttattcacatgatgctacatatatttgtaaatgttaggtaatggtgttatgccattgttcttaccactgtaagatcaagcaatttacttcagatacactaagttgataccgtgtttcctcaatgcatgcagcaattacagatccaccattatcaagagctctaggtctctttaatatccagagactaaatgggctgcaccttattcctgttttgcaccttattcctgttttgggcaccttcatagtctaccttcttttctgccattaagtattatttcccaacattcatctctcttagtgagggtgatcactgcatggagcatgtccctgccatgcaccataggtgacactttcttcttttactttttatcagggacatcatcctgacccagacaccaagatccctgttaacatcttttggaaagaggcactcaatcttttatcaagcaactgcccaggtacatggagaaatcagttggttccagatgaaactggacagggatttgcactcgttatatctcatatctctaatgtgcccaaaaatgtcccggcctggttccgtgggaggggaagtggatccaactacatcagcatcagtgggctgcagcctaggactccataaaattttactgatgcctgactaggagagccaaatcacagtgctgtagcctctgcacaaaccttcctgctgctttataagctgcctgaattttaagggaaattgcttatattggaagaaaggaagaaagctccatttgtcctctaaatgtttgctgaaaataaactgacaaaaggaagattaataagagaaaaggcaaacaaaattcacttaaagtgcagcaggatatcatagcaaggtgattacccagataactcaatgagatccaggtgtttatgtttcctttctagggaagaggtaattgggaaatgtaggcaacctggagagaatagatgagaatagaaatgcatcctcaaaagaacaggtaatcacctccctaggtaaagtatcaactttgagtctcttccatttttgattcctcttttgtgttaatcttccttgatataaaaattctcaggaagagttttcttaaaaattggtttccttctgaagaatttgcttttaggcaggtaggggatatttaggaaaagccccctgtgcatttcctgctttctaaatgcctttggttttatataatcatcatacaaatgcagcacagtttgagatgttattttctggattcctttacttgcaacccacctgccaagatcctgttccagagagatgtggctacagactgaaagagcagttgtcccctcaacaacgtggaggttggggcactgaccactggtgcagatgaaaacctgtgtagaacttttgcatctccaagttatgtagtaatagattacttttgactggaagccttaatgataaaataaatagttgattaacccttttttatgttatacatattatatactctattcttccaataaagtatgctaaagaaaaaatgttattgagaaaaccttaaaaatgagaaaatatatttagtacttattaagcgcttgctcacaggtgacacacagaagaaaatataagtggatctgcaaatttcaaacccaagttattcaagggttaactgtaccatgatgaatgtagcagtccccatctatagtctagggcttttccctttgctgtatctctgctcatttccaatggctatatatatgtcttatgtgcttcatgatcttgggcagagaggtctgcttgcatgccttgctggccagatggcctgcaatgtgtatctcttaggaaagtgctatggtttgactgtgtcctccagaatccatcgttgtaaagttaaatctcagtgaaatggtattgccaggtggggcctattgagatgtgttagatcatgagggtggagccctctagtggaataccttaatgccactataaacagggtttatggggctggaatctctctgtctcttctgctggtctgtcatgttaagacatggccttcgttcctttgaaggactgaaagctccaggcgtcatcttgaaagcagagaaagacgaccttaacctgcccatgccttgatcttaaatttcccattctccagaaatgtgagaaaataaatttctgttctttatgaattacacagtggcaaggaacctaacctgttatagcagcttgaaagagaacaagagagacagctcacaatcagtgaggacagaatgaggtgtatacataccttagcttcctcgtctctcaggtggaatagcccagaggaatttagtccatgtttccacatgtggttgatcttcagttatcctgagtcaggtgggttgttgatgtgtcttttaccattcatcttctgttccctccctcactttcttcctttcctcccagtgtaaatttgctgcctaaacaggaatcctcattgctggtggacccaaactaagatagtaaataaaatcattaatcttttgtatgaggggtatttctcatctgaattcttttatcatttccctttctttgacatgtaggaatattcaggaaacacacaattttttttttaaccaatctattttagattgaatttatgcggtgattttttgtgtgtgtgtgttaaaacaaaaaattacgttgtaagccactaaccagctgaacggactcctcttttggtagagagaacttcaaagaaatctgaaaaactaggttaggccatgactggcaggtgggtttagatgtacctcattatatggtccttcctttggagttcagacacaactgaccagcattatcattacaacagagatctttggattgacaaaacagatgctttgtagcaataagataccatactccaacacgacagataataggccctgaagaaaatcaaaatattttaccctaaaagtatttctttgacatattctgaagtggccctgcaagctgcctgttgtgggggaaatttgcattctgcagagaatctcctccccttactaagtcttttccaaagagtctgacattttttttaaggtctgataaacaacattagccacctactttgtttgctacccataggattcatctaggtgacaagaacctttgcttccacacccccttttctaaactcaagcatttctttatgatgaattcaagtgtttaggcagagcttaactctttcaaccagttggcagtcaggaaatctttgaatccacctatgacctggaagcccctacttcaagctatcccacctttccaggacaaactaatgtaaatcttatatgtattgatttatgtctttccctgtaatttctgtctctccaaagtatttaaatgtgtattcttgtcaccctgggcacatgtttgcaggacatcctaaggctgtgtcacaggccataagctttgggaaaataaacctataaattgattgagacccgtctcagatactgttttgtttatactggtcacaaacttaaaaatcctctaaaacaatctacacatcaataaatctacattagagacagtggaatgatcataccttaacagttaaagctcacaatttaaaggaacctgagtctaagattttggccagctctcttgcttcataaaaaatacttcgtgatttttaaaattttactttagagaaaggcaatttgggggaatatatttattgtcaatgggatgaataatgtctctaccctaaaagatgtccatgtcctcatctctggaacccaagtgttacaggagttattaagaaattattttaggcagataggaaaagagtgtccttggtaaggttttctttcctttaaagcagctccagaaacgtttcttgtctagcaggaaagccctggctcttagagccaggctgggaagctttgatttgcaaattccggccattagaaactgagtccagccaaacctgtcaattcccaccatcttcttccttgcccccacatgtgcctgacaacaaggctgcccccacatatccccatgtgtagagaatattttggcaccctgcatttgcatattaaaagtcttgttgggaaggccagttattttgcaggcttcatgaatggcatgcctggtcaaaccagtccctagagccctatataaatcagacaccacctcctccagcctcctcatataagagccacttttctgctgcaatggagttttgtctttgttggaatccctcctccctctgtctctgtgtgggggagctgttttcttcttccttccttcttgcatattaaacctttctctccctaaaaccactccacgtgtgtctgtgttgttttatccaaagtggtgtgagaccaagaaccctggtgttcctccagtcaacggagccgtatcataaaaattctaccttacatagcaaaaagagaacttgacagatataagtgaagaataagcgacccagttatctagatgaaaccaatatgatcacaaaggtccttaaaataaaagaggaggcttgcagtcagagaggagctgggacaatggagagggatgtggtttgaagagggaacgggttactctgctacaaaaaaaaatatgaccacgggggtactttgcttaaaaaatatcccagaatgtcctgctatacttagagagcatttgcttcccaaatagaaaatgaaggcctccttcatttcacaccagtttctgctacatgcactgtatcgctctgttgcttggtgtctacgcacttagaactgctctgtcttctttccgaaatgactttcttcattatgtaatgtacatttctgtcactggtaacattcttggctttgtagtctactttatctgatattagtatttgctactgattcattttattaattttgcatactatgccattttcttttcttttatattgagtctacttctagtgtcatatttgatgtgagtgtcttatagacagtatactgttcggacattcctttttgattcatcaattgctgtctgttataatttactaatttgcatatttaatatatcgataattattgatatactaagatttaagtctttgctctacttttttgctgtatctttttttgcttctccgttttctttttgctgccttcctttgggttacttgaacatttttagaatttcattttaattttacctaatttgagggtatctctttttatagtgatttttaaattggttgtcatggtatttcctttatatccatagcttctcacagtatgttggtgtcataatattaccatttaaaataaatataaaattttaccttgttttatgtcatttttcttcccccattagtaatagattgtgcacatatactcatgtacccttcacaccatctctagcctacttataatacctgacgcgatatgtatacatgacttaacctgtgtggattcaaccaagtggtactaagcacatggtgaagtcaagtttttctttttggaactttgtggattttttttctatatatttttgatccaggtttagttgaatccatggatgcagatcccatggatagagagatgactatactgctccttataactctgaggatcaactctgtggttcctccattctgggctggctgaactgatctctgctgagcctgctcatgtgtctgcagttaccctgtggttcagttgtgactagatggtctgatatgacttgtttaacctatctggaagctgatttgatgtgcaggttggacaacatttggtttcggtttacataggtcagggagatggggcctgttccccaacctctattcagttcgtttctagatcaactcaggagttcgtctattcattgtaggttgtttgggggaaattccacacagaacattggtaatgaagaagctgaactgctgtcatcagttattgttatcatctgaaatgcatcatatattaccaaagtctccccagggtggcccaacagtgcagctcagctcaccccatccagtcacttccctggttgcctgcaggtgtgagaaaggcaatgtgctcagtcacaggaaagacaggggccctccctggtgctgaaacctgcagatagttttcacacagtttcattccaaaatacaaagacttcattttctttgtctttaaaatagttatacattttctttctataatgtccccatgcttttcaactaatttgaattttcagaactggaagtatttattatttctgtgttagatgctcttagtcacttatggcaagagtgagttaatagagacaggatatggattagccatagaacaatacagaagtgtgtggattcagataggataaagatcaaagcggtgacaaatacattcttttgaagcggattctcataggtcaccagtcaatgtccgcattcaaggtgcgatgatgtgtcagctacattgtgcaaatggtcagctctgcagagtaaacttggacagcacactacaggaccaaaattacctgtaaaggtatggggaaaataaaccatcatagaaaaaatagtgtgaaggagttctcggttatttatacttggatatcaagcagaacactataatcaatgaagctataacctaaaaactttaagacttttaaagaggtttcccttttctcagggtatttctcaggaaaaaatttataaattatggataaactacttgcacaattagctacaataaatcccttccctgcactcatcctttggttggcctcattctaaatggactcaggtgttacccatgtgtcttgctcaggccaataggataatagcagatgtgacagaattggaatattggaaagggcttgcacatcgaagctttcctctctttcacagtgcttggaaaccctaaggtcacaatgagaataagcctgtgcccatctccattcaatgtcagtggcatggctgctcttaggtctattatttgttcttaaaatgtgtgttcagtttgttataaacatgtaagaaattacctgcaaatttatcaacttaagactacacccatttataatctctcaatttctgagtcagcagtcagcacatggctttgctggatcctgcccattggatttcacaagactgtgccacagtgtagactgttcttcattctcacctgagactccctgagaagagagatattttagagctctttcaggtagttgcagagcccatgccttagcacctctgtgactcagggcttcagcttcttactggctcttggctcaaggctgctctcaggtcccagaggctgtggacaattccctgccatgtgatgctcacacaggcaatgcccacatggctggttgtttgttcaaggccagcagaaggtttcagagagtgtctctttccagtctgctatgacagaggcttacagaatacaatacaatcattggaaagacatctcataacctctgccataccatatgggttagaagcaagcctaagttctacctgttctctgtggaggtagatcacacaatgccatgactcactggagacaggtttctgctagggtgttctggcatctttagtttcctcaaatatcagggtactcgtactgagtgtgaaatctctcctacatctacttcatcgtgctgtgtctgactgatcagacatttgacacatgacttttttttttttttgtgacggagtctcactctgtcgctgaggctggagtgcaatggcatcatgtcggcccactgcaacctctgtctcctgggttcaagcaattctcctgcctcagcctcccgagcagctgggattacaggcacccaccaccatgccaggctagtttttatatttttagtagagacggggtttcaccatgttggccaggctggtctcaaactcctgacctccggtgatccacccatctcggcgccccaagatgggattatagggatgagctaccatgcctagcctactttagtttttaagtagatttaatgaaatctatttagtagccaaaagccaagaatgccaatagttttacctggctactctctgaaacaatggtattaaaaagggtctttccagcccctttccagcagaaagacaggtgctaagaaacagtggaagtgtgaaggtgggggaagggagagaaacagtttttatatacctaaactaacccagctgcatgtaaaccagtaactactcatcaaaataaaatacagaaagcatattagttttggtttggtgtgaaccagccttaaatacaaagttgttacactgaatgggtttaattgaccaaaatgcgtagggaaggcagaaaggattaggatgcccttctactcagctttatctgctgtcaagtctggttcctcaggggacacatggatcccctccattgtcctgcagattctgccaggccaaggctgttaaatctggcggggtctcatgtgtggacttctgggtgtatacagggagaaactagagaaaggccgagcagatttttactgcatgtaggtaatctacgtgggcttttagagaaaaaaggctttagataaaaagtgtttgacaaagtcacacatggtttgtaaaaaaacaaaaaataaaatacaacttgaaaactcttggagaagtgacactttagtttcccaaatcactcttcttcatacacttccacttagctttttttcaccttctagctctgtggtcttagaaggacatgcacttaaaataatttgtttccataggaatccaacaagtaaaagcataaacaacatcaaataaactacatcattagcatagaagcatgtcaaagaaactgagattagattttgagttttggcacaagtattagagaaatagagaaaagatttaaaagatagaataagacttacacaagaaagcaggacagcaatacgacaattgaacctatcatagaataataggttgtgataatggatggtgagaagaaatgcattggacagacatgcatgggcatgattgatttgagcaatttagcatggatcaagacaaaatctttaggatttaaagggctgtgagctgggtagtaaaaagccccattttagcacctcttggggctgtagatggaaagaacttggatttaaaactattttcaataagtgtctgctaagtgctaagtattatagctataaggatacctaaattaatagaagcacatattatctgttggatatattctaaatcttttaccttgtttaaattgtaaaccgacctatgaggtagaacctattattgtcacagcattgcgggtatagaaaaggaggcaaaggggggttaagttactttactaatgtcacacaacatgtaagcggtaaagctccatccccaaccccaagggtttgacttcagggcctgccaagacaacatctggactgttgcatggatcttgcctggctgtacatgaagctctaattccaggatggatgaagattccattagaacttggagtagcattaataaaattgcttccttgagaccaggcgaagtgtccagaaagcaaaggagtttaactgcttaaaggaaaggtgcagatttgtaggaaatgaagctctggactgtgaacagagtttttcaaaacaattaaggagaagagaaattgagtctagtttgatagatgtgttgtgcagagtgagtgtagtggagattagagaatcagccaaggaattatcccctgccttcatggatggcatcaacatctgtcttcatggcaattgtattggcagcctgagtgtcagagcctgggtcctgcccatccatgcagctgtggtcacctttgcacctgcagtgctggagttacttgagtgttactctttgaggtagcttcaggacacttggtaaaaatcactaagtggcaagtgaaaggcttggaagaaaagttctaatcagctcttcattcccacctgatgcaatttttgctgctgctgggaccccaagttctttgtctcctccccgccgcttttttttttttttttttttttttgagacagagttttgcttttgtttcccaggctggagtacagtggtgtgatctcggctcactgcaacctctgcctcctgggttcaagtgattctcctgcctcagcctcccaagtagctgggattacaagtgtgtacccccacgcctggctaattttgtatttttagtagagatggggtttcaccatgttggtcaggctgatttcaaactcctgacttcaggtgatccacccaccttggcctcccaaagtactgagattataggtgtgagccatcgcgcctgaccccttgcctcttttgtaaatagaaatcaacaccaggccaaacagaaattgtctcaggcaaggtttaataggtttgtggcaagagcaaagcaagggagcagcctatgggtaagagatcctggtggctattccttgaagtgcccagctcttaccattttaaggaagctgaggcggaaaaaggaatgacatacaagcatggttaggcaaagttttctttgcatttgtgcagtggagcgtcatgctctaacatatataacatggtgaggaaatggaggataagccctgccttgggtggatattttagtattacaatgagattataatgaggaaaaatcagtgaaaggtcagttctggggaccatcccaccttcagctggctagatctcatttggtgctttggggaaatgccagctctatcagcaaccttggaagatggtcaggttcttatcaggaatgttagagttccactttagaaaccttgggaggctgggcacagtggctcacgcctataatcccagcactttgggaggctgaggagggcagatcactggaggtcagcagtttgagaccagcctggccaacatggtgaaacgctgtctctactaaaagtacaaaacatagccgggcatggtggtgtgcacctgtagtcctagctactctggaggttgaggcaggagaatcgcttgaacctggaaggcataggttgcagtgagtgtagatcgtgccactgcactgcatcctgagtgacagagtgagactctatctgaagaaaaaaaaaaaatgaaatcttgagatactcaggccctatcattttcctacagcaagcgaggagttgccattcaaaagaggcacaactggtggccacttcaggaaacttttgcatccaaaagctgagtctggtgcacctagtgacattgccacagactccagtcagcatgcatagaaatagtggatacctggatttccatcgagcaagcaggctctaaaggtcttaaataaatgccttggacatgtatagttgtatagattccaaggctaccgttgcaaagggctccattcaaagttggcaactttgttcatgattttgactaaggtgaccaaaaaaaaaaaaaaaaaaaaaagactcagggggacagtgcaactaggtgagaacccagtggctttcctgagcttatttgtcttgcatttttgttgacatggattgttgttcacattgtcttcctctggcaggtccacctggaaagcattatatatttagcaagaaaaaaggaggctgtgaatgatgtcactgcggactgcgtatattccctgttgcaaatgtcagatccatgaagcataaagtgattaactagaagatattaaattccttacaaattgttgaaaagccttaaagaacaggctccagtcaaagcctctagaacaattccaagaatcatactgctggcacaggctggggaggagctcctactgcttgagacattcaagctgtcttttgcagcagaaaagagaccagctcttctcactactgcccccaggaggacagcagctctgctatcaactctcaactgctggaaatctgacccctttctctgactgcccatcagatgtgtcactacagagtcgttttggattgagatgagggaggggaaatgtctgatttcactcaaatgtgctcattttcctggtctgggtctcagccaggcagcacagtcctgtgggcacaatatcttcacttgccaggttcctataaaatgagagtatctttcttgactgtggaaaatatggaggcgaggagggtcaagcaatagcaaaaggagtacttggagttgcctgagcttccactctggtttccccaaatgttttcaatccatttaattcatgataataaacacctttctgcctaaccagccataatcgcttttcttagatccaaatgattcagtgataaaagtaaagagaaaaaataaatacacttttcaacgttgaagctgaccaggtgtctgcctctggtgtttacccctccacatcccactatgcatttcatcttccctttgcctcactggagatccaagtgcaagtaatgcttcacatgactgtgatccctagaacttcatcctgatgactgttgaaatcttctctgagttttaccagtggaaatggcaataaatagaaagattccagaaggtcccctagggtccatattttctgtacttcctctctaaaatatgtaaaatcagttatttttgctcttgctttatatgggctagatctatggccccagcacacatctgaatgccctgtgttgacaacttatccagtattgtattaagtctaaatggtgacatgcttatcatatcatttcttccaatttcttggaataattgtcatgtcaattctttgcattaagaaccatcagccagaaaaccacagccctgagaaaatagaaatagagtatttcaagctgttcagttggcacaagaatgatgaatctgcagctcattttcaagatataaatattctgtttatggaagtaacagcaccattcatgattagtgtttcagagcctccaccacttctgacagcatagcaattcaatagcacaagggtttgtgtgacagctttgcttgactaataatgggtttttccctgtctatagggaaagctgcacctgtgcacatgacaagagcatgagctacattttgcttcactttttttgaggcaaataagttgcttgatccaaagccatattatggaagaacttcctgactctgatgaaaactccttgaaaatccacaaataatattttatgcagaaacataaccgaaaaggaaggcaaatccatatatagtaaaataaccactgccatcctcatgttccatgaggtccactagaatcacctgataccagtaattagtctgagccctgatgtgtggtacaatgttaagggttctggaggggtcagttttcttggcaaattgggtgttcagaagagccagtagccctgtacatctcagttagttgaaagtcatattattgagtctccacagggacctccataacactggttcgtgaggctagctgggaaagctggaagaggtaactgaagtccatatgttgaatcatcctcattattaaaagccccctggtcgttaatggcatttcaattaatattcacttggaaagcttcttattcttgattatggctcatttttgaaacttctagtcatagctcttacagaatgactttgtctgaaatcatcctgttgcatttcttttaaggcctgatgatctgtcaaaaccaacagccaatattattaaactgctgttctctttgcaacgtgatcatcagatgtaggccttgcagtttacccactgttatgagttttacatttccagggcttccttgacaatggcactgatgtgactccatccagcatccattgttgtgagaactctatttggaatatcatcattgtgggcatgaacataatggagacttttataggatgcaatggttaatattcaacattattcaaaatttgctctagccttacccttggagctctactggattggaaaaatattttaggtaaggacaaccatttggtaaagttttaaaaataaaggctacaaataaattttctgtagcaagagtatgaattaggtgtcatcacaaataccattttttttgtgtggaatgtaacaattatttaaatgtatataatttagataatattttataaataaaatatgtatatattgcatatataatagaataaatgtacttaaatatgaatactgtacgtagttgtagccaacattttatcaaataaatatatattcacttctatgtatcttaaatatatatgcacttttttccataaagaaggtaaattttaattttttattgaaatactaattagttttaattttgtgtttttctcttaataacttcataatttgattactaaatattcatatttataccaccaattcaagaaaaaatatgtatgtttatataggtagaggtgtaaatactgtatcaggaagtgtttatgcattaattacggtaactggttaaatgtacaactcagtggctgataacagtaaacatttgttttcatgttcatagatgctcatgttcacaatcatctggctgatcaaggaaggtctctgctgagtggctcctctcagcagagaggagcctgtagattgtattcagcctgtagatatcagttgtttaacgacaaggctgaacagcagtgactacacatgacacaagattcttgtggcaggtcacagtagtgatcaacatcccaaaccaaaccgcacagttgaatttaagtccaataatttctaacatagcttcaaacatttaaaatatattcctttatttcaatgagtataagtttttaagaaaatgtttactccacttaattgtagaggtgtttgatcattccatagacaaataatcatgttttcaaccttcacaatcctgaaaatatttgcaaatgtaagtttgcattaataagaaaacaaagctggatgtgttttcaacatgtggcttcaaatataatttttttaaatgacctttttgggggaaaatcattttaacttatggaaatatccctctttacctctcatgtcctatagggttgcccaataagagggtcccccatgagatttggaagtgagaaaaggaagactcagtattatccattggtacctaagaggcagagagacaaaggtgaggactggagaaacacctggaaagatgctctaggaagcgagaacttcagcaattccagacttaaacttccagacaggactgaggaccacatgggtagaaaacccttacttcaggggtggatacattctgttttcagtgggagcaccaaagaatgctgcttctaatatcaactttcctgaatactatatccttggttttgaaaggttgtagtgtgaatgttaatcataggaattgggtcattcttgtcataccaaacagagccatgaaaccagaggggaaaggcactcagggtgaaaaatattgtttctagaatgcaattgaaataggccctattatgccatggaactaatgtttatggttttttgaataaacatagaaattgacttccccgatcttaaaactcaagatagttacatctgtcttacctgagttcttttttcagtaaaccaaccatcaggcctcccagatactatcaaggagctgaaacttacatatcactgaatcaggacagtgggacatcagacccttcactcattatgactgcataactgacctcctgcttcttgttgaccaaattatctcccttaaccctccataattcctgttttcccacatttcttccgtgctatataaacccctaatttttgttggtcagggagatacatttgagaatggtgtcccatctcctcagctacagcacctgattaaagccttttccttggcaatacttgccttagtgattggctttctgtgtggtgagctgcaggatctacgctgaatccctggtatttcagtaacaaaacactctgcaaccttcactgctttggcttcttgtaacctgaaatcaaatttgtccacaacttctgagataacttgatataattctaggattcactttgtccaccactgcttcccagtctgagcttgccagctcccaacccttcctagtgccaatgaactttctcaaagagccataggtaatattttccctttttcatgaaacactaactttttctttgttcttgccacatattgaagaccactgagttttcctgtatgccccatttgggaaatatttctgtgtaaataaaacattacatttagagattcatctctacattttatttagacgtcagtagtttactttaattctctgtattaagacaattcctgcctagaatatctatagtggcttcttctctgttatataaagtccaactgaagccataaactagactcctcaggtgtcatgatctctgtctgtattaaattaggagaggcattgctatgtctgtgtagttggggctgagaaagagaaaagaattagggtgcagaggtgacttcatgtccccttctaccaacaccatcagagtgtggctgcatctgaggaacaatctcagctgatggaggcatcaggaggagcagctggggcagcccagcctcacacatctgcttccctgggggtttatgttcgggtgtgtaacactgtgggagggtaactattatgctgtagacagtaataagttgcaaaatcttcaggctgcaggctgctgattgtgagagtgaattctgtcccagatccactgccgctgaaccttgatgggaccccactttgcaaactggatgcagcatagatcaggcgcttaggggctttccctggtttctgctgataccagcctaaatcatttctaatgccctgacttgcccggcaagtgatggtgactctgtctcctacagatgcagacagggaggatggagactgggtcatctggatgtcacacctggcacctgagattggaaacataaaaacaaatgtccacacaattaatcatgttgtaagagaatttccctgaacagtaaagcagtactgagcactctgggctgagtaaactgctagtgttctccatccttacctgggaaccagagcagcaggagccccaggagctgagcggggaccctcatgtccatgctgtgtcctgagtgggactgattcctgcatgaagtgtgtccagcctattaataaggcttcagggcaggaggctgtgctctgggaacatgcaaatgagcaggggatggggcaggctgggcgcagctgcagggctggctcatctcagtaactcagcagcagctcagtgtccccaggtgtcccaggtaagatcagggtagcacagatttgtctgcagagaatgggtttctactggagactattttgttacgagagacattttttagattttttttgacaatttgaaatattcctcaggagtcggtggagtatcatatttcattggcgtatggggagtatataggaggatattctttttttgtaggaaacacatagtaaagttttagacgatagaattctaaggtctttaaaagactattgtataattccggttagggaagggggtatttattgtatacttgcaacttttctgtaagtttatcattgttcctttctaaaaaaaattaaaaataaaatatattgacatgatgatgcatatatttgtaagtatatgcagctagagagaaaaaacagatcacctacaaagggaagccatcagactaacagaagacctctcagcagaagagattgggggcctatatttaacattcttaaagaaaataaattccaactaagaatttcatatttggacaaactaagcttcggaagcaaaggagaaataagatccttttcagacaagcaaatgctcaggaaatttgttaccaccagacctgcctaacacaagcttctggaagaagcactaaatatggaaatgaaacaccgttatcagccactataaaaacacactgaagtacacagaccagtgacattataaagcaaccacacaaacaagttggcaaaataacaggctaacagcatgatggtggtatcaaatctaacatatcaatattaaccttgaatgtcaacaggctaaacgccccacttaaaagacacagggtggcaagctggataaagaagcaagaccaaatgttatgctgccttaaggagacccatctcacatgcaatgaagcccatggactcatataaagggatggagaaaaatctaccaagcaaatggaaaacagaaaaaaaccaggattttaattctaattcagatgaaacagactttaagtcaacaaaaatcaaaaagacaaagaagggcattacataacagtaaagggttcaattcaccaagaagatctagttactctaaatctatatgctgccagctcaagatcacctagattcataaagaaagttcttagacactttgaaggagacttagattcccacacaataatagtgggagatttcaacaccccactgacagtattatacagattataatctgtataattaattttctgaggcagaaaattaacaaaggtattcaggacttggactcaaccctggatcaaatggaccttatataaatctgcagaactcttcaccccaaaacaacagaatatacatattctcatcaccacatggcacatatgctaaaattgaccacacaatcggacatacatcaatattcagcaagtgcaaaagaaccaaaatcatgccaacctctctcggaccacagcaaaatgaatgtagaattcaagactaagaaaatcactcaaaaccatggaaattaaacaacatgctcctgaatgacttgggtaaataatgaagttaaggcagaaatcaaaacgttctttgaaatgaatgagaacaaagatacaatataccagaatctctgggacacaggttaggcagtgttaagagggaaatttatagcactaaatgcccacatcagaaagttatacctcagattaacagcctaatatcacaactaaaagaactagagaagcaagggaaaaccaattccaaatctagcagaaaacaagaaataaccaaaatcagagttgaactgaagtagataagacacacaaaaaaattcaaaagatcaatgaagccagtgcctgtttttattttgaaaaagctaatgagataaatagaccactagctagactaataaagaagaaaagggtgagtatccaaatacataaaattagaagtgacaaaaggacattatcactgaccccacagaaatacaactaaccatcagagactactatgaacacctctatgcacaataactagaaaatctagaagaaatagataaattcctggatgcatacaccctcccaagactgaaccagaaagaaattgagtccctgaagtgagcaaaaatgagcttgtaattgaatcagtaataaatagcctaccaaccaaaaaaatcccaggtccaaatggattcacaactgaattaattccgcggatccttctatagtgtcacctaaatgtcgacggccag

SEQ ID NO: 7 - DNA, 312376 bp, Artificial Sequence
  FIG. 1C
taatgtggtgactagactagcctagtgggattcccattaggctcatcatactgtgattgaacagtgctggtctgcacctcttcaggttaacaggggctgtggagtgacctggtgcaggaaatatcatctccatccataggatatcagtgtgaacccagggagaggcactggtgcaagagagatgagaacaggggtgtggagtaggggactgagccttcactttgagccgaagaagtttcctttcctatcctcaatcctgaacaagagggatttctggacttctttttgttttcaagtttgtgccccttcagatttggggctgtctggaatcctgccaggggacaccgagaaaaaataggagtctcacactgactgttgtatttcatctgctggggccatcccaaaccactgcgtacaatttcctttcctggtgctcaaatagctgctccacgcacttgttgtggtttcagagatgaatctgggtgggaagacaggacagtgtatgttataatatttaaatggaacccaaatccattaatatttattttaatatggaacattaaaagagttttgtaataggcaatgggaaaaggtaaaaaagataaaagctttttgagaaaaaaaacaaaaacaaacttatagaatgtctatgtgtcttcagtgttgcagggttgagagagatcagctttatggtgccccatggatgtgctgagatggggaaaatcaagaaagaaggaagtatgtaccactgtgactcaacaaataaatcaaagtaaaatggacttaaatctttcaataagtcattcacaataaatatcactctggtgcacacagaaatgcctgttagcaaactttcccttccccctggccatgtctccatggatcacctgtgtgcagagtggctccggtcagtgctctgtgttccctccacagggctccccacaacatgtgccctgtgtggatgtgggtgcatcgcctggggtggctgatgtgctccagggattcgatgctgcagatgcctcagcaccaagggtgggggtgggaatgggacaaggctgcagctggggagaccaaggatcaaccacacacagcaggggtttccacggggtgagcagcctcatttcctgacagtagagcgagcctaaaggtaggtgccaggcagtggtatctgtggggtggcccaggcctggagggtcacagagacacaggcaccacacagcagagacactgagggccaggagctcactcaggtgagggacttcagcagatctttctctcctggtacaaagagatcaagttcctaccatcagaatagacaaacaaggactttaatctcctcagctgagccccactgtccagggaagaagtctctgagcccaggcccaggtgagagtgggatgaggagaggagccaggacacagattttcatggatgccccgccctcctctgaggcagagcggataagacagggctgggggcatacccagtgcttgagtctcaggaggcagcgctctcgggacgtctccaccatggcctgggctctgctcctcctcaccctcctcactcagggcacaggtgatgcctccaggaaaggggcctcagggacctctgggctgattcttagtctcctgctcctcaggctcacctgggcccagcactgactcactagagtgtgttttttcctttttccgggctctcgggctcagtctgccctgactcagcctcactcagtacccgggtctcctggacagtcggtcaccatctcctgcactggaaccagcagtgacgttgggcattataactatgtctcctggtgccagcagcacccaggcacatgatttatgaagtcagttataggctctctggagtctctgatcacttctctggctcccagctctggcaacatggcctccatgaccatctctgggctccaggctgaggacgaggctgattattactgcagttcatatacaagcagcaacattttccacagtggacataagattgattctcaggctccaagtctggccagtgagcttctttgagactccctgggatcccagcagtgacactgatcactattgctgtcccacacatcccaagtgatgaggaagtaagaccaaaaccctcctgagattcctgacttgtgtcctgacaccagggctgttgggattcctgtctttccttcaagattgttcaaataagcagtgacagtcacttccatgtgagatatgagaagaagaataattccatatgaaccaaatccacgaagcctacactgaagcctgccaagttctctgcagtccagcgcgatgaagggagcattttcgtgggaacttttgggaatatgaggggagccaggctcagctatgggttccagagacaaagctcctggatgtttctccccggccttggtccatcacctgctacctctcctcactctttccacagacactgccccaggctaagcccccacaggaccctaagcctattcctgaccctgagctcagcccaggtgatgcttcaggagatgggatcctgagaatgagccccaacatctctttaacctaaggtgtggggtcatgagacacctgttagccataagacacctgtcccccacctgctcaggagacagtggagcaggcaacagtgcagagagaaccagcaggagccaggccaggccctgcatccaaagcaggccccagtccccacagattctccagctctagcctgtggtacagcccccactttctgcaggctgaaatgggcttctcaggatgggcaggccatgatgggggatggcagtgtgtccacaggacacagccctgctgcctgcctgaccctcatgccccctccttccccaccctggttaatctccaccagaaagggcccaggttcagaactcaggacacctggatcagctcctggacttgcccccactgctctctgttctcctgagccacttagtctcttttggcctcagtgttacctgctgtgaagtgaggaggcttatactgaactgaggaagctcttttcttcattcaaaattaaaagacagaaaaacaatgaaagtcatgtaaattaaagcctgctgaggggatgtcatttaatgggcttcagtgggtttcagacgtggaacttcttgtcttttctctgcagggattccaagacaggggctcaaaagagcttgctttctgtatggtgggaacagcggtccctagctgagaataagcaggagattcccagcttcatcaggaaggcagactaggctagtgtagaaatcctctccgtacaaactctgagaggtgttgaataaaataaagataaacataatttcatgttttcatggtgccgatgatggtgatgttagctcacaactaagctgcagtgcctggaacatcaggaaatcacagtgaatcacagctgctcttattgggtgggaggtgcaccagtttgatgcctaagtacatagaaagcctgggtccctgtaggatggcacatgcatctctctggactttgaaagctttgcagaagagcttcagttgactcactctaattagtccggactgaacaaaaccactagaggagggcatttcaaccctgagacacttctatagccccaacttcctaccctgcgtgtgcgaactctctgtgctgggctgggcagggcagattgggtcaccctgcacagaatggggctggactgtctggtcctcaacttctgaggtgacaggtgctgtggaggcacgtggaagaaaaaagctcctgggctgagtctcctccaccagctgggggcagcagagctgcagccaggagcagtcaggattaaggctggggctgcccagctggggcaaagagaaggccagcctggcgttcaacaggtgtccaagaatcagtcttcagactgaaagtgagtgcagttcatcctatcccctcaggctgcagtgaccattctctgagggtcagactcatacagtgtcaccccaggacactgacagaagcccggcacagtgaaggcctcacctgggaaatgcagctggaggaggctgggaccaggtgtcaactggggcagcttactcaggaaggggatttctttggagacatcccaaggttgaggtgctctaggagggggcacagcgtgaggtgacggggctcccagggcccgggttcttcacccaggatggctgtctgagcctcctgccactctcagggccttgtccctctcagtccagcagcaacctggggagctgagccctctgtcctgggcacttccagatacaccatacctcacttccttctgcctcaccttccagctccaggcggactctgactcagggggaaactcctgtgctcaggggagtctcgggtgggtggggtgaagcatttgggatcctgatcccttcatggggcatccccagcatccttaaggagacactcttcagagggacagggcttctcacctgcctcagctctgaccatggggctgtccacactcagtgacaggacactgaccagggatctgactggagtgaccaggaacctggctggggcaaccagggaccacccaccctctggagctcacatgctgtgcagagaccatgaccctgggaccccttcagagaccatggggcctgaagttagattttcagtccagtgtggttttctcctgctttttgcaagtttacataaaacattgatgagaaaaacatacataaataacagacgagctgagggtgccaattgctaatctcttgtggcaatgaggggtgatgtagcaggagcagcaccatggctgaaatgagaccagaggccctgttgactccacaggggtgtgtggttgcttaaatgacccaactattcccactgaataatcagcaagtgtcccaatgacacagcacagcatttagatgaaatgaacaagaggggactgagtctgagggaccagggggaggaagatcatgggtccctgggccacctgctgctgagtcaggtgtcagcaagatctctccgcagagcccagctcagcccatggccaacctcctggaaggtccacagctctgctgagcctggcccaggacagaccccaggtcagcgaggtttgggacagtggtcatgagattaattcccagaaaggtgactgtgatcacagggcttgaaggctgcagctgattttctaatctgagaccctgcttcttcctcctgttgcctgtgctgccctcacagctggtttgagtgacatctctccaggaggaatcgcagaggatgtaaatttgcataaacgccaaacactgactgcccccaaaagctggagagggaataagagaggcctggggagcccagctgtgctgtaggctcaggaggcagagctctgaatgtctcaccatggcctggatccctctcctgctccccctcctcattctctgcacaggtgctgcccctaggctcagtctccacagaccccaagttgagcctgacctgaatcctgagcaaagccctgccactgcctctgggggggattcctggcaatgcgtcctttgtcctcaagccccctctcctgtcttttcttgcagtctctgtggcctcctatgagctgacacagccatcctcagtgtcagtgtctccgggacagacagccaggatcacctgctcaggagatgtactggcaaaaaaatatgctcggtggttccagcagaagccaggccaggcccctgtgctggtgatttataaagacagtgagcggccctcagggatccctgagcgattctccggctccagctcagggaccacagtcaccttgaccatcagcggggcccaggttgaggatgaggctgactattactgttactctgcggctgacaacaatctcacagtgacacaggcagatggagaaatgagacacaaaccccttgccatctgtgtcaccttcttcctccagccccaggaggactgtggacaaagccacgaacaggtctggcccagtacacccagatcagagactctgaggcctccttccttccagatctctacggaggccctacagaaggtggatcaataataaattcggggttggcaggtccagtaggtcctggtgttttctgggctggagtgtgacttggggaaaaatgacttgaatggaagtacagtcagtgggagacatctattgagtggtgatggtcccagtatttccttgtgtggtgactgaacctagggcagtgccactactctgtggcccaaatgccctgggttattcctctgagttccccgtgtattattgagatgctccagcccccactctcatggtatcctgatctgaagaatcatggccagtgcccattgcagtgtctccatctaggtgccattttcaggactcatgcatccagcatccaaacaaggctgtgtgggagaccgtgacttgtcacagctgttccccactggaaaatgccactgagctgcagagaactgctctcccagtgatgttcccccttcacagtgtggttcaggtgcaatgcctgcctggtccctagattttaatgccatgttttcatttaaaataaccacgaagtgtctcttgctgagcgctccggtgtaacacattcccagtcatgcctctcacaattttctttctgacaaaatttcctgaaaccctattgcaatgaattctccctctcagagtaggattgcagggagttcacaaattaacaaacaaaccaaatactgtctagaagaaagaggatcaaagaggagagagctgcacagggagcgcactctggagtctgcagatattcatgagcaccgatgagcatgtgcatgggaggaaaccttctgtgatagagaaaataaccattcaaagacatttgaggaaacactccatagagctcacacacacatccatgtgcacacacatgcacaatcagaatagtgcctgttcctccgctccatgaagaaaggcccgagttaaagtgggtgagatttaccagtgagaagagctttgcctcagtactggggaaaacattgccctagacaaaaggcatctctggtgttaactaagaaagtgtacggcccctgtgctgatgcccatgtcaaagaccatcacacgtattttaaccaactagcccagagttgtcaccaagagtttgatcttacaataattctgcaatgaacatccctattcagactccttggagttcacctatgaagattaccatagaataaatctctagaagttgaattgttaggtcaaaaagaagtacgtttgtaattttcactgattattctcagattcctattcacgggggggttgtaccaatttacagtgccagccataaatctttgacgtgagtatgctgttgaaagtttgggtttttgccaacatggtagattaaaattttgttgtcttgtaacagtgttattttggatttctcctattctgcttgaggttgaacattttctcaaacatttcagggctcttatattttaggatttagtgagcttttttctaaaatggccaggtaaggagggttttagcccctgtgggccaagagtcaactttgaccatattatgagggaacttataactccagttacaatgtaaccatttaaagctataaaaaccactctcagctctgggaccacacaaaacaggtggcaggccaggggtggccacaggatgtggtttaatggtccctgttttgtagggtcatttgaagtttaaaaatttcaccagcatatattttaggtggagatctttttgtgggtaatactgtatttcaccgcctatagtggcctgagatttctctctagataagaacacacttttcttattttttggatggattttgggtctatctgtgatagccctgtgtcataaactcataacttttgtgtccgtccttttactgtgatttttgggagtgtgacagtatatcaggaatacactatccagggtggaaaatcagagagagggggaggagcaagtgggcaaggaagcttgtaccaaagctggaatatccactgcagcaggctcagagaaaagggtcctaatatcagcatttgactgaagccaaaaccacaagagaccatagaggttctgaggatgacaaataaaaacatagtttaagttttaatgcattcattatttttataatccacaaaaattctaaaactcagaatttaacaatgggataaggaaaagagtttgagatgttaaacgataaagaccccaaggaaagttgccaggaaaagaacaggacctttttggtggaactatgtttatgctgtaaattaccctcttctatatgtctatatatatatttaggtataagagaacatctcatggaacacccttcttcaccacagtcaaagatcaccctcacccaaggagggaaccgaaagggaacgtcaatatgagacagaaaacataatgcacttttgtataaacattaggagagtctctatttgcatatcaaatgtggatgcttaatgttaacattggaaatagtaggttaatatgcatgtgaggtgagttttcttttgactatttctgtctgtgatttatctttcttaatagggacatttctgcccttagaacaacttaacttgtgatattttttgttctattatctgtatcagctctgttttttttttttcaaacagtggcaaagatatcccatgactaatgattaataaattcaattaatgggtatttaaattatttcaagagtggacagttgtgacttccccacatctaactcacagatgtcgctgatgctgactcactcttctcttccaatcatagcaaataaagtgggagctttgacttttctgaagacccagatgacaacaggagagaggaggtgaaaccccctaaagctgttatcctttaaaccctcaggaggaatcatcctggagaaacacccacacttgagttggattatacctaaatgagagtttggtcttagagttggtgctgagttagttcaggatttgggttgttgggatggagtgaatgcgctttacaagtgaaaaatacatgagtttttgggtccataggttggagagttcttggctgaattgtgtcccccagagttcatacaatgaagctctaatgcacggtgtgtgactgaatttggagagaatctttaaagaggtgattcagtgaaaatgaagtcatgagggtgggttcttatcgaatctgactggtgttctcgtgagaagagaaaatttgcacacacaaaaatgagacactcgagatgagcgtgcagaggaaagaccgtgtgaggactcagcaaggaggtagcgacccgcaagccaaggagagaggcctcagtgaaaaccaaacctataaacactttcatcttgactccccagcttcagaactgtgagaaaataagtgtctgctctttaggccagcaggtctttggtatctcattaaggtagcactagcaaatgaaaacaaaagggaccccaaagaccttggatgcgggaggaggaggagatggagcagggtgcaggaggtggggcagggaggggctggaagttcaggctctgaggtcatctcctgggtggaatcctgactccactcactgctgtctggggacttggggaaaaacaattaaccgcccaatattaattccatagtaaagatcgggccttgagcacaggattcctcatcttccttttttatatgatgaaagtcttcttgaggtcatgcttgtaaaacactcagcaatgtatctggcatacactatggtctcagaagtggttattatgaattttctagtgatatgtagaggatgacattggtcctgtgggcagagggggcactgtggaccttggtttgaggactctgaaagacaccaagtccgctggtagtgctcaagagcgaagagcatcacagatgcttcctcccaggccccttctattgggtaaaatttactctccactcctgacacccatctggtccttcttctgaccttagcacattatcagtttgaagacttaaggctcagggctcagatgggagctaggacaggcacactggggaatgaggagtagatttgcattcactgctcatcagagagcccacccaacaaggatacaagaataaaagaagtagatttgcatgaagagcctctccttcccatgataagagaggcctgaaggtccctccccagccatgggctcagagacagagctatgtggcatctccaccgtggcctggacccctcccttgctcaccctcctccgtctctgtgctgcctcccagggctcagcccccaaaggaccagagatcagactggccctgagcttcagctcagcacagggagtgatgcagagtgtggggctctgggaatgaccctcatcctcataattaactctcctgtcctctcttgtaggctctgtggcctcctccatgctgactcaggagccagtagggtctgtggccctgggacagtcagccagggtaacctgccagggagaaaacctaagaagccatggtacaaactggcaccagcagaagccaggctaggctcctgtgcaggtcatacatcgacaaaataaccagccctcagggctcccagaccaattctctggctccaagtcaggaacacagccaccctgaccatcactggggctcaggttgaacatgaagctgactattaccatcactcatgggacagcagtgctactcacctcacaatgacacagacagattgggaagtgagatctaaagaccttcactgtctgtgtcaccctcttcctccagccatagcaggactgtggagacagccatgagcagggctggcctgggtcacctgcatcgaagtcctccaagctgcccttccccccagctctccaggtagtctctgcagagaatgagtcaggataggatttggggctggcagaaccaggctgtcctgctgttatttggaatggatgtaccttggctcaagatgacctgagccatcttactggaaggacttactggaaggacggtaagagggagacagctcctgagtgctcatggtcactgaatttcctcctgtgtgttgactgaacccaatgcagtgcctctactctgtggcccaaataccctggattatttttctgaactgcccgtgtttaactgagaccctcaagccccagctttgtgcatcctgatgttctgaacatggaagcctttcacagtgtgcactgtgacatccctcagattcccgtttcaggacttatgcacccaccatcctcccagggctgcagggaggccctggcttctcacagctctccccaccagaaactgccatgcagtacagagaatagctttgctcaaagaattgcccatttcagagtatgtttcgggggcaatgactccctgatgccttaatctgaaagtcatgctttaatttaagaccctgaatatcaaattgaagtgccttctagctgaacactcaattgtaaaacattcccagtcacacactccacacttctttcctgagaatatatcctgaaaccctattgcatggaatcctccctctcagagtaggattccagggaacttaaaaattaaaaaaaaaaacaacacaccagtctagagggaaaaatattgaagaggagagagttagggagttgcacaaggaaagaactctgaagtctgcaaatatgcatgcactgaagagcacttgtgtgtaaagaaactccctctgaaagagaaagacccttgagggaacactccaaagagtgtgcatgcgtgcgcacacacacacacacacacacacactccagtcacagaggaaaggcctgagttacagagcatgaggtggactcatcagaagagcttcggctcagtattggggaaaatgtcggacagacatagggctactccactgtcaactaagaaagtgtagaagcaaactgggaaaagttaagacagtttccaagtaactttactgaatccaaaaataaaagaccaaaatagagaagaaaatgcaaaaggattataaactcaacaaagaaaaattcacaatgattggcattctgtcaatatttcttgcaagcaaaaaagaaaatatatgctttaacacagagaaaaatgaatcaatccaaagtggccaaaaattgcacacatgatagaccttgtaggcacgaattttggagcaattctttttttttttttttttttttttgatggagtctcactctgttgccaggctggagtacagtggcgcgatctcagctcactgcaacctccgccacccgagttcaagcgattctcctgcctcagcctcctgagtggctggaactacaggcatgtgccaccacacccagctattttttttttttaatttttagtagagacggggtttcaccgtattggccaggatggtctcgatctcttgacctcatgatccacccgccttggcctctcaaagtggtgagattacgggcgtgagccaccgcgccagccttggagcaattcttataactcttttctccttcctcatgagaatggaggatctattgaatgtgttaagtggagaaatggaaagcataaagcaagatgcaagttaaacttttagaaatggcccctaaatatctgcattgaaaaaatacactggatgagactcattgcagattagaagctgtgaaggaatagatgagtgaacttgaagatatggcaatggaagttatgcaagatgaagcacaaaaaaagtgaagagagcatcagtgagtttcaggacatcttcaagctgacttactggttataattaaagacatgaagggagataacattggtggggggagaggaaaggtagaaaagccatttaaaggaatcatggccacaatttcccaaatttggtgaaagctagaaacccactactccaaaaagcttaacaagtcacatacacacacacacacacaaacacacacacacaaataacacaccaccaacactcaccataatgaaattgctaaaaacctattataaagacatacttttaaaagtagccataaagacatggtatgtacagatgaacaacatcataaaaagaacagatttctttttctttttaaaattttcttaaacatctgtgggtacagagtaggtgtatatgtttgtgggatacatgagatattttgatacaggcattgccatgtgaaatagtcacatcatggagagttgggtttccatcccctcaagcatttatcctttgtgttacaaactactcaattacactatttcaggtattttaaattgtacaattaagttgctgacatgttatcaaatagtattgatgtaactctgacatgctatcaaatagtaggtcttattcattctttctattttatttacccattaagcatcccctaataagagcagatttcttcttagaagtcatgcaagcaggaggcagtggagctatatttataaaatattaaaagaaaaaacttactaccaaaacccatccacagactcaatgcaatccctatcaaaatacaaacgacattcacagtagtagaaaaaaactctatagttggtatggaaccacaaaatcccctgaatagccaaagcaataccaagcaaaaagcccaggctgaatatgtcacattatctgaatcaaaatatactacaaactacagtaaccaaaacaagatcgatggtattggcttaaaatcagacactgagactaatataatggaatagaataccccaaaataaattcatatatttacagccaactgatttgcagcaaaaatgccaaaaacatacgttgagaaaatgacatacttttcaataaatggcgctgagaaaaactggatattcataggcagaaccttgaaactagacttttatctctctccctatacaataatcaactcaaaatttattaaaactccgaaatataagacccaaaactataaaactactagaagggaacgtagagaacacaggggaagttcttcaggacgttggtctagacaaaaattccatagctaagacttcaaaagcacagggaacaacacgaactagacatatgggacttcattaaactgaaaatcttctgaaaagcaaaggaaacgatcaacagagtgaagacaacttctagaatgagagaaaatatttgcaaactattcaactcaaaagggcctaagatccagcataagaaaataagacaaggagctgaaataactcatcagcataaaaaacaaataatacaattaaaaagtggataaatgatatgaatagacttttcacagtcaaagacatacaaatggccaacaggtatatgacaaaatgctcaatatcactaatcatcaggggtacgcaaatccaaacctccatgagatatcatctcatcccagttggatggctatcatcaagaagacaaaaaaataacaaacactggtgaggatgtagagaaaatagaagacaaaaccacatggtcatctcaacagtcacatcaaatgttttcatgcgaggaaacattaccatttgttgtttttctagtcttgctagagcatcataaaaagataagatttgtggtgccactattggagaaaatgttattacatgcaaagactctggctatcccacaccaaactacatgaacacttactgttaaatgctaaaagaggccaggcacggtagctcacactcgtaatcccagcactttgggagaccgaggcaggcggatcacaaggtcaagagatccagaccatcctggtgaaaccccatctctacaaaaatacaaaaattacttgtatttttgcacggtggcacacacctgtagtcccagctactcgggaggctgaggcaggagaattgcttgaacccgggaggtggaggttgcagtgagccaagatcacgccactgtactccagcctggcgacagagtgagactcaggcaaaaaaaaaaaaaaaaacctaaaagattacaattctgcatttccaaatgttctggtggtcagagaccacttccttgacaagtggtgagtacggggatctgatgggataggtggcatttaggcaggtattgggtgaagaatagtgatatacacaagaaactttcaaagagaaaaacacacggaagttggaacacagaagagaacataatatgtctgagaaataaggaaagtccagactcactggagctgagtgagaacaagaaaaatggcataagccatgtatttctctctggatatctcatcaaaatattgtctcctccccaacacaccacccatgtgaattataaaaatgcccgtttttaatttttgtttgcatgtcgtgacagagtcaagcacgtgaatcaagctgagtttgatgagtccagggctgttaagctccagacccaggtggcctcagaaggacttggtggaacaagggcttgttgtcaaaagcagaggaagtgagattttccattgtggcttagaccagagattcttaaattccagtggacacacaaggccccttaaggatctggttaagatgcagatgcagcctcagcagttctggatgtggccccaaattctctgtgtccggcaactcccaggtgaggctgctgctgctggtcctcccaggaccacactttgagtggctgaactcttattcacccacctcactcaagccacgggtgagactcacacaaggagggcaccttctagaagcacaggtcacttctcactcctccccttgtgtcttagatcctttcctgttactataaagaagtacccaaggctgggtaatttatacagaaaataaaagttttatttggcagacagttccaatggctgcagagttcaaaatgtggcatctgctcttgttgaagacctcaggctgcttcctgtcatggtgaaaggtgaaggcgagccagtgtgtgctgaggtcaatgaggggaaggaagcaagagagaaagggaagataccagtctcatttaaataagcagctcttctggaaacagaggaaattcactcaccccaagtgagggcattaatctattcatgagagatccactcctatcaccctaaaagctcccattaattcccacccccaacactggggattcaatttcagcataagatttgcaagggatgaagatcaaagccatagcaccctgaggcttggccacacacttgctcatctccacatttgtcccttccttcaggaccgggatcctgactgctctgactcagtctccgtctacctcatggacacctggcagtcggtcatcatcggttttgctgaatcagcagcaacattgggggtaacaattgtgtctcctggttccaccagagacagagtagagacccacacagctgaagtgtggggtcaaatattaaaactaagagacataagattgattctcaggctccaagtctgacaagtgagcttctttgagactccctgggatcccagcagtgacactgatcactgttgctgttccacacatcccaagtgatgaggaagtaagaccaaaaccctcctgagattcctgacttgtgtcctgacaccaggtctgttcttccctcccctagaataaaacatctcttaagcacaaggctgaagaaatgtggcctcctcctttctcccacagctggtcaaagtggatacctgagagaattggctcactgaggcctcttgggaacaaaggctgggttcctgcctgtgatctgtgtactgagacacattccggacctgcccaggaaaggcaagtatagatgatgtttagttgtcacagagtccaagtagggacaattcagcggtgtcttcttgggacccctgcctctggctattttcatctactttataatgggccagggccattatttccaacttgtcatatcctttttctcctttcctcaccaggtaaggaggtggaggacagttgatgagggctggcttatgagttaccccaggatgcaaatgactttgaagtcaagcccatgtggggtcaagctcagtctataaccagggtcttttgagctctggaggagccaggcatcccagccatcaaagaggtcttgcatttgctaataaatcctcttcttccaacccacagcttatcttggctgcctaccctcatctctgtcaggaagcaatccttcgttgtttaacaccaaattattcttacttggtcagtttaaaagtcccttcctcagaaaggtcatctgtggcctgaagacaaagtgagaaggctttgctgcattttcatttggaaccttacattgccccttctgcaatgttctaaccacacatggcacatatttacaggacagcgtgataattcacttttgaaaatacagaatgtgctcatggaacaggacaatgtcatacttttggggcctgatgagcatgtccttttcacaggaccccccagagctgcccatgcatccagaaggtaccattctactctatgcaaaacgatggggcatttctatattgcagtttcttagggttccttagaaagaggccacccccaacacagagctgcacaccttgtgaccacttactgtcaattcctcaatgctgtctccaagtctcaccatgcacaagggaggaacacagagaccctggattcctagagacttgcatttcttggatgaacaaatctggggtttggttggtggcagagagctcagggctcatgtgtgagcatcacctgatgcttcctccagggtcagagtccagcccctaccctggaaggatgaaagatattgtccacagaagtggtataaaggtaacagcatcgaggacggagctgcctcttgaaatgggctattgctttgcacaacgctggagacctaaattatgttgactataatggaagagtagtccctgcggatggcctctaattgggtggaagaaagcagagggtctgcgtctgagagagcagcaatgggcagattcagcacaggcatgggcagagcagcaatcaagggtacctgagcagcaatggccccgggagaggcctggcacctgccggaagtgacgttggagacagagaaacatctaagacttaaggcttctctttctgtgcaatcccccaccccacagtttatgtgtcacagatattggcacctccttactgtaaggggtcatatgaataatacagtcctcaggggcatgggttcgaggggcagccaggtttatcctcgaagcccacttctgttacctgcagctgtgtggctgtaagcaaggcatttaatctctcagaaaaccatcctaatgagaggttaagaacctctgagaaaaaaacttagacaagaattgacagtaattcttcactattgaggctgcagggatgtaacttaatcatgtttgtaaagtgcataacacagaccctgacatgccccagctgctcctgagttggcagcaattattcctgacatcactcatgagaattggacctggaatggggatggagggaaggcagtgcagagggtttcagagggttaggaaaagagagactttaatgatttaaaatgaaggcctaggagtggagacaagcgtcctgggacattctcctgccaactctcacaatgtctcagagactgttccaaggtgaagtctactagagagctaagggaggagtttgcagaatcaaggtttgcaatgtcatgcatgagggggcagagagtcagcgggagggaagacagctgagctcatctgaagggtatttatggttttctggccctagagtccttggccatccctctatgaccagggcctcagataagcagagagcttatctgcttctctcctccaacgatagttcctggttatcctgagcccaggtcagtgcagctgtggcccattctctcctctttgtgctcagtggactgacctggaggaaacagtaggaggttcccctgctctctgtccccagggtcctttcctttcagtggcaccagcccagccctagtgtccatccatctgtgcctgcccagtcaggcctccatgctgccccctgtaatggccacaggtcaaaaactgattgtcagtcttgagcagattgtcctgactctttctgcaaaactgagcctctcacccagcaccaggacgtcacaagcaaggccagctgtaggaaggcaagtaggggagtaacgtgcatcacagagtctggacaagacaaagtagttctgctgggacacatcctggtgatgtttctcaggatggttcaggtccctgcaattgcaggcccagagaacaggactgaaggctggaagatgtgctccctttctcctgtacacaaaacagtgccatgtgtgcatgtgagtaaatgcatatgcctgtgtgcttgtgtgtgtgcacctgtgtaaatgcatatgcctgtatgtgagagagtgtgtgtgtaaatgcatatgatgtgtgtgagtgtgtgcatgtgtgtaaatgcatatgcctgtgtgtgtgcatgtgtgtaaatgcatatgctgtgtatgagtgtgtgtgcatgtgtgtaaacgcatatgcctgtgtgtgtgcatgtgcatgtgtgtaaatgcatacactgtgtgtgagtgtgtgtgcatgtgtgtaaatgcatatgcctgtgtgctggtgtgtgtgcatgtgtgtaaatccatatgcctgtgtgtgagtgtgtgtgcctgtgtgtaaatgcatatactgtgtgttggtgtgtgcatgtgtgtaaatgcatatgcctgtgtgtgtgtgtatgcatgcgtgtaaatgcatatgactgcgtgtgagtgtgtgtgcatgtgtgcaaatacatatgcctgtgtgctggtgagtatgcatgtgtgtaaatgcatatgcctgtgtgtgcatgtgtgtaaatgcatataccttgtgtgtgtgcacatgtgtaaatgcatatgcctgtgtgtgagagagtgtgtgtaaatgtgtgtgctgtgtgagtgtgtgcatgtgtgtaaatgcatatgcctgtgtgctggtgtgtgcacatgtgtgtaaatgcatatgctgtgtgctggtgtgtgtccatgtgtgtaaatgcatatgcctgtgtgtgagtgtgtgcatgtatgtaaatgcatatgctgtgtgtgtgtgtgcatgtgtgtaatgtatatgcctgtgtgtgtgcatgtgtttaaatgcatatgctatgtgtgtgtgcatgtgtgtgtgagtgtgtgtgcacgtgcatgtgtgtgtgcatgtgtgtaaatgcatatgctgtgtgactgtgtgtgcatgtgtgtaatgcatatacctgtgtgtgagtgcatgtgcatgtgtgcacatgtgcatgttagtgttgccagggagtgcttcaagtatcgaatgtcccaaattcacaacttttctattttcctcacttacctcctccctgacacatgcttctcagttaagtgagttcatatgcgcaaggcctacaaacaggcaaggcatgggccatagtcagtgctgagtcagtgtcatcaaatattgttatgcttatatagaaccttgtccagggtgggccaaatgtatgcccctgtcttgtcctgacagagcagcagaaagggagactgagacaaaacaatggccagggccctggcaacacggagacaccttcccactcctgtgagcttcacagacaaccctgggtatgggattcctgtcattcctttaagattgttcaaataaacagtgacaatcactctcatatgatatatgagaagaagaagaattccatataaaccaaacccatgacgcccacactgaagcctgccaagttctctccagtcgagcccaatggagggagcattttcatggggacttttgagagtatggagaagacctgaggaaaccaggctcagctgtgggctccagaggcaaagctctgggatgtctccccatggcctagacccttcgcctgccacctcttctcactctttgcacagatgcttcccccaggctaagcccccacaggaccctaatcctagtcctgaccctgagctcagcccaggtgatgcttcaggagatgggaccctgagaataagccctaaagtctcctcaacctgcaggctctgtagtctcttaaagactcaggtacctccagtagagttggccatgagacatctgtccctccaactgctcaggagcaggcaacagtgcagagagaaacagcagcccaggccaggccctacactcaaagcagcccccaatccccacagatcctccagcgctaacctggggtacaggccccacctctgcaggctgaggtgggctcctcagcatggctaggccatgacgggggatggcagtgtgtccatgggacacagccctgctgcctgcctggccctcatgccccgtccctccccaccctggttaagctctgccccaaagggcccaggttcataactcaggacacctggatcggctcttggacttgcccccactgttctctgttctcctgagccacttagtttcttttggccacagtgttacctgctgcgaagtgaggaggcttatactgaactgaagaagcacttttcttcattcaaaattaaaagatagaaaaacaatggaagtcatgcgaatggggggatgtcatttaatgggcttcagtgggcttcagacatggaatttcttgtctttcctctgcagagattccaagaaaaggactcgaaaagagcttgctttctatatggtgggaacagcagctgccagctaagaataagcaggagagtcccagtttcatcaggaaaacagactaggctagtatggaaatcctccctgcagaaactctgagaagtgtggaatgaaataaacataaacatgaaattaatctgccaacgatggtgatgttagctcacaactaagctgcagtgccagaaacatgcggtgattgcagtgaatcatagctgctcttactgggtgggaggtgcaccagtttgcttcctaagtgcatagaaagcctggcacgcacgtctctctggactttgaaagcttggcagaagagcttcagttgacttactctaattagtcctgacggaacaaaaccactagagtagggcatttcaaccctgagacacttctgtagcaattgctcctgccccacatccctgcactgcatgtgtgacctctctgtggtgggctgggcagggcagattgggccacactggcacagaatggggctggactctctggtcctcaacttctgaggtgacaggtgctgtggggtcacctggaaggaaaaagctcctgggctgagtctcctccaccagttgggggcagcagagctgcagccagcagcagtgaggagagaggctggggctgcccagccggggaaaagaggaaggcctgcctaaggttcaacaggtgtccaagaatcagtcttcagactgaaagtgaagacagttcatcctatcccctcaggctgcagtgaccacgctctgagggtcagactcatatagtgttactccaggacactgacagaagcctggcacagtgaaggcctcacctgggaaatgctgctggaggaggctgggcccaggtgtcagcttgggcagcttcctcaggaaggggattccctggaagaagtcccgaggtcaaggtgctctaggaggggcacagtgtgaggtgacggggttcccagggcctgggttcttcacccaggatggcggcctgagcctcctgccactctcagggccttgtcctgccctgtccagcagtgtcctggggagctgagccctctgtcgtgggcacttccagatacaccctgcctaccctccctctgcctttccttccagctccaggcagactctgactcaagggcagctcctgtgcttaggggagtctcaggtgggtggcgtgaagtatttggggccctggtccctgcatggggcatcaccagcctcattgaggagacactctccagagggatggggattctcacctgcctcaggccacagccctgaccccggacctgtccatgctcagtgacaggacaataaccaggaacctggctggagtaaccagggaccacccatcctctggagctcacatgctgtgcagagaccatgaccctgggaccctgggaccctgggaccctgggaccctggaaccgtgacagaatccatggggcctaaagttagattctcagtccactatggttttctgctgctttttgcaagtttacataaaacattgatgagaaaaacataaataaataacagacgagctgagggtgccaattgcttatctcttgtggcaatgagggaatggtatagaaggagcagcaccatggctgaaatgagaccagaggccctgttgactccacaggggtgtgtggttgcttaaatgacccaactattcccactgaataatcagcaagtgtcccaatgacacagcacagcatttagatgaaatgaacaagaggggactgagtctgagggaccagggggaggaagatcatgggtccctggtccacctgctgctgagtcaggtgtcagcatgatctctcggcagggcccagctcagccccatggccaaactcctggaaggtccacagctctgctgagcctggcccaggacagaccccaggtcaacgaggtttgggacagtggtcatgaagtcaattcccaagaaggtgactgcgatcacagggcttcaaggctgcagctgattttctaaccagagatcctgcttcttcttcttcctcttgtcgcctgtgctgcccccacagctggtttgggtgacatctctccaagaggagtcccagaggaagtaaatttgcataaacaccaaacactgactaccctaaaaagcctgagagagaataagagaggcctggggagcctagctgtgctgtgggtccaggaggcagaactctgggtgtctcaccatggcctggatccctctacttctccccctcttcactctctgcacaggtgctgtccccaggccctgctccaggccctgctccagtcttattccccacagatcccaagttgagcctgccctgaatcccgagcaaagcccagacgcagcctctgggtgcgactcctgggaatgggtcctttgtcttcaagccccctctcttgttcttccttgcaggctctgaggcctcctatgagctgacacagccaccctcggtgtcagtgtccccaggacagacggccaggatcacctgctctggagatgcattgccaaagcaatatgcttattggtaccagcagaagccaggccaggcccctgtgctggtgatatataaagacagtgagaggccctcagggatccctgagcgattctctggctccagctcagggacaacagtcacgttgaccatcagtggagtccaggcagaagatgaggctgactattactgtcaatcagcagacagcagtggtacttatcccacagtgacacaagcagacagggaagtgagacataaacccctccccctctatttcatcctcttcctcctgccccaggaggactgtggacaaagccatgagtaggcttggccaaattcacccaaatctgaacccccaggctgcccttccctccagccctccaggcaggcactgcagagtagtcagtctggagtggatttgtgcctggcaggccaggctgtcctgtgtttctttgcctggggtttgagttgtcgatggagggtctgactggaaagacagacacagggagacatccatgcaggcatgtccaaagggacatggggaactctcaggtctcagttgaatgcagtcattgttgtatcctctgggaaagcattcctctagtgcatctaagacctccagacccacagagcctgagatcaggaggagagaatgttaaatttttgctaatggaccactgaagacatttttgagtggagccactacaatttactccttgattctggactcatggatcctgactgtgggagaaacagcaccatctattgggcactgatgcacagaacatgccctatcctggaagacattgtccagccctacacatacttgccacttgcctggtgcagtaatggtgtctccaagcagtcattaaaccattcatataagccatatgtctcagaatgtttgggacaagagtaagaatcttgattgccagaagaaaaggcccatagccctttatttgcagtgaaatgaattccttggtcagaacctcctgtggaataccatcatgatgggtgcgtcattctgtaatccagagacaacagttttggcagaagcattgctgtcaatgaaagcaaatcctctgtagaataaatgtcaattctagtaagaaaaaagagctattcctgccatgatggaagagtgcaaacgaaattaatattaagcaggcccctggctgttttccacagagaaagtcatcctatagggatctctgtgttagtctctgctgttggcagatggtcactcagcagtggctacagccaggccagctccagttagtggaaatcgacattgatgagcccatggacagcctccatccctgccaccatgggcgcttttttttatggagcccactgggcattgacaagagtggttgagggaggctgcctgatgtccacagaacaagtcaccctactcacctgattagcaaaatcacttcattttcacagaagacttggtgagtattgacatatggaaaaaattctcttactttctgcccaccggaggaggtctattcacacatctctccccctgacgtatttgtgatcaatattctcattgtgtctctctcaagtccctgaacatccttgagcatctttcaagaccctgagtcacaacctgtgaattaggaacctctgcccatctcttggcaggtgacatgagccaattgcactgcttaaaattctactttaatgagaatgttcctccaacactgctgttcagggattctcagaggccaggtggagtactagcactgtccacaccagtagtggctgcatgtcctgcagaaaactctgtaaccccagcctaagtgcctcctcctaggcagctgatctcagggagcccctcaggacgtcaaggctgtagggtgagaggaagacatggtgcagggctccggtcatgtctatttggccaactcttcatgaaacttacttgggcctcgtgacctagtccctcaagtcacaaatacatccctgccatgtgattgaggagctgctggaaatggccaaccgggactgtggttcagaccaaacctagcatactggcaacttgggtcgcatggtgagctgtgtggccacaatcacacagagcctctgctgaggcccaggagcgttcgcagtctttctcaaatggagctttctgctcattcaaaaaaataagtagagggaggctgggaccccaggaccacttagaccacgcacatgatcttgtctgattattctgaatccttgcatgctcagctatgcattatggtaaccaagccacagtgtctttggcaataaaatgccactacttggcccccacctaacctgggatcccctcaaccacatcttgctacccaaaacaggtttcacctccactgagagaaatttatttttatattgagaagatgaaagattaattatttcaattgtgaaaattttataggacagtaatgtgaaaatattttaaaagacactttacgaagagtgaaagaccttccattaaaccactcaatatatgacactgtaattggcctacccaaaccctaagttcagctccgggttgggaccttctgggaatggacccttcatcctcacgccctcctctcctctcctctcctctcctctcctctcctctcctctcctctcctctcctctcctctcctctcctctcctctcctctcctcttctgtcagccctgtgcctcctatgtgcagagacagctggtctcagtgttggtggccctgggactgacaatcatgagcacatactctggagataaccttgagataaacatgcattaaggaaccagcagaatccaggccagtccatggtgctggtcatctagtataacagcaactgaccctcagggacatctgcccaattcttaggcttcaactcagggaacatggccaccatgaccattaatggagcccaagcccgggaagagactgactattgctgaactgcagataataacagtgggagcagctggcagggactcatagtaacacagagagacagggactagccacagaactgtcccatctcggcctggctctcattctcagctgccctgtgagcagctgaaggtcaggcctcagggtcaggcgtcctctctggtcttaacctggcccctgcagggctggtgattctgagcagcttctccatcctctcagggcctgcatgtgtccagtgagaagtgagtggacagggggaagctggttggagctgcaggaacctctgtcaggtttgtggtgtacatgaaaggtttaggaatccacacaacatcacatggccccagatgtaatcacacatcacacaggggaggaaagagctgtcgcagagggtacagtcctgtggaatttctcttttccttgggtataagcagcttagtggaagctccagaggctgtgtctcctctggtttccagatgagttcagttgacctccgcattctaaaggggtgcctgaggcctgaggaggactggagacccagccccttttggccccagggccctttctgtgctgacatttcacagaaactgaagaggaagaacagacactacctttcatcccacctggggactgtctttggggcacgctgaactcccatggcccccaaagtcccatcaccttccccaggtaggtcagacctgactggatgtccctctagtgccctgatagtgtggattttatctttgggctctgggctgctttctgaggagctcactaagaacccttgatgccaagtccaggacctgcccctctgctccatgtcccaggggctgcaagcatgacgggaaggtcctgctgggtgaggatggtgcccttttccagaagagatgtctgattccagtctctagggccaggtttgttgggctttttttctcacttggaaggtctcagtctctttattaccttctttaaaagtacaattggtttaatcgtgaaatcatgtgcatgcactaaagtttacagactatggtcatcagcacatatgtacactctttctggatgggacaactgtggacacggccatactggggtctctgtctctctcattatcacaagggaggataccaacagctctctcctatgcagaccgtagtcatgtttcccaattgcacaagaatgtctcttacagttgtttaatttccttcccagccaggacgcttaagtttcccatgctgatacttggttgctatttctctctgatccaacatttttcaaacagtattgcttgcaacccaaggcttatgaaacactttaccaaaagttccacaagaaaagctcaagtttctcatgcaccgttggaccaggttcattgcgtgcagtaggaccttgctcaagtgatgagtccatttgatgttttcaccatcaaggtgaagggtattatgacttttgggcactgagttgatagaaggaagacagcagctgatgatggccctgcccaccgatgtgtgtgtgtgggcaggacctatcgatggatttagaagttgagggaactgtttattctgcagatggaatttccagcactgaatctccaccaaccagacactagcactcagcaggtgctctgtaagaagaagcccttcactgccaatcacggccattacacaggtgaaggagaggatgatttttaacagccattgaccctcacagtaaactgaggtcaaaactctggtacacaaagtgactttgagagaacaggctgaggaagcaggttaattagtagcagaaggctttgccgagagcaggaacaaaacagggttggtgaggaactagtgatgccatggtgtggaaggaacaaggcctgtaccaggagcaggaaggggcatgggaaagaccacactgccacatgtgatgagtcagcacatggaaggcacagcaaatgttgcacaaaggtttttgtgtaataacctggcaaacagctgcttctctatcaagattgatgagtcaaaaaatgttactgatgcattgctgtcacatgtgaaggtgtgtgaagaatggtgacattcaaggaaacctgttctctgcagacacctacccaccagtacagcagacaccccagctatgccaagggctttgtcttcctctggggtaagagcctgggaacaacaagttggcccctgaaaggggtgccccatcatgcgctcttcatggctgagttaagtggggagctcccagagaactttccagtaaatggtcaatctgtttgttctgggtgcattgagcatgacccaggatcaatggaagtgacagaagcttaatttccccaaggctgcaaggcgggcactgggaggacggctgaagcagtttagccaccaccccctagtggctccagccccaggtaagcagggacagttgaagggcctgcctgagcccacctgtgtctaattagttccagcatcagcagctgcatcctgtagaccaccaaggagtgtgtgtgcccagcccctcacagatcacctgagcataaacaggaaattctccttcttacacctgactgcaccacacatctgccccttgctcttcatttacaagacgctatcacatcagacacggactgatctgagtcccgggttccctcaggtttctgctgtcctctcagatccccacacacaaaagactcttcaccacagggcgttgagccagctcttcccctaacactgcctcttacaggttactcttctccaatatgatgcgggtttgatttcagtgtttctacatatatacttttgtattttattgggtaagctgagccccttgtacctgatcttgagtcaggcaggggccacacagagaagaggtgttcctcccctgggaccagcagtcctcggatcagggcatcagggacctgaacagcaggttctgaatccacacctagacccaggaagtccctgagcccccagcccacagtgtggagcggccaccagggggaagcagagagttacctggcaaagccacctggcgatggggcgggcctgggtgacagggagacgctgacatgcagcaggagccagtgaccatgatctcacacctggaatgaaagggtctttattttcatagagtattgtccttgtgtacttgacactcatgtagaaattctagaataggattttaccttcagctcttgcagatgctgcctctttctctgccacagctccaggcacttgacttctcacagtgccctctcctcacacacccagttgtgctaaaatggtgtccctgccatgtgcagtgtcctccctgaggtcacaggtgtcccctttatctcccctttgctctgggagcccctgtcctgcagacacagtggcttctcctttcctggctgctcctccactttcattgtccctggtctttccggactctctcctggggaagctgccaaatcatggctcttgatttcctggtgagtcacaaaatagttgctcattaacctttagttgacttaagttcttaatcattgatacattttccccaacaactgacgacaacttagttataataaacattcacttctgggggtcttggagtttgcagccccctctcattctctcatggagcaaacatttccttcgcctcctcatctgtctctgatcctgacagcatcctggagatactgaggcacagcagctatgacctacccaggagcttgcagccaaggcagaaacttccatcacctcatggatcttccagcactctgtgtgcacttgacaaataagaaattccattgtcctctaccactcaggagctgtgccctgcggtgggacctgcacctttccaaggtgtgtgttatcatctgcacagtggagatgaagagggaacctgcattgggttctggaaagtaccatctaaaaatatatttagacctgcaacagaaatctcctctctaacataaaatatttatgatcaggacacactgagaggcctagaccaaaattaagcactgccctcctgagccaggatagaatggaggaggggactggggaccccagataattccacagttaccagcatgactctatgatcacctcctggaccagatcaaagatcatcccatatgaaggacttcatattccttaggaaatacaaagtcacctctgagctctgctgtgaccaagtgagcccaggaatgaggctgagcacagtgtgatgtggagatgtctgcagagaatatggaatcaattgataaaggagatcctgtgggcaaagggtgggagggcaaggccacccctaacctctttgggtcccttggggctgagtccttctggaaaccacaaagctcctccagcagcagcccctgactctgctgattggcatcacgggctgttctctccaacaaggggttaagagagacctgggaggagcctgcccagcctcagacttgagaagcagcattggaggcacttcagccatggcctggcccctcttttccttggtctcctgactcactgcccaggtgctgcccccagggtctcacccacctgcccagccccaggcctccaggttcagcctggccatcagtctgagctcagcagggccctgtgtgtggtgggcaggatgctcgtgaccctgctgcagggggaggggctggttgggctgaaatgcccccactctgtgctcctgtgctcatgggtgccctgagagctcttttattcctggggctcactccagccctggcaagtagcaagatatcctggggttgagcctctcagtttcaaattttttatctcccctttccttcttgcaggctctgtcacctcctgtgagctgacacagccaccctcagtgtcagtagctccaggacagatgactaggatcacctgtggggaaaacagtattggaagtaaaagtgcttaatggtaccagcagaagccaggacaggcccctgtgtgggtcatctatggggatagcaggcggccttcagggatctctgagattctctggctcaaactcagggaacaggaccaccctggccatcaacagggcccaggctggggaccaggctattactgtaagatgtgggacattaggactcctcatcccacagtgacagaggtagatggggaagtgagacacaaaccccttccccatacgtgtcactcttgtcctccagcccaggaagactgtggacaaagccatgagcatgggtttcccaattcacctggatctgagaccccccaggctgccctttccacaggccctccaggcaggctctgcagaggggacatcaagactgaatttagggcagaggtgaccaggatatattgaggtttgggggactcagttgtgatttggggaaatggggccagaatggaaggtcaggccaaggtcaacatccttagttggtctctggatttccatagggggtgaaggccagtccttgggctgaatatcctgagtcagtttccagaactgcccagctcaggctcccatggcatcctgccattctctgaaaagggccctggcatgccaggtgctctgggttctgagggagagttggaatcagatcctcctgcaggaatccagggtcaggagaagcagcctcacctgacacagggaccacagatgcacccccacagggtgagctgcaggatggatgctgctcatctccaatcctcacatcctatgcaaaaaatcattcttttcacccctccttcagtgtatcaaagttgacacttaaaaagccttaagagcccactcttgtcaacagaaaacccattcacatctccatcagccacacaatctccacagaatgattcttcaaaaaacgataacagtagacatgaaaaggtatctaaaatgttacataaataattgaacttagattacatatgaaaatgatactatttttggtatgctaggtaaataaaatatattatttggactcctttactttcttctctttgtatttctaatgtggtgactagacattgggattccaatgaggctcacatcatattgtgattgaacagtgctggtctgcacctcttcaggtaacaggggctgtggagtgacctggtgcaggaagccccatctccaatcataggacatcagtgtgaacccagggagaggcactggtgcaagagaaatgagaacaggagtgtggaccatctgcttgtacaggggactgagccctcactttgagccaaataaactttttttctattttcaattctgaagaagaagactttcctggacttctttccgttttcagatttgtgccccttcaggtttggcctgtctggatcccagccaggggacaccgaggaaatccaggagtctcacactgactctgttgtatttcatctgctggggtcatcccaaactgctgcgtatcgtttcctttcctggtgctcaaatagctgctccatgcacttgtcacggtttcatagctcagtctaggtgggaagacaggatagtgtatgttataatatttaaatggaacctgaatccattcattgtttttgtttttttgtgtttttgtttgtttttgttttgtttcgtttttgagagagagagagagtcttgctctgtcgcccaggctggagtgcaatggtatgatctcggctcactgcaacctctacctcccaggttcaagcgattctcctgcctcagcctcctgggcagctgggattacaggcccccgccaccacatccagctagtttttgtattttagtagagatgaagtttcaccattttggtcaggctggtctcaaactcttgacctcaggtgacccacctgtcttagcctcctaaagtgctgggattataaaggtgagccaccacgcccgacccaatagtttttttaaaatatgaaatgttaaaagagttttgtcataggcattgggaaaggtgaaaatagattaaaaacattttaagaaaaaaaccaaaaatgtacttgtagactgtctgtgtgtcttcagtgttgcagggttcagagaggtcagttttatggttcactaaggaggggctaagatggaggaaaccaagaaagccaaaaacacacatctctgccactcaaaacataaatcaaagtaaaatggaaaaaatctttcaataaatcattcccaataaatatcactctggtgcacatagaaaggcctgttagcaaactttccctttcccctgctggctcatatccccatggatcacctgtgtgcagagtggactctgtggtccccatttctcaggctgagaaccagagactgggaaggacaagtcacctgctcatgagtgggaagggcaggattgggagcagctggcttgggttcaggactgtggccctggtcggtgctctgtgtccctccagagggtccctcccacatgtgccccgtgtggatgtgggtgcactgcctggggtggctgatgtgctccagggattcgatggtgcagatgcttcagcacaaaacgtggaggtggggatgggatgaggctgcagctggggagaccagagaccagcgccacccagcagaggtttccacggggtgggcagccccatttcctgacagtagagacaggctggaggtgggtgccaagcagagggcgctgtggggtatgcccaggcctagagagtcacagagacacaggcactacacagcagaggcactgagggccaggagctcactcaggtgagagacttcagcagatccttctctcctgagcaaatcaggtacaaaaaaaattaagttcctgccatcagcatgcacaaacaagaacattcatctcttcagctgagccctgctgtccagggaagcaaaagtctctgagcccaggcccacgtgagggtggggtgaggagaggagcccaggatgctgattttcatggaggccccgccctcctctgaggcaaaggggataagacagggctggggcagggccagtgctggggtcacaagaggcagcgctctcgggacgtctccaccatggcctgggctctgctgctcctcactctcctcactcaggacacaggtgacgcctccagggaaggggtcttggggacctctgggctgatccttggtctcctgctcctcaggctcaccggggcccagcactgactcactggcatgtgtttctccctctttccagggtcctgggcccagtctgccctgactcagcctgcctccgtgtctgggtctcctggacagtcgatcaccatctcctgcactggaaccagcagtgatgttgggagttataaccttgtctcctggtaccaacagcacccaggcaaagcccccaaactcatgatttatgagggcagtaagcggccctcaggggtttctaatcgcttctctggctccaagtctggcaacacggcctccctgacaatctctgggctccaggctgaggacgaggctgattattactgctgctcatatgcaggtagtagcactttccacagtggtccaagttcatggggaactgagaccaaaacctgcccagggccttcagacttcctccttgctctgaagatgcttcctcacccggtgcaagaggcttgctgcagcgcggccttgagaattcttctctctcagctccttccctttccaccatgaattccaacaggaaacctgccctgtggtttcccatccaggacagggacagcttcctgatgcttgtgtgctgtggtccctgaatgtgcaactcttcccagctcttcaaatgcagggacagtgacaaggagctgcctgattggtgcagtcactgcttttttcagggatgtcttcaccctacatgtatcatcatcccctacactgtgggtagaattttagcaactacattctaatggttatcgccacaactttgatcttagaaataacagtgcagtgaacatccctatgcaggctcctttgagttcctgtgtgaatacgaccataggattcatttctaaaagtgaaattgcgggtcagaaagatgtgtgtttgtgattttcacccaatgttgtcagattcccctccagagggattgtaccaattttcaatgccagctggaagtacttgttcagagtacattgttgaatgtggaaatttttgccaacgtatcagagtgaaaaatggtaccttgttacagttttatttttcagtctcccgttctgcttaaggttgggccttttcacaaatagttcagtactcttcatttttcatgatttggtaaactttataaaaaatatccagataagaagaattttagtctttgtggccagacacggtggctcatgcctgtaatcccagcattttggaagactaagacgggtgaatcgcttgatcccaggagtttgggattagcctgggccacacagtgaaccctcatctcaattaaattaaagaaaataaaaataatttttaaaaaaatcctttgtggtccaaggatcaactttggggatattacctatggacttatatcaccatttacaatgcaaacatttaaaatgataacaactactgtcagctgcagaactaatttgactccatcaaaaaaaaaaaagctaaaagattataattctgcatttccacatgttctggtggtcagagaccacttccttgacaagcagtgagtacggggatctgaagggtagttagcatttaggcaggtattgggtgaagaatagggatatacacaagaaactttcaaagagaaaaacacatggaagttggaacacagaagagaacataatatgtctgagaaataaggaaagtccagactcactggagctgagtgagaacaagaaaaatggcataagccatgtatttctctctggatatctcattaaaatattgtctcctccccaacacaccacccatgtgaattataaaaatgcccgttttaaatttttgtttgcatgtcgtgacagagtcaagcacgtgaatcaagctgagtttgatgagtccagggctgttaagccccagacccaggtggcctcagaaggacttggtggaacgagggcttgttgtcaaaagcagaggaagtgagattttccattgtggctgagaccagtttcttaaattccagtggacacacaaggccccttaaggatcggttaagatgcagatgcagcctcagcagttctggatgtggccccaaattctctgtgtctggcaactcccaggtgaggctgctgctgctggtcctcccaggaccacactttgagtggctgaactcttattcacccacctcactcaagccacgggtgagactcacacaaggagagcatattctagaagcacaggtcacttctcactcctccccttgtgtcttagatccttttctgttactataaagaagtacccaaggctgggtaatttatacagaaaataaaagttttatttggcagacagttccaatggctgcagagttcaaaatgtggcatctgctcttgttgaagacctcaggctgcttcctgtcatggtgaaaggtgaaggggagccagtgtgtgcagatgtcaatgggggagaggaagcaagagagaagacaaagatgccaggctctttttaataaccagctctttcggaaacaggggaattcactcaccccaagtgagggcattaatctattcatgagagatccactcccatcaccctaaaagctcccattagttcccacctccaatactggggatccaatttcaacataagatttggaggtgacaaagatcaaagccatagcaccctgaggtttggccacacacttgctcatctccacatttgtccctcccctcaggactagggtcctgactgctctgacttagtctccctccaccttatgggcacctggcagtcggtcatcatcagctttgctgaatcagcagcaacattgagggtaaaaattgtgtctcctggttccaccagaaataaagtagagccccacacagctgaggtgtggggtcaaaaattaaaactaagagacataagactcattctcaggctccaagtctggccagtgagcttctttgagactccctgggatcccagcagtgacactgatcactattgctgtcccacacatcccaagtgatgaggaagtaagaccaaaaccctcctgagattcctggcttgtgtcctgacactggggctgttgggattcctgtctttccttcaagattgttcaaataagcaccgacaatcacttccatgtgagatatgaggagagaataattccacatgaaccaaatccacgaagcctacactgaagcctgccaagttctctgcagtccagcacgatgaagggagcattttcatgggaacttttgggaatatgaggggagccaggctcagctatgggttccagagacaaagctcctggatgtttccccctggccttggtccatcacctgctacctctcctcactctttccacagatgctgccccaggttaagcccccacaggactctaagcctattcctgaccctgagctcagcccaagtgatgcttcaggagatgggatcctgagaatgagcgccaacgtctctttaacctgaggtgtgaggtcatgagacacctgttggccataagacacctgtcccccacctgctcaggagacagtggagcaggcaacagtgcagagagaaccagcaggagccaggccaggccctgcatccaaagcaggccccaatcccacagattctccagctccagcctggggtacagccccaactttctgtaggctgaaatgggcttctcaggatgggcaggccatgatgggggatggcagtgtgtccacaggacacagccctgctgcctgcctggccctcatgcccactccttccccaccctggttaatctccacccaaaagggcccaggctcagaactcaggacacctggatcagctcctggacttgcccccactgctttctgttcccctgagccacttagtctcttttggcctcagtgttacctgctgtgaagtgaggaggcttatactgaactgaggaagctcttttcttcattcaaaattaaaagacagaaacaataaagtcatgtgaattaaagccttctaaggggatgtcatttaatgggctccaatgggcttcagacatggaacttcttgtctttcctctgcagagattccaagaaagggactcaaaagggcttgctttctgtatgatgggaacagtgatctccagctgagtataagcaggagagtcctagtttcatcagcaagacagacaaggctagggtagaaatcctcctggcacaagctctgagaggtgtggaatgaaataaagataaacatgaaattaatgtgcctatgatggtgatgttagctcacaactaagctgcagaaccagaaacctggtgattgcagtgaatcatagctgctcttactgggtgggaggtgcaccagtttgcttcctaagtgcatagaaagcctgggtccctgtaggatggcatgcacatctctctggactttgaaagtgttgcagaagagcttcagttgactcactctaattagacctgactgaacaaaaccattagaggagggcatttcaaccctgagacacttctatagcaattgcacctgccccaccccactgaactgcgtgtgttacctctctgtgctgggctgggcagggcagattgggtcacactggcacagaatggggctggactctctggtcctcaacttctgaggtgacaggtgctgtggggtcacctggaagaagaaagctcctgggctgagtctcctccaccagttgggggcagcagagctgcagccaggagcagtgaggagagaggctggggctgcccagctggggcgaagaggaaggccagcctggggttcaacaggtgtccaagagtcagtcttcagactgaaaatgaagacagttcatcctatcccctcgggctgcagtgaccacgttctgagggtcagattcatacagtgtcacccaaggacaccgacagaagcccggcacagtgaaggcctcacctgggaaatgcaactagaagaggctgggcccaggtgtcagcttgggcagcttccttaggaaggggattccctgggagaagtcctgaggccgaggtgctctaggaggggcacaatgtgaggtgacagggctcccagggcccaggttcttcacccaggatggcggcctgagcctcctgccactctcagggccttgtccctccctgtccagcagtgtcctggggagctgagccctctatcgtgggcacttccagatacacccgacccctcctgcctctgcctttccttccagctccaggtggactctgactcaggacgcagctcctgtgctcaggggagattcaggtgggtggcgtgaagcattttggggccctggtccctgcatgaggcatcaccagcctccttcaggagatgctgtccagaggaacagggcttctcacctgcctcaggccacagctctcaccacggggctgtcctttgatcagtggcaggatctgcatggctggagggactactgaccacatgctctctggagctcatgtcttgtgtggagaccatgacctggggaccctcagaaagaccaagcagcctaaagttagattttcagtccagtgtgattctctggttcttttcgcaagtttacgtaaaacgttgatgagaaaaagtgaataaataaaggaagagttgaggatggcaattgctggtctactgtggggctgggggataccatggaaagagcagcaccacatgtcaaatgagactagagattgggatgcatccgaaatatgtgtggttgctcaaatgacaaaactcttccaactgcaatgattcataagtgtcctacagacacagtacatcatgtacataacattaccaggatggggccaagtgactcgggggtatcaggagcagggatgaaagaggagaaagatgatgcatctttggtgtacttgctgctgagtcaggcgtcatcagtgatttctcaacagggcccagctcagccccaggccaggctcctggaaggtccatagtcctgctcaatgcagcccaggacaggccacatgacacagaggtttgagacagggaccatgttgtcaatccccaggacggtgactgtgatcacaggccttggaggccaaggctgattttctgactggagaagcagacgaaggaagctggggattcaccccttcattttaagtttctcatgctgcccccagagctggcttgagggatatcccgccatgaggagtcccagagaagtaaatttgcataaacaccaaggatgcactgccccagtgggcctgagaggaaataagagaggcctgggaagcccagctgtgctgtgggctcaggaggcagagctgtgggtgtctcaccatggcatgggccacactcctgctcccactcctcaacctctacacaggtgctgcccccagaccctgccccaggctcagccctcctaagcccctggtcttaccctgaaccctgagctcagcccaggcatagcctcagggcgatactactggaatgggtttgttatcttcaagccccctctcttgtcctctcttgcaggctctgttgcctcctatgagctgacacagctaccctcggtgtcagtgtccccaggacagacagccaggatcacctgctctggagatgtactgggggaaaattatgctgactggtaccagcagaagccaggccaggcccctgagttggtgatatacgaagatagtgagcggtaccctggaatccctgaacgattctctgggtccacctcagggaacacgaccaccctgaccatcagcagggtcctgaccgaagacgaggctgactattactgtttgtctggggatgaggacaatccctcagtgacacaggcagatggggaagtgagacacaaactcctttttcatctgtgttgtgttcttcctccagcaccaggaagactgtggaccaagcaatgagcaggtctggccaagttctactggatctgagacctccaggccatccttttttccagctgtccaggttggctctgcagagggtggagcaggagtggatttaaggctgctataatcagaatttatggtgttttggggcctcatgagtgacttggggaaataagaactggatggaagatgaaagagatgtagagaaccatcacttgaccttagatttccatacgatggtgattgggtcactccttcttcaaaatatcctacatcagtcccgaaaaatacccacctcagctcaacacctgagcttccaggcttccatggcagcctgggattttgaacaggaaaagccaaggaggggacactgtggcatctgcctcaatacccttttctgagctcacccaacctcaactgctgggagcttctaggagctcagagctgtgccctcactgggaagtgctattagctccaaagaaaacttccttcctcatatttaggcccagttttgagagttttggtttgatgactgcctgagccaagaacccaaggccctgtcctaatagaggatgacactgaaaggccttccagatccagacatcccagtatggatgcctgaggcctcagttgcaaccctattgtgggtcagggtctccttctggtgggcgatgcctccctcactccttccagatcctctgtgcatgcacatctttttctcagagtctacttccaggaaacccaaactaagatggctggctatcaccaaaataaactaccatagacctgaggtggaaacaccagcgaatttcccaaatttccattgtgaacatccaaatgcccatttatatctgagtgttccttgtattcttataaaatgaaaatggagcctgacataccaggtttttggagtcctgaaggagatgtggagacagatccttctgcaaggaatccaccgaaaggggagcagcctcaccccatgcaggggctggagatgctcccacaggggcagctgtagcatggacgctaccaacctccaccctgcacatcctgcacaaacaatcactctttcacccctccttcagcttatcaaagttgacacttacgaagccagcacagctcacccttgtcaatcagactccttcaaacctccatcaaccacacaatctcaacataaagaatctccccaacataataataggaacagtagctatgaaaatggctataaaatatctcataaataattttagattgtgttcatgtgtaaatattatttttcacactttgggttaaataaaatatattactgaaactagtttacctttttattttttatgtctagtatggtgactagacagtaggattcacatgagactcacatcatgtgattgtacaatgctggtcttgtcttaccccttgaggtggcaggtgctttggagtaacctgcttcagcaagccccatctccacccgtaggacatatgtgtgaagccatggagaggcactggtggaagagaaatgagaacacagatgtggaccagctgtttatgcaggtgactgagtcctggagccctgatcctgttctaacctagatgtgtcacatccatctcaccagagaccgctgctggcctgccttagctcataactggggggatctggcagttcatgaaacatggtcgcttgatgtccagtgttatcctgtctctctcagggcccaataagacaaaaggagctgcttttagaaagggaagtaacactctactgcacatgacatggccttattccaaaaccccatgagtctacgttgggattctccagtggggtttgccatgtacaggaggtttcagttcccacagtagagtcagctggattctctggacccaacagcaggacactcacaaccctgcctgcacctgctgcagagcctcaatgctctgggcctggaaaacaatgggtgatatttgtggctcctgatatatgggttggagccacatccccaagtgtaaaatatgctactcctagacctttatagaccttgtgtctgtttcttcctggagggaattgaagggtataataacatgttctttaatttgtaggagactctcagctgctccagacaactgaagtcccaatttctgctaatacagaagagggaacagtttatttcccactcttaaaagtgcatggatctcacaaaagcttccagtaggccatgcccatcatgtatatgtgattcaactatgatatcaagatggtctgaaccctcatgatgatatcatgatagagataagagagctaatgatgctgggcagagaaagtgtgaatgtatactgtcgtccattccacctgaatgcacactgattctgatcctattctctgagggaaatagacaagacctcagtatctgcttcagtgaggtaactgtgcacctgcagccatagcattctgttcccagagatccccatctggcacagatattgctaatgccactattgcccatctgggtctgtacaaatccaaattcatcttccaggatcattcaactattgtagagatcagtccagtaaactgaaaacaaaaccccagaagtaatcacacgtactgcgggagaggagagagctgtctcagagggcacagtcttgttgaaattcctctgctccttgggaagaaacagcccagaaaaggccccaggggctgcgtctcatctgggttcctggatgaggcacaccccctactgcactgagattccacagaagctgggggtgaagtgcaaataccgtctttggttcatccttgggattttctttttatcacacactcgtcattttgtccacaatgtccaaagtttctaaagtgctgtctaatagatagaggttctttgtgcgctgaactaaaagctcttgggttggacaatggtgatgtttgcacaacatttttactgtacttactgccgcttaattacacacttaaaaatgattaaaaggatgaaacattttgttatgtttattttaccataataaaaatattgcatgctcaggaagcaaagtaattttgcaattatacaactgttaaaaatggaagaattatgtactgagcaccattttctctgttgtttatgctacaattcaactttctctctctctcactctttctctaattagcaatgatcttctgtctggtccaaggtcacacatttccagtcttccagaaatgtctgttgaatctgttaatttgttgccaggaagaatactcaaacttctcatgctcatatttgagtgttagctgtctccagccagcatttctaagccagaccctttgtcaaggcttttgaataattttgtgaaaagtacccccaaagatgacagtgttcactgttggcagcaggactgtttccatgcagtagggctatgctgggtgtgcagtggagctgtgcacactgtgctcacggggcagattctgtgctgctgactctgatccctgtgcttgggaggaccgtgtccactgctgagtctacatctgaatttgattctcaagaaaaaggtcattcatagctattggacactgagtcacatagagggacagaaggtggctgaggacaccttatctctgatgagcataaggggattagatctgctggtggaacaggaagctgaagaaacctgtggctctaaacatggaatttccagccctgagtctctgctgtccgtgcccctctcatctgtatgttcctgggagatgtggaccacgggggttagaggtgaaggggattgggaagctttcatgttctctctcaccatctcccttgcttatctaacacactcttacacacctactttattggagcttctgctctacaaacatggctgagctctaaattagagacttttgaaagtgcagacggatgcaggaactcgtccatctggagactttccaccacttgaagcagtgaacacgtctgtgcaaggctcagaatttcaagtgacaggatgttgggatttcaaagaaaactaaatctttggatgaaccacgacagaagagggaaggttcacacatttccctgctgcttgggcctcagtgaggactgactcagccagtctcaggctcctggagaccgcctgggagatctgcactaggaaaccattttcagcacagcctggggctggtaaggggcccttactctgttattctgctgcctgataattttgcatccagagaagaattaggacctgtgagtccaggaatttcaaagcccatagacaaggtcccctcattctgccgtgacagcctcagctctgctttcccaaaaaaagagcatcttcccagcatgaagaaccaggagcaaagagggagcttctcccaggggtgagcagggcagaagccaccttggtcagtgggaaggaaacatgctcagctcacatctgacccagaatgactcagtcacacctgtgcagggtcacctgtgtgtgagcatcatctatttgctccatgagaaaataccttgtgtggctcttgggtaaaatcataccataggtgacatttctctgcctattgcttcagccgatgcttttcgtgattccctttaggacactggcataaggtaagcatgtcaggtgtgggacgtattgaacaggaaaagcagaggcttctcatatcaatgctcgtggcttgtatttgggcccatacctcatggaaatgggaaaaacagaaaagaaaatgatactctgctcaaaaaagcactgagaaatgctatagtattaatatatcgacaactcatttattgagctaatgaaatattaacatagatagatcatttttatagggggatccctaatccttaaacattatattaaaaatttgtcagcttaaaggatcattaaaaggcctatgtttgattgaaacctggagtactgtactttgagtcttctaatcagccaatgagtgcagggagctggctgccctcccaggtcctgactggctccatgtccaggtagagcagcgctccccacaggcagctggaggaactgacgaggggaagctgttggcatcagggcctcaaaaatttgactcaggattttcccacgtcccctccccaagtccaggcgggttccaggacactcagaagagctcatcattatgggtctaggacttccctggtcctgctcttctttcttccttccccagtggccttaagattgtcactccctgtcacaggcccttcctttccttgtcaagtgcactccctgaattctctgctcctgggtcaggaaagctctggaacttcagggaaagcagtgctgggtgacccaatggggacccagaaagctggcccagggccagatacacaggcagcagggtgggtccctacagtgctgcctggtgggcatcaggtagaggggagtgaccaggaccaactcccctgagtgtcttcagggccaggtgaactagggagggtctgggacctggtgtggacccatgcactgacccaggaataggacaggaaactcctcagagcaaggactgtgttttcctcatgctgagctcctgaaaagcagtcttgccaggatagagtgggccagggtggatatatgttgggtgaatgagcttctgtctctgttttattgcaggagtcactacgaaggtacgctggccctgtatttgtatccagaaccagtcaaagccacctgtgagtcctgcatccctcagtaccaagccccagtcccccttcaggaccacccaccacacagagagacagacgtgcagggagcctgaggaagaacctgaaacctcctctactacatggagtgtttgtatttccatcaggaatcttgagcaccttgtgccgggtcttgaggcaggaaggggccacacagagaagaggagtttcttccctgaggtcagcagtccatgaacgaagggatcagggacttgagcagcagattctgaagcaacacctggacccaggaggcccctgagcctccagcagcccgcgtagagtggccaccagggggcagcagagagtaacctggcagaagcacctggagatggggtgggcctgggcatcagggagatgcccacatgcagggagggtcggtgaccatgacctgagatctggagggaaagaggttcttcttttcttagagtatttgtccttgacaccgatgtttacattcttctggcttcctggttctcagatctgactcttggagatgatccttatttttctgacacacattcaggcactttgcctcttcccatcgacctggcccccatctcactgtcacacatgccatcccatcctgtagtcagacgtgtcccacctccctgcctttgctctgggagcccctgtcctgcagacacagccacttctccttccctggccacccctcaacgtccactgtccccggtctttcctgactctgttctggggaacctgccaattcgtagttcttgatttccttatgagacacacaatacttactcattaatcttttgttgacttaagtttttatccattgttacattttcccagcaacagaagacaacttagttataataaacacttacttcctgggtcttggagtttgcagccccctctcattttctcatgaagcaaacatttccttcacctcctgatctgtccctggtcctgacagcaccctggtgatactgaggcacagcacccatgacctgacactagaactcgcagccaaggtagaaacttaccgcatcccatggatcttccaaaattctatgtgcccttggcaaccaagaattgcattctcctctagcacagaggagctgtgccctggaatggggcctgtacctgtccaaggcttgtgccgtcccctgtgggagatgagaagcgtccctgcattgggctcttggggacccgtcttggacatgagtgagaatgaagagggtccctgcattgggctctggcatgtgactttaaatggatttaggcctgtaccagacatctcatgtctgacataaaatatttacaatcaggacattactagagaagcagaaaaaagctaaccacctccctcctgagccaggatggaatgaaggaggggactgtggaccccagataattcccctgtcaccactgtgactctaacaacctcttaaatcacggccaacatctatcccataggaaggtctttatatcccctagaaaatacagaggaagtcagctctgagcttttccacgaccaacccagccaaggagcaaggctgggcacaacctgggtaaagatgtgagcccagaccatgggaccagtgggtgaaggaaaatcgcatgggctgagggggtgggtaagcaggggccagccctcctctctctgtttcctttggggctgagtccttctctggaaaccacagatctcctccagcagcagcctctgactctgctgatttgcatcatgggccgctctctccagcaaggggataagagaggcctgggaggaacctgctcagtctgggcctaaggaagcagcactggtggtgcctcagccatggcctggaccgttctcctcctcggcctcctctctcactgcacaggtgatccccccagggtctcaccaacctgcccagcccaagggttctgggtccagcgtgtccttgattctgagctcaggagggcccttcctgtggtgggcaggatgctcatgaccctgctgcagggtgggaggctggtggggctgaactccccccaaactgtgctcaaaggcttgtgagagcctgagggactgcacctgccaggagagagtagtgagttttcagttcaaagtctccatacaacaggaaagtcatgggccactggggctggggctgattgcaggggataccctgagggttcacagactctctggagcttgtctgggacagcagggcaagggatttcataagaagcatctttcacctgcaagccaacctctctcttatttatttatttatttatttatttatttatttatttatttttatctttgcaggctctgtgacctcctatgtgctgactcagccaccctcggtgtcagtggccccaggacagacggccaggattacctgtgggggaaacaacattggaagtaaaagtgtgcactggtaccagcagaagccaggccaggcccctgtgctggtcgtctatgatgatagcgaccggccctcagggatccctgagcgattctctggctccaactctgggaacacggccaccctgaccatcagcagggtcgaagccggggatgaggccgactattactgtcaggtgtgggatagtagtagtgatcatcccacggtgacacaggcagatgaggaagtgagacaaaaacaccctcccagcctcggtcaccctcttgctccagccccgggaagcctgttgataaagccatgagtgaatctggcccagttcacctggatctgagcctttcaggttgcccttccctccagccccctccaggagtctctacagaagatacatcaggcataaatatggcctggaagggccagaatcatctggtgacttggggctgttgtgtgagttagagaatgaaggcttgggtggaaagacagacagaggcaacctctgtccactgtcctacccctggatggtcatatggtggggacagggcaagtccttagaccaactgtctggatcaggccccagaactactgcccagttctgctgaggtcctggcccccaggctgtgtggcagcctgtgattcccaacagagcaaaccagaggaatggacactgtgaagtctgcccagatcccctcctcaatgtgacccacctggcactgctgagaagcccagcagctcagagctgtgccctcactgggaagtgctgttggttgcagaaagcttcctcaagtttgtgtcccttttcagaggggttcggtttaatcaaccaagatctcaaatccttgcctcaatttaagatgccactgaatgaagggcctcccagctccagagctccctgtgtggatacctgaggcctcaatgtcaactccatcacgagtcagggtctccttctgccccgtgttgcctcccccactcccttctgaatcttctgtgcatggacatctctattgcagagttagcttccagagaaccccatctaagatggccagctgtccccaacatgggtcatcagggacctgagtaggccactataaactgaaaactctggtttctgtccaaatttgcagagtaaatgttgaaatgcccaatctgatggttccttgaatttttatggaatgaaaagggagcctgacatgccaggtgctctgggttgagggattgttggagtcagatctccctgcaggaaagcccggggcagggggagcagcctcacccctcacaggaaccacagatacacccacaaggtgagctgcaggatggatgctgcccacctccaccctccacatcctctgtaaatgttgctcctttctacaactccaaccagatatgtagatgtggcgaactacgtaaaatacggatcattcatcacatcaaaacccactgcaggacaccctggtcaacaaagaacccaatcacatccccatcaactacatagtttccaaattttccatctccagaaaaataacaataacaatatacatgaaaatcgatgtaatttatctcatacataatttcatgttgataacgtgaaaatgatagtattttgctctactgaaataaataaaatatatatatatatctgaatttatttgtcttatcttttcatatttaatgtggtgactagacactagggggtcacaggaggatcgtgtcataccactatgggacagagctcctcacaactctttcaggtgacaggtactgttgagtaacctgctgcaagcatccccatctccaccagaccatataagtgtgaacccaggaagaggcactggaacaatagagagaaaaacctgcttgtgcagaagacggtgcccttgagccctgctcctgctccatcctacgggtgccacattcatctcatggtgtaatatttcgtgccctgcctgagcttatgaccgaggggatatggcaggtctgactgtgtggttactggtgtctcatgaggttctggatgtaacaaagccctcgaatatagaagaggttgttttcaaaaggaaataattatctactgcacatgacatagacttgttgctaaatcccatgcgtctacactaggattctcctctgaagccttgccttaagcacaaggtttcagttcctatgtccagttcctctattatggtagagtctgctagtttctctggcccaatagcaggacactcactcccccacctgcacctgctgcagagcctttctactcttggccccaaaacactgggtgacacagttctcagacccatgatttatagtgtcagtattcaggcctcaggggtccctgatggcttctctggctccaagtctggaaacacagcctccatgaccatctctgggttccaggctgaggatgaggctgattattactgcaactcacataggagaggtggcactttccaccgtggtccaagttcatggggaattgagacccaaacctgccctgggctctcagcctctctcttgttctgaagatgcttcctcaccctgtgcaaggggcttcttgcagcactgccttgagaatttcccctctcccagctcctctcctttctcaccaggaagtccaaaaggaaacctgctctgtgatttctcatccaggacagtgacagcttcctgatgcttgtgtgctgtggtccctgaatgtgcaactcttcctagctcttcaaatgcaggcacatagtgagaaaagctgcctgactggtgcattcactgctgtttttaaggatgtcctcacccaaaatgcatcctcctcccaaattgtgaagaacaatctggacagaggtcattacagggagtttcaagaaactgcatcttattcaattgtgtccaccatggtctggtaaagatggccctcctggatggactattcctctgcatgtctgtcctgaagcagtgaccactgtgagaagatctgaacatgtttgtgaggtattaaggacgagaggaaactgttgtttttattattcttttgtttttgtttttgaaacaaacttttgctttgtcgccaggctggagtgcagtggcagaatcttggcttactgaaatctcagcctcccaggctctaccaatgctccctgcctcagcctcccgaagagctgggataacaggtgaccaccaccatgcctggctgatttttgtatatttagtagagacgggatttcaccatgttggccaggctggtcttgaactcctgatctcaggtgatgcacccacctcggcctctcaaagggatgggaatacacacaggagccactgcatctggcagtgttttttttatttttgctcctcctctttgcctcaatacctcaggttgctgagctggggagattttgcgtgacaggctcagtgctccctcaaaatcctcccgtctcaattcgctggggccctgtcctggaaactccccaaaagtggatggtgtccctataggttgggagtttccaaaatggccccacagggaagagttaacgtgagtccattccttcttcctcattgacatccagcatttgtaatttccatgggtgtcaatacttttgtagctgaaatctttcttaatctactaaaggtgagaatgaatttaataaatattcagacattagttgcatccaatatttaaattttatgagtcaattggtagacatagccattattatatataatttaggcttcataaactttgattaaataggttttattaaaaacaaagtaaccattttattatgtgtttagactatatcaacatgttgtgtacctgaaatatccacaagaaaatatatttcaaaaaccaaattgtatttattgtctattgttgcataaaaattgctccctaatatttagcatggtaagagaacacgtgtttgtgatcttgtcacttcggtgcatctggaattgagagcagcttagttttgtggttctggttctgggttggtcatgaagttgcagccaagctgtcaggccaggctgcattcagaggccagagcaggtggccaggcccagcctgaggggcttccactgtccctaacctgtttgtctgatgtggaaaatctcagaggaaaaggagagagtgaagtgtaaggcacctgtcccagtcccccttgtcaaaggccatcccatacctgcaccatttcttattctttcctggggcgtcataggcatagagcactgcccattcattctaacgctgtagagtattctgtagtaggattttagccatgcagcctctaatggttatcaccatgattttgatcttacaaatcacactgcagcaagcatccctgtgcagactcctttgagttcatgtgtgcatatcaccataggataaatttccagaagtggaattgctgggtcaaaaggatgtgcatttttaacttttatccattgttttcatattcccctccagttctaccagtttacaataccagccctaaatattgattggaattcattggtgaaagtgcaagtttgtgccaacctatcagatatacaaagttatcttgttacacatttatttttgatttctcctattttgcttgaggttgagcatttactcaaatatttcagtgctcattatgttttaggatttggtaaaccgtttcttcaatgcctcggtaagaggtattttagtctttgccatgcacaagacaacgttgggataatatgtatgttctgatacaccatctacaacgtaatcattaaaacatataaaaaccactatcagttctggggccattaaaaaaattggtggcaggccagggatgtcccacaggatgtggtttaacggtctctggtttctagggttatttgaagtttgaacattgcacccgcatatgttctatgtggagatctctttgtgagggacactgtaattcacctcctctaggggcctgaggtctttctttggataagaacctacctgtaccatgtgtttgattggatcttgtgtctgctcaagacagccctgtgtcacaagctcatgactttcatcttcatccatttgctctgttttgtgagagcttcagtatatcaggaatagagattcctccgaggtgaaaaattagaggcagagggaggggcaaatgggcaaggaagcttgcaccaagtcgggagtgatccagtgtaggctgagagaaaaaaggtcttaaaatcagccttgtagctgaaaccaaaaacacacaagatggttggtgttctgagcatcattaacaaatgataaatgaagttgaacttttaaatgtattgcaaatttttataaagcaagtagatcgttaaactcagaatgcaacaatggaataaagaagagagtttgagatgtttttaaaatttatttatttatttatttatttttgagatggagtctcactctgttgccaggctggagtgcagtggcacaatcgcggctcactgcaacatccacctcccgggttcaagaaattctcctgcctcagcctcccaagtagctgggattacaagctctcgccatcatgccaggctaatttttgtattttttgtagagacatggtttcacaatgttgaccaggatggtgtcaatctcctgacctcatgatccacccgtctcggcctcccaaagtgctgggattacaggcatgaactaccgtgcctggctgagtttgagattttaactgtaagtcctccaactaagttgccatgacaagaacagggatgatgagagtggaaatatgttatcctgcaaattatcgttttatgtaaaagaatattttccctcttttaggtaaaggaagcatcttctggagcaccttctctctgactatcaaagcaccattaagccacaaataaactgtaacatgaagtaggaaacaactgcccttttatataaccattgagaggtggctttatatgcataccaaaatgttgatgctcaatgctaaaattggatttagtaatttaatatgcctacaagaaattaattttctttggattatattatttctgtgtacgatttatcttagttaacttggaaatattctgctctaaaaacaactcttgttttttgggttatattttctgtatcaactatagctcttttccaaatgctgtcagagatagcccatggctactgatcacaaaattcaattttatggcatttaaattattctatactctaaattattttaaaagtgcacagatgtgaatttttcacatctgactcaaaaatgttgctgatgttgactcacttttttatttcaatcttattgaagtaggagtttacttttctggaacctggatgataacaggagactggagaggaaaccccccaaattgttttcctttaaaccctcaggatgaatcatcctggataatcacccacacttgatttgggtgatatctaaatgagagttgggtcttagagtaggtgctgagttagtttaggacttgcgctgttggaatgagttgaatgtttttacaagtgagaaagacatgagttttttggagtccagagggtggggggttattggctgaattaagtcccccaaaatgtatgcattgaagctgtaacacacaatatgtgactgaaattgtgcatagggtctttaaagaggtgactaagtgaaaatgaaaaaattagggtggattcttctcaaattggactgatgtcctcctaggaagaagaaatttgcacacacagaaatgaggcaccagaggtgagcgtgcagagaaaagaccaggtgaggattcagcaaggaggtagcaacctgcaagccaaggagagagtcctcaggggaaaccaaacccactaccacctttatcttgggttttccagcttcagaactgtgagaaaatatgtttctgccatttcggtcactaattctttcctatcttcttgtgggagctctagcaaaaacaagagggaccccaaagaccttggatgagggagaaggaggagatggagcagggtgcaggaggcggtgcaggaaggggctggaaggtcgggctctgaggtgcatctcctgggtggaatcttgactccactccctattgtctggaggacttgggaaaaacatttaacctcctaatattcactcactaataaagatgggcttgaagcacaaggctccccatcatcctattctatattacaaaagtcttcttgaggtaacacttgtaaaactctcgctaatgcatctggcatgtattatggactcataagtagcccttctgagtgatctagtgatgtgcagaaaatggcattcatgctgtgtgcaccagggggcactgtgaggtttagtctgaggcccctaatgagtccaagcccctagtaatgctcaagggcgaagagcctgactgttgcttcctatgaggccccttctagtgggtaaatctgaaaatgcacttggcccttcttctgatcttgagaaattactcagagaaggccatcaggctcagggctcagacaagaaccaggacaaatgttttagggaatggagaacagatttgcatccactgctcaccagagccacctaacgacgacacaagaataaaggaagtagatttgcatgaagagacttcccttcctatgataagagaggcctggaggttcctccttagctgtgggctcagaagcagagttctggggtgtctccaccatggcctggacccctctctggctcactctcctcactctttgcataggtgctgcctcccagggctcaaccccatattatcatgctagctgtgccaacctggccctgagcttcggctcaacacagggagtagtgtagggtgtgggactctaggcgtgaaacccttatcctcacctcttctgtcctcttttgcaggttctgtggtttcttctgagctgactcaggaccctgctgtgtctgtggccttgggacagacagtcaggatcacatgccaaggagacagcctcagaagctattatgcaagctggtaccagcagaagccaggacaggcccctgtacttgtcatctatggtaaaaacaaccggccctcagggatcccagaccgattctctggctccagctcaggaaacacagcttccttgaccatcactggggctcaggcggaagatgaggctgactattactgtaactcccgggacagcagtggtaaccatctcacattgacacagacagatggggaagtgagacagaaaccccttcactatctgtgtcatcctctctctccagccccagcaggactgtgaacaaagccataaacagggctggcccagttcacctgcatctgagacctccaggctgcctttccctccattcctccaggtaggctctgcagaaggtgggtcaggatgatgtgaggcttgaaggaccaggctgttctgctgttgtttagactgagtgtgccttgcctcaagatgacctgaatggaaggaccacaagaaggagatgggcagctgttgagtggtcatgatccctggagttcctcttgtgtggtgactggatctaacacaatgcctgtactttgtggcccaaatgccctggattattggtctgaactccccatgtttaactgagaccctcaagccccagctccatgcatcctgatgttctgaacaggaaagtcttttctagtgagcactgtggcatcccttggcatcccagcttcacacagcaattccccaccaaaaaatgcctttgagtgcaaagaacggcttcatgcaaagatgtgcctccttcagaatgtagttcaggagcaataactacctgatgccttaatcccaaagccatattttaatttagaatgaccttgaaatgccttctagctgagcagtcagttgtaacacattcccagtcacgcctcccacacttctttcctgacagtatgtcatgaaaccctactgcatggaatcctgcctcttagagtaggattccagggatctcaaaaattgtttagaaatgaacaaaaacagtctagttggaagagtatcaaagaggaggcagttgcacatgcagagaactctgaggtctgcaaatatacatgaactgatgagcacttgtgtgtaaagaaacacctccgaaagagaaaagaaccacgcaaagactcttgagggaacacctcacagagctcactcccacacacacccacccacgcactcacagacactcacacactacagtcacagaggaaaggcctgacttacagggcatgaggttgactcatcagaagagctttgcctcagtactggggaaaaagtcaccctagacaaaatgctgctcaggtctcaactatgaaagtgtaaaagcaaacagaaaactcaaactgtttttctgaacagtaaagtaactttactgaattcaacaataaaagacagaaatagagaatgaactgcaaaagaattctcaacccagcaggaaaaatgcacaatgccttcatcctgtcaatatttcctgcaaggtaaccagaaaatatatgctatatcaaacagagaagtgaatcaatcccaaatggcaataaaattgcacacatgatagaccttgtaggcaaggatatgaaagaaattcttataactctattctattctacttgttcttgaggatataagattgaaaaatcatattaagtggatacataaaacatataaagacagacgcaagttatactcttataaatgatccataatatgtctgcaataaaaaatacactgaatgagactgattgcagattggattctgtgaaagaatagatgagtgaacttgaagatatggcaatggcagctattcaagacgaagcacaaaagcgtaaacagagtatcagtgagttttaggacatcttcaactgcctaaattggtataatgaaagtcattaaaggaggtaagattggacagggaagagaaaaggcagaaaaacaatttaaaggaacaatgaccaaaatttcccaaattttgtgaaaactagaaacctcctattccaaaaagtttaacatgtcccaaagacacacacacacacacacacacacacagagagagagagagagagatagagagagagagagaaagagagaaagggagagagagagatacaggtgaacaacaaaatgacaagaacaaatttggtttttaaaaatttttttaattttagtggcttcatagtaggcatatatttttattgggtacacgagatgtttcaaaacaggcatgcaatgtgaaatagccacattatggaaaattcggtattcattcactcaagcacttatcctttgtagtataaactattcaattacactcttttagctttataaaatgtacagttaagttgttattgactatagtcatcctgttgtgctgtcaaatagtaggccttattgattatttctaactagttttttcttacccagtaaccatccccaggtaatagttgatttcttattagaagtaatgcaagcctaaatcagtggagttacatttagaaaatattaaatgaagaaacttactacccaaagcaatctacaaactcaatgcaattcctatcaaaataccaatgatattattcacagaaataaaaaatcctctaaaattggtataaaaccctaaaagacgctgaatagccaaagcaatactgagcaaaaagaacacagctgaagatatcacactactagaattaaaatatgctacaaactatagtaaccaaaacaggaagttattggcatgcaatcagacactgagaccaatataacaaaatagaaaacccgtaaataaatccatatatctatatatagctgactttcaacaaagatgtcaagaatgtacactgagaaaatggcacaattttcaataagtggtgctgagaaaactggatacccatctacagaacaatgaaactagacacttatcctctccacaaaaaaatatcaactaaaaatggattaaaggcccaaatataacaccccaaactataaaactactagaagggaacttaacataggggaagaacaaattctttaggacattgttctagataaaaaattatatggccaagacttcaaaagcacaggcaacaacaaataatagagatatgggacatcattaaactacaaagttcctgaaaagcaaaggaaacaatcaacagagtaaagacaacatgtagaatgagagaaaatatttgcaaactgttcacttgacaagggcctaacattcagtgtatgaaaattttaaaaaaactgaaataactcattagcataaaaaaactaataatatcattaaaaatgggccaagaatttgaagagacttttctcaatagaagatatacaaatggccaacaggcatacgagaaaaatgttgaacatcactaattagtgagggaatgagaatcaaaaccccagtgagatacaatctcaccctagctggaatggctatgatcaaaaagacaaaaaatgcaaagctggtgaaggtaggtgacttcacatttctctagtccgattctctgggaacaatgagagtgctctgtctttgctctccctctagtaactatttttcacacgcaaaaatatggaccctagtgggaaataatgcctaagaccaccaacaccttaatcatttgttcatcacactagaaatgaaactgttttccaaataatattaacatctatctgtgtctatcgccattgtgtcaatgtctgtgtgatcctataacatttagaaggcctagaagaatgcccttgctttttgcaatatgaaaatggccgatatcatagatgatatagatatagatagatagggggttgtattttgaaatgtatttctctaaaggacttctttcacttcaaatttgaaattattcttgttttaaatgtcacaaatgataaaccttatagaatgataacacaattgtatgtgttataaagtcacagggtctatcaaatgatgaaccaatcattcggtgttgaggttagtagtattttttttatttcgattctcactaaatgagaacacgttttgtattgaggggccatgccctaaccataccacatcgtggggttgctcagagactgtgaggttctgcccacactaagccagaaggagaattttattcctaagccaggatgagaattttattcctcacactgctctctgcacttgtttgtatcccataatatcccccaaaagtgagcatgagaagttcattttttaagctgcttgttcattctcttacatttaatacatgtaccaaaaattgtcttcatttttaaaataaaatgttatgctatcttgtaatctataaccctatagaataatcttgatccatacacttttgctatcacaagcagaacaagatccacttcctctctctgggataaatcccatgaccgctgctctttgagcattatttttcttaagttattttttaaacagaaatttatctgacttaccttaaccaaatgtcttttcaaagtaaccgcatttcttttaagtgaaaaattaaatagttaccttctgttatcaagaattatctgaatacaaaatatttattgtttcaactttagaaggaatgaaaaacatctacaggttactaatctaaaaatgcaggctctgggtttctatggtgttaacatgtcttccaaattttaagtaacaggtatttaaataacatgaactttgttttcaaacttagaaaatgtttcaaccttttggctgggcatggtggctcaagtctataatcccagcaatttggaaggacgagctgcgagttttgtctgatcccaggagctcaagaccagcctgggcaacatgatgaaactccatctctaccaaaagttataaaactttgccaggcatggtggcactgcctgtagtcccatctactcaagagactgagatgggaggattgctggagccagagaagttgaggctgcagaaggtaaactgtagaggctaaaacatgataaatatttaattcatcacttaaaagaaatgttggttacattgaaaagaaatttgattaatgtaattagatatatttctgtttaaaaaataattgaagtaagccctgttagcaccactgcattccagcctgggcaacagagcaaaacctgttaaagaaagaaagaaagaaagagaaggaaggatgaggaaggaaggaaggaaggaaggaaggaaggaaggaaggaaggaaggaacgaaggggaaagaaaaaaaggaagaagatatttcaagctttacagtaccagagccactctgtaatcaataagcaacaggaccaaaacagaaagagattctgtagaacagtctaaccagcgatacaattatacatttctgttcagatatcaaaaccattttcaatagtaaatatatggaatgaactccccacagagatcaagtaggatgtatgatgtgtgaatgaaattatgagttgagagtaggaaatttataaatttaatcaaacaaattaaagcattatgaggaagttgtactgctaatgtattacttggcaagctgttcagtggaacaccaagatattcttaaggaagttgcaaatatcttttaaaatgttatcattgaagtggatttttaaaaaatgaggacatgaatacctttacaaagtattcagggataaagagagaaaaataaatttagattgtgcatacatatataaaatttattttaaaagataagcttgtcttttttatcccttaaataaaaggagcagatatttaaattccttgtcttttattttaaaatttagaaaatgcttacagcttcccacactgaaatttatactaagacagataatctaatcaagggataacaaaatcaaaacagaattctcttgatgaatctattttcttgatttttaagtctcagtgtgtactctatagtaaaactatttataattgattctgctgtttgaaaatatttactgatcgtttatcttgcaccaagtgatctccagctctgaagataggtcagtgggaaaacatacaaagttgcccagcttcgttaaacttaaattctaatgaggaaaaaagaagtaattaatcagggactttaaaacaggagtgttgtgatatggcttggaattctaactgcttcctgtgcttgctgtgtggagactggattgaaaaatagggcgatagaagcttaaattcatatagaatatggctagcctgtattttgagggcccctgaaataagaatgtatagtagttctcattatttcctcaagaaatctgtgcagtagagctttggccttgggagggaagtactatagtcaccaagtggtgagggtgggaaggtgaatttgcaaataccacttggaatgagttcactttaaaggtaaagctggcaggattttcatacatgtcagatctgaaaaaatgtgtgtgcgtgtgtgtgtgtgtgttatagagagagagagagagagagagtgaaaaccagacagataccgagagagaacgacagatctgcagtgacagagagaattaaaagcggacaccacgaatattgagctcagaaactataaaatgggaggtgccattaaacagaatggggaagagcaagtttgaggagtatcagtggctccatgtggacttattgattttgacattcctaacagatgtccaaatggagaagtcagacagtgttgtgcgtagtctagtgttaaggtatcaaagaaaatatcaggaaatgagtgacacaaaaattagtaagaaagcaaagataagaaacattagtcaaagtcctgagtccagtggttatctaacacccaaaaagtagtaggccgggtgccgtggctcatgcctggaatcccagcactttggaaggccaaggcgggcagatctcctgaggtcgggagttcaaggccagcctgaccaatatggagaaaccctatctctactaaaaatacaaaattagccgggtgtggtggctcatgcctgtaataccagctactcaggaggctgaggcaggagaatcgcttgaagcagggaggtggagggtgtggtgagccgagattgcatcattgaactccagcctgggaaacaagagcaaaacttcatctcagaaagaaaaaaaagtgataaagacaagaagaaaccagcaaaaaagtactaggggtaattatcaaaaatgtcaaagggaaagtaggttaagtgttctggaattctctcaaagaaagttttgaaaaaaggagggaggaagagatcaactgctttcaatgctgctgatacataaattaagacaaaggctgaggaattatgcttcaattcatcatttaacgatatggatattgtttgtgctttgataagagcaattttcttggagtgagtaggtgagaaaccatattggagtggtttctcaaaggaatgcctgatctctggattcttaaggaaactttttattgaacagtggaggcacaaattggatttgttttaattccggggtcgggacacactctaaacatgtgcctctgcatgcctcgcttattacagctaggtatcctagtatctttcagtaacagaataatcacctgcaaaacccacacccatttaatagacacgctttacaaagactgatactagaagttgttggagaggatgtggttccacgtaatatcttatgagtcactgatgggcaagtaagctggtaaaatgtctttggaaaactcactatacctgctatactaaaacattcagataccaaacaccagaaattccatattgtaatatatttctatgagaaaaaaacaagagccctgtattaaaatatagattattattaaaaataatcacactgggtttcctgatttttttattagcaagtcagtctctgcctgattcaatagtacaacctctatctaatatatatatatagtgtttttaatcaaccactaagaaaaagtattatattttatatcaattctacattcagtgccgaaaccagcattttgtagattccagagatttgttgaataaataatgaataacttaaataagttaatatttatagtatccatatacaaataatacatcatctcagaatacaataataacgtttgttatgcagaaaatgatttcaatctcagttaaaaatattttgggcttaggagttactgtcatatatggatgctcacattgttttgtttatacgaaaatgtttgtagttaacgtacgtttttggtacttaagccttttgttcttgctgccatagcaaatagtgtgcctattaggaacaagaaccagaggtttacttcatcttaacagatttcttaataaaatacatgccatactgtttggtttaatgcataagcaaagagtcattcactccgccattgctacgtgtccctcctctaatacggctcctgaagatgttaccgatagcagaggactttgtgttcaacctaagcactttatagccctttcactttcaactaagtatgagataaaataattcagcaccaataaaacaaacacttcttaaatactgaccctttttttgagcctgtttcacgttacgcagcaagacagagtacacttctctttcccagcaaatcagtgttggcactacaccctctacactctgaaaacttgtattattggcttccttagaaacacaatttgagcttataatttagatgtcatcaaataatgtacaaaaatatgctacttccttccccttcacttctcttctcttctcttcttatcagataattgtcagttgttttttctctccaactcctttcctccgactacctgatttttaaaagactttctgcacatttccaatcttagtattgtagagacaaaatgtgtggtcaaactgcatatataggaagagctgaattatatgcaagcatttttaaatacacaattcctcctcagttttctgtgattatttcatataatcaaatgtcttccagatacacatcccaaacgagtggttgtcaagctctgctttgtggtctaatttcatcagaattatccaaaattcttatgataaatacagataaattgacataactccagatttatgaaatcaacatttccagaacccaggaatatgcattgaaaaagtgtattcctcagatgatgctgacatgatacgggatccgagtttacaatgcaaggaaaattaccttccttgcccttcagctgacccttgtatccagaggtcctcttcccctttcatattctgccctctctccttctgcacctttctcctttcctccctccagttctgctcatccagatcccaagccctcccccatggattccctaaacctcccaaatggtcagttgccactaaagttccctctgtctcatgaacaagttatgtgggcaaatgtaaaatttaagcttggaccaagctgactcaagagcggcaattacaaatttccctaaacccagaggggaccagcaaacacttgtagaagattagagatttcctgtgagtgcaaagggctcagagtgtcctgatgctgtagaccaaatcttactgtcccctccaattcatgtgttaaaatctaattccctatgtgatgggatttggaggtgaggccttggaaggtgattaagtgatgaaagcagagaacccgtgaaggggatcagtgtccctatcaaagggacggctgagaactcctcatcccttctgtcatgtgaggacacagtacaaagatggccgtctatgaaccaggaaggaagccctcaccagacacaaaatgtgctgaccactcactgctgactccagtgagtcagaggagcgcaggccacatacctgggtctctgcctccatgcctcccacagtgcccagggctgagagcagagtggcagctgctgactggggctgtgctggccacctgctctcttctacctcttgctcaagccatgctttcagccccatggctgaggccagtggctagagcaggtgccatgatgtcaggcagctccttaatgggctggtccttggcaggaccagggcaggggcaggagggctctgcagctgcctctagctccagttctgtccctgaagggggctcttcccctagtgctggcactggctcatcagctggtgctggaaggtcctggattgccgcacattgagcaggagatgaaaaagaagaaagagtcaccaatgtcagtcactttccactggaatttccacacacagaatcagcctcactgaattaaaggaattccagtccaaaaacactgcccccgcaaagtctccaaaactacaggccccccctcaccatgtgcctgtgcctggaggaactccagaggctccagcaggccaaggacaatgcacggatgtggcccggatgggatcaccagtgaggcctggcctcgtagggcctgcccagggctgtcctgtggtacctgggtgcgccttcggccagaggtgcctggggtgaggaatgagcctgcatcggcatcatgggaaaaggctgtcactctgggccctcctgaagcaggagcctcaagatatgcggatgcagcatgagaacatcttgctctcctgagcatctcccaccaagggaactggctgcgggactgtctctaggatgtgggtgcctggttaccagaattctaagttctgtgagggtatatcaccaaggaagtgaagtcacttctttaaggttccgtatcctcagccccttccttccataagacctactcagaaccccctgggctgctggctgctcaccctccccccaggccagatccttacctgtacacaggtaagtccacccagggcctgcttgtacacgtgctcctgatgtgcacctgggacctaggaatccacttagggcctgtgatccaacaggggcctaatgttgtttaaaagtaatttttattattcctacaggaaagaaaaggccttctagcaataagaagcacagtttcacatcaaaaacataaaaatgatcaaaatcttggggaagaaatgtatcaattttaatcactgaaatgttaacttttgataaatatttaagtttataaggaaaaataaaaccatgctgataaaaccacagttgtagggaatgctatagagtttctcctttgtggtttgaacacagaaaggtcccacctagttaggctcataattttctaccttaatcttcttgttcttatgattaatggaaaaaataccatgacaatgatggtgatgatggttcaagtacacactgaggtttagtgacagaaacatcaggtgctcccagttacagtgcagctgttcttattggggtgggaaaatcaatcttgtgttcagtatacacgggaagcaggagtacatgtggatatgaccacatttcactggacttatattttaaacagaagatctacagtttattcttcaaaaaataataacacttgccatgcaaagtatatatataagatgtctcaaataattgtacttacattgcatatgaaagtgatacattttgatatgctaggtaaataaagtaaattatttaactcatttacttcttccctttgtatttttaatgcgatgactagacattcagatttccatgaggctcacatcatattgtgaatgaacagtgctggtctgcaccccttcaggttacaggggctgaggagtgacctggtgcaggaagccccatctccatccataggacattggtgtgaacccagggagaggcgctggtgtaagagagatgagaacacaggtgtgaaccacctgcttgtgcaggggactgagccttcacataagttgacacttaaaaagccaccacaccccacccttgtcaacaggaaacccattcacatctccatcagccacacaatctccaagattcttcaaaaagtaataacaatagccatgcaaagtatatgatatatatcataaataattgtacttacattatatatgaaaatgatactctttttgatatgctaggtaaataaaatacattatttaaactcattgacttcttctctttgtatttataacatgacaactagacagtgggattcccatgaggctcacatcatattgtgattgaacaaggctggtctgcagggcttcaggttacaggggctgtggagtgacctggtgcaggaagccccgtctccttccataggacatcagtgtgaacccagggagaggcgctggtatgagagagatgagaacacaggtgtgaaccacctgcttgtgcaggggactgagccttcacttggagccaaagttttctttcccaggttcaatcctgaacaagagggccttctggacttctttttgttttcaggcttgtgccccttcaggtttggggctgtctggatcccagccaggggacactgaggaaatccaggagtctcacactgactgttctatttcatctgctggggccatcccaaactgctgtgtaccatttcctttcctggtgctcaaatagctgctccatgcccttgtcatggtttcagagatgaatctaggtgggaagacaggacagtgtatgttataatatttaaatggaagctgaatccattaatatttattttaatatgaaacattaaaagaattttgtcataagcaatgaggaaagaggaaaagatattcaagttattttgagaaaaaataaaaatgtatttatcaaatgtctgtgtgtcttcagtgtcgcagggttgagagcagccagctttaggttgccctgaggatgcgctcagatgggaaaaagcgagaaagcaggaaacgcgtctctgtgacctgacagataaatcacagtaatggaaataagtctttcaataattcaaacattcacaataaatatcactctgatgcacacagaaaggcctggtaacaaactttccctttgacctgctggctcatatccccatggatcacctgtgtgcagagtggactctctggtccccatttctcaggctgagaactagaggctgggaaggacaagtggcctgctcatgagtgggaagggcgggattgggagcagcagactcgggctcaggactctggccctggtcagtgctccttgttccctccacagggtccctcccacatgtgcccgtgtggatgtgggtgcactgcctggggtggctgatgtgctccagggattcaatgcggcagatgcttcagcaccaaaggtagggagtagggatgggacgaggctgcagctgtggagaccagggacccatgatgcccagcagaggtttccacggggtgggtagccccatttcctgacagtagagacagcctagaggtgggtgccaagcagagggcactgtgccatgtgcccaggcctggagggccacagagacacaggcgccacacagcagagacactgagagccaggagctcactcaggtaagggatgtcagcagatctttctctcctgagcaaatcaggtacaaaaaaattaagatcctgccatcagaatagacaaacagggactttaatctcctcggctgagccccgctgtccagggaagaagaagtctctgagcccaggcccaggtgagggtggagtgaggagaggagctcagggtgcagatttgcataaaggccccgccctcctctgaggcagaggggataagacagggctggggtcaggcccagtgctgggatctcaggaggcagctctctcggaatatctccaccatggcctgggctctgctcctcctcaccctcctcactcagggcacaggtgaggcctccagggaaggggcttcggggacctctgggctgatccttaactcctgctcctcaggctcacctgggcccagcactgacttactaaaatgtgtttcttcctttttccaggatcctgggctcagtctgccctgactcagcctccctccgtgtccgggtctcctggacagtcagtcaccatctcctgcactggaaccagcagtgacgttggtagttataaccgtgtctcctggtaccagcagcccccaggcacagcccccaaactcatgatttatgaggtcagtaatcggccctcaggggtccctgatcgcttctctgggtccaagtctggcaacacggcctccctgaccatctctgggctccaggctgaggacgaggctgattattactgcagcttatatacaagcagcagcactttccacagaggtccaagttcctggggaactgagaccaaaacctgccctgggctctcaggccccctccttgctctgaagatgcttcctcgcccagtgcaagcggcttcctgcagtgcggccttgagaattcttctctctcagctccttccctttccaccatgaattccaaaaggaaacccgctctgtggtttctcatccaggacagggacagcttcctgatgcttgtgcgctgtggtccctcaatgtgcagctcttcccagctcttcaaatgcagggacagtgacaaggagctgcctgagtggtgcagtcactgcttttttcagggatgtcttcaccctacatgcatcaccatcccctacactgtgggtagaattttagcaactacattctaatggttatcgccacaactttgatcttaaataacagtgcagcgaacatccctacgcagactcctttgagttcctgtgtgaatatgaccacaggattcatttctaaaagtgaaattgcaggtcagaaagattgtgtgtttgtaattttcacccattgttgtcagattcccctccagagggattgtaccaattttcaatgccagctggaagtacttgttcagagtacattgttgaaagtggaaatttttgccagcttatcagacagaaaaatgttaccttgttacagttttatttttgagtctcctgttctgcttacattttggccctttcagaaatagttcagtactttttctttttttaggatttagtaaactttataaaaaatatccagataaggagaattttagtgtttgtgggcaggcacagtggctcacacctgtaatcccaagcacttcgaaagagtaagacaggtgaattgcttgttcccaggagtttgagattagtctgggccacacagcaaaccctcatctctattaaattaatgcaaataaaaataaattttaaaaagaattattttagtctttgtggcccaagaatcaactttagggatattacataggtacttataacatcatttacaatgtaaccatttaaaaagataaaaatcactgttatctctgggccatgcaaaaacagttgtcaggccaggagtggccacaggatgtggttgaacggtccctggtttgcagagttatctgaatgttgaaaattccaccagcatatgatctaggtggggatctctctgtgagggtcactgtatttcacctcctgtattcggctgaggtctttccttggataagaacatgctcacatcatctatttgatgggctcatgggtttgcccaagacaaccctgtgtcacaatcacataacttttatctgcattgcttgttctgagttttgggagagctttaatatatcaggaatagactcctcctaagggaaaagtctgagggatatggatgggcaaggggtcaagaaagcttctaccaaagctggaatatccagggcaggctcagagagaaggatcctaatatcagcatttgactgaagccaaaaccagaagagaacatggacgttctgagaataataagtaaataaacagtttaaattttaaatgtattgaatattcttatactccatgaaaattctagaacggaatttaacaatgggataaggaagagagcttgagatgttaaactataaagaccacaaggcaagttgccaggaaaagaacaggacctttttagtggaaataggtttctgctgcaaattacctttcctatgaaattggtttttaggtataaggaaacatcccatggaacattcttctttcctacagtcaagatcaccctcaccccacaagggaacctcaatatcaaatagaaaaaataatgcactttgtataaccattaggagagtctttatttgcacatcaaaatgaggatggttaatggtaacattggaaatagtagtttaatatgcataagtgatgaatttcttttgactataccatttctgtctgtgatttatctttcttaatagggacatactctgttcttaaaacaatttaacttgtgttatcttttgttctattatctgtatcagctctgttttttttttcaaacactggcaaagttattccatggttaatgattattaaattcaatttatggatatttagattatttaaattatttcaagagtggacagatgtgatttccccacatatacctcacagatgttgctgatgctgacttgttcatctcttccaacctctgcaaacaaagtgggaaattggatttttctgaacacccagatgacaacgggagaggaggtgaaacccccctaaagctgttatcctttaacccctcatggtgaatctcccatccacacttgagttggatgatatgtaaatgagagtttggtcttagagttggtgctgagttagttcaggatttgggttattgggatggagtgaatgtgctttacaagtcaaaaactatgagtttttgtgtgcataggttggagagctcttggctgaattgtgtcccccagaattatacaatgaagttctaatgcacagtgtgtgactgaatttggagacagcctttacagaggtgattaagtgaaaatgaggtcatgagggtggcttcttctccaatctgactggtgttctgagaagagaaaatttgcacacatagaaatgagacactagagatgagcatgcggaggaaaaaccatgtgatgacacagcaaggaggtagccacctgcaagccgaggagagaggcctcagggaaaaccaaacccaccaacacctttatcttgactccccagcttcagaactgtgagaaaataagtgtctgctctttaggccagcaggtctttggtatctcattaaggtagcactagcaaatgaaaacaaaagggaccccaaagaccttgggtgccagagaaggaggagatggaggatggtgcaggaggcggggcagggaggggctggaagttcaggctctgaggtgcatctcttgggtgcaatcctgactccactcactgctgtctggggacttggggaagaatcattaacctcccaatattaattccataataaagattgggtcttgagcatagggctgctcatcctcctattccatatgatgcaaatcttcttgaggtcatgcttgtaaaacactcagcaatgtatctggcatacactatggcctcagaagtggttattctgaattttctagtgatacatagagaatggcattgttcctgtgggcagaggaggcactgtggaccttggtttgaggactcagaaagacaccaagtcctctggtagtgctcaagtgcgaagagcgtcacagatgcttcctcccaggccccttctattgggtaaaatttactctccactcctgacacccatctggtccttcttctgaccttagcacattatcagtttgaagacttaaggctcagggctcagatgggagctaggacaggcacactggggaatgcggagtagatttgcattcactgctcatcagggagcccacccaacaaggatacaagaataaaagaagtagatttgcatgaagagcctctccttcctatgataagagagggctgaaggtccctccccgctgtgggctcagagacagagctctggagcatctccaccgtggcctggacccctcccctgctcaccctcttcactctctgaactgcctcccagggctcagcccccaaaggaccagagatcagcctggacctgagcttcagctcagcacagggagtgatggagagtgtggggtctgggaatgaccctcatcctcataattacctcttctgtcctctcttataggctttgtggcttcccgtaagctgactccagagccagcagtgtctgtggacagtcagcaagggtaacctgccagggagaaaacctaagaagccatggtacaaactggtaccagcagaaccctgccagatgcctgtgcaggtcatacatggtaacaacaaccagccctcagggatcccagaccgattctctggctccaagtcaggaacacagccaccctgaccatcactggggctcaggttgaacatgaagctgactattaccgtcactcatgggacaacagtggtactcatctcacagtgacacagacagattggaaagtgagatctaaagaccttcactgtctgtatcaccctctttctccagccatagcaggactgagcagggctggcccgggtcacctggatcgaagcccttcaggctgcccttccctccagccctcccggcagactgcagagagtaggtcaggataggatttggggctggcagaaccaggctgtcctgctgttatttggaatggatgtaccttggctcaagatgacctgagtggaaggacagtaagagggagacagctactgagtgctcatggtcactgaatttcctcctgtgtgttgactgaacccaagacagtgcctctactctgtggcccaaataccctggattatttctctgaactgcccatgtttaactgagaccctcaagccccagctttgtgcatcctgatgttctgaacatggaagcctttcataatgtgcactgtgacatccttcagattcccatttcaggacttatgcacccaccatccacccagggctgcagggagttcctggcttctcacagctcttccccaccagaaactgccatgcagtacagagaatagctttgctcaaagaattgcccatttcaaaatgtgtttcatgggcagtgactccctgattgccttaatctgaaagtcatgctttaatttaagaccctgaatatcaaattgaagtgccttctagctgaacgctcaattgtaaaacattcccagtcacacactccacacttctttcctgagaatgtatcctgaaaccctactgcatggaatcctccctctcagagtaggattgcagggaactcaaaaattaaaaacaaacaaacaaaaaacagtctagagggaaaagtattgaagaggagagagagagtgcacaaggagacaactctgaagtctgcaaatattcatgcactgaagagcgcttgtgtgtacagaaactccctctgaaagagaaagacccttgagggaacactccaaagagcgcgcgcgcacgcgcgcgcacacacacacacacacacacacacacacattccagtcacagaggaaaggcctgagttatggggcatgaggtggactcatcagaagagcttcggctcagtattgaggaaaatgtcgccctagacatagggctactctgctctcaactaagaaagtgtagaagcaaactgagaaaagttaagacagtttccaagtaactttactgaatccaaaaataaaagacgaaaatagagaagaaaatgcaaaagaattataaactcaacaaagaaaacttcacaatgattggcattcaatcaacatttcctgcaaggaaaaaagaaaatatatgctctaacacagagaaaaatgaatcaatccaaagtggcaataaaattgtatacgtgatagatagaccttgtatgcaaaaattttggagcaattcttataactcttctccttgctcatgaggatagaggattgattgaaggtgttaagtgaagaaatggaaggcatgaagaaaaatccaagtttaacttttagaaatggtctctaaatatctgcattgaaaaaatgcactgaatgagaatgattgcaggttaggtgctgtgaaagaatagttgagtgaacttgaagacatggcaatggaagctattcaagatgaagtacaaaaaaagtgaagagagcaccagtgaatttcaggacatcttcaagctgacttacttggtataattaaaggcatgaaaggagataacattggtgaggggagaggaaaggtagaaaagccgtttaaaggaatcatggccaaaatttcccaaatttgttgaaagctagaaacctacaactccaaaaatcttaacaagttacacacacacacacacacgcaagtaatacaacaccaatactcatcataatgatattgctaaaaaactatgataaagacatacttttaaaagtagccatagagtaaagacatggtaggtacaggcgaacaacataagaagaagaacagatttcgttttctttgtaaaattttcttcaacatctgggggaacatagtagatatatgtatttgtggaatacatgagatattttgatacaggcatgcaatgtgaaacagtaacatcatggagaattgggtatccatcccctcaagcatttatcctttgtgttacaaactactcaattacagtattttaggtattttaaattgtacaattaagttgttatcgatgtgctatcaaatagtattgacataactctgatgcgctatcaaatagtaggtcttattcattctttctattttatttacccattaagcatccacaaataagagcagatttcttcttagaagtcatgcgagcaggaagctcgcatgtggagctatatttataaaatattaaaagaaaaaacttactacccaaacccatctccagaccatgaatttctctctggatatcttattaaaatattgtctcctatcaaatctctatcaaaataccaatgacattcacagaagcagaaaaaaaattctgtaactggtatggaaccacaaaagcccctgaatagccaagcaataccaaacaaaaaaccccaagatgaatatatcacattatctgaatcaaaatatactacaaattatggtaaccaaaacaggatcaatggtattggcataaaatcagacattgagactaataaaattgtatagaacacaccaaaataaattcatgtatttacatccaactgattttcagcataaattccaagaacatacattgagaaaaggacgcacttttcaataaatggtgctgagaaagtggatacccgtatacagaagaatggaactagacccttgtctctctccgtatacaacaatcaactcaaaatctattaaaaaccccaagtataagacccaaaactataaaacaactaggagggaacgtagaggacatagggaaagttcttcaggacattggtctagacaaaaattccatagctaagacttcaaaaacacaggcaacaacaaaaactagacatatgggacttcattaaactaaaaatcttctgaaaagcaaaggaaacaatcaacagagtgaagacaacttgtagaatgagagaaaatatttgcaaacaattcaactcaaaaggacctaagatccagtataagaaaataagacaaggagctgaaataactcatcagaatagaaaaccagtaatagcattaaaaagtgtacaaatgatatgaatagacttttcacagtcaaagacatacaaaaggccaataggttaattaaaaaatgcccaatatccctaatcaccggggcatgcaaatcaaaacctccatgagatatcatctcatcccagctaggacagctatcattaagaagacaaaaaaataacaaatgctggtgacgatgtagcaaaaatagaagacaaaaccacatggtcatctcagcagtcacatcaaatgttttcatgtaaggaaacattaccatttgctgtttttctagtcttgctagagcaccataaaagataagactagtggtgccaatactgtagaaaatgttattacatgcagagaatctcactatcccataccaaactacatggattcttactgttaaatgctaaaagattacaactctgcatttccaaatgttctggtggtcagagaccacttccttgacaagtgatgagtacggtgatgtgaaaggatagttagcatttacgcaggtattgggtgaagaatagtgatatacacaggaaagctttcaaagagagaaacacatggaggttggaacacagaagagaacataatatgtctgagaaataaagaaagtccagactcactggagctgagtgagaacaagaaaaacggcatgaaccatgtatttcactctggatatctcattaaaatattgtctcctccccaacacaccaccgatgtgaattgtaaaaatgcccgttcttaaattattttttgcacatcatgacagggtcaagcatgtgaatcaagctgagtttgatgagtccaggtctgtctgatgagtccagacccaggtggcctcagaaggacttggtggaacgagggcttgttgtcaaaagtagaggaagtgagattttccattgtggcttagacaagagattcttaaatttcagtggacacacaaggcccctgaggggtctcggtaagatgtagatgcagcctcagcagttctggatgtggccccaaattctctgtgtccagcaactcccaggtgaggctgctgctgctggtcctcccaggaccacactttgaatggcttagctcttattcacccacctcactcaagccacaggtaagactcacacaaggagagcatattctagaagcacaggtcacttctcactcctccccttgtgtcttagatccttttctgttacaacaaagaagtacccaaggctgggtaatttatagagaaaataaaaggtttatttggctcacaattccaatggccacagagttcaagatatggcatctgctcttgttgaagacctcaggctgcttctagtcatggtgaaaggtgaaggggagccagtgtaggcagaggtcaatgggggagaggaagcaagagagaagaggaagatgccaggctcttttaaataaccagctctttcggaaacagtgggaattcactcaccccaagtgaggacattaatctattcatgagagatccactcccatcaccctaaaagctcccattagttcccacctccaacactggggatccaatttcaacatgagatttggaggcgacaaagatcaaagccatagcaccctgaggtttggccacgcacttgctcatctccacatttgtccctcccctcatgactggggtcctgaccactctgactcagtctccctccacttcatggacacctggcagtcggtcatcatctgttttgctgaatcaacagcagtattgggggtattcaacattccacatttgtattgtttgaaaattgcccaatcttaggtgttttgttattgctacacaaacagactaagacatttactatttaatggttacatttcattctctttttatgaaattttgttgctaacagggactttctgcttggtcagaagattaacaattgtgtctcctggttccaccagaaacagagtagagacccacacagctgaggtatggggtcatagattaaaactaagagacataagattgattctcaggctccaagtctggcaagtgagcttctttgagactccctgggatctcagcagtcagactgatcattattgctgtcccaaacatcctatgtgatatggaagtaatatcaaaaccctcctgagattcctgacttgtgtcccgacatgaagtctgttgggattcctgtcattccttcaagattgttcaaataagcagcaacaatcactctcatatgagatatgaaaagaagaattccacatgaaccaaaccctgaagcccacactgaagtctgccaagttatctgcagtccagcgcgatggagggagcattttcgtggggacttttgagagtatggagaaggcctgaggaaacgaggctcagctatgggttccagaaacaaagctctgggatgtctccccatggcctcgacctctcacgtgctacctctcctcactctttgcacagatgctgccccaggctaagcccccacaggaccctaatcctagtcctgaccctgagctcagcccaggtgatatttcaggagatgggaccctgagaatgagccctaaagtctccttatcctgcagcccctgtggtctcttagactcagctacccccagtagagttggccatgagacacctgtcccccacctgctcaggagagagtgcagcaggcaacagtgcagagagaaccagcaggagccaggccaggcgctgcattcagagcagcccccaatccaacagattctccagctctagcctggggtacagcccccaccttctgcgggctgaagtgggcttctcaggatgggcaggccatgatggggattggcagtgtgtccatgggacacagccctactgcctgcctggccctcatgccccctccctccccatcctggttaagcaccaccccaacgggcccagtttcagaactcaggacacctgggccagctcctggacttgcccccactgctctctgttctcctgagccacttagtctcttttggcctcagtgttacctgctgtgaagtgaggagccttatactgaactgaggaagctctttcttcattcaaaattaaaagacagaaaaacaacgaaagtcatgcgaattaaagcctgatgaggggatgtcacttaatgggcttcaatgggcttcagacaaaacttcttgtctttcctctgcagggattccaagaaagggactcaaaaagagcttgctttctgtatggtgggaagagcagtccccagctgagaataagcaggagagtcccagtttaatcaggaagacagactagggtagtgtagaaatcctctcagcacaaactctgagaagtatggaatgaaataaagacaaacaagaaattaatggtgccgacggtggtgatgttagctcacagctaagctgcagaaccagaaacatgcggtgatgggctgagtctcctccaccagctgggggcagcagagctgcagccaggagctttcaggagagaggctggggctgcccagctggggcaaagagaaggccagcctggggttcaacaggtgtccaagaatctgtcttcagactgaaagtgagtgcagttcatcctatcccctcaggcttcagtgaccacgctctgagggtcagacacacggtgtcaccccaggacactgacagaagcctggcacagtgaaggcctcaccagggaaatgcagctggaggaggctgggcccagatgtgagcttgggcagcttcctcaggaaggggaatccctgggaggcgtcccaaggtcgaggtgctctaggagggggtatagtgtgaggtgatggggctcccagggcccgggttcttcacccaggatggcggcctgagcctcctgccactctcagggtgtcatccctcctggtccagcagtgtcctggggagctgagccctctgtcctgggcacttccagatacacccgacccctcctccctctgcctttccttccagctccaggcggactctgactcagggggcagctcctgtactcaggggagtctcgggtgggtgtggtggggcatttgggaccctggccctggatgggcatccccagcctccttcaggagacactcttcagagggacagggcttctcacctgcctcaggccacagctctgaccatggtgctgtccacgctcagtgacaggacactgagcaggggcctggctggagtaaccagggaccacccaatctctggagctcacatgctgtgcagagaccatgaccctgggacccttacagagaccatggacctaacgttagattctcagtccagtgtggttttctgctgctttttgcaagtttacataaaatattgatgagaaaaacatgaataaataacagacaagttgacggtgctgattgctaatctcttgtggcaatgaggggtgatgtagcaggagcagcaccacgactgaaatgagaccagatgccatgttgactccacaggggtgtgtggttgcttaaatgacccaaatattcccactgaataatcagcaagtgtcctaatgacacagcacagcatttagatgaaatgaacaagaggggactgagtctgagggaccaggaggaggaagatcatgggtccctgggccacctgctgctgagtcaggtgtcatcatgatctctccacagagcccagctcagccccatggccaacctcctggaaggtccacagctctgctgagcctggcccaggacagaccccaggtcagcgaggtttgggacagtggtcatgaggttaattcccacaaaggtctatgatcacagggcttgaaggctgcagctgattttctaaccagagaccctgcttgttcctcctgttgcctgtgctgccctcacagctggtttgagagacatctctccaggaagagccacagaggatgtaaatttgcataaacgcttaacactgactgcccccgaaagcctgagagggaataagagaggcctgcggagcccaactgttctgtgggtccaggaggcacagctctgggaatctcaccatggcctggatccctctcctgctccccctcctcactctctgcacaggtgctgaccccaggcccttccccaggctcagtccccacagattccaagttgagcctgacctgaatcctgagcaaagcccagacacagcctctgggtgggactcctggaaatgggtcctttgtcttcaagccccctctcttgttcttccttgcaggctctgaggcctcctatgagctgacacagccaccctcggtgtcagtgtccctaggacagatggccaggatcacctgctctggagaagcattgccaaaaaaatatgcttattggtaccagcagaagccaggccagttccctgtgctggtgatatataaagacagcgagaggccctcagggatccctgagcgattctctggctccagctcagggacaatagtcacattgaccatcagtggagtccaggcagaagacgaggctgactattactgtctatcagcagacagcagtggtacttatcccacagtgacacaaggagacagggaagtgaaacataaacccctccccctctatttcatccccttccttctgccccaggaggactgtggacaaagccatgagcaggcttggccaaattcacccaaatttgaacccccaggctgcccttccctccagccctccaggcaggcgctgcaaaggagtcagtctgcagtggatttgtgcctggcaggcctggcagtcctgtgtttctttgcctggggtttgagttgttgatggagggtctgactggaaagacagacacagggagacatccatgcaggcatgtccagagggatgtggggaactctcaggtctcagttcagtgcagtcattgttgtatcctctgggaaagcattcctccagtgcacctaagacctctagacccacagagcctgaggtcgggatgagagaatgtcaaatttttgctgatggatcactaaaggcatttttgagtggagccactacaatttactccttgattctggactcgtggatcctgactgtgggagaaacagcaccatctattgggcactgatgcacagcacatgccccatcctggaagacattgcccaaccctacacatacttgccacttgcctggtgcagtaatggagtctccatgcagtcattaaaccattcatataagccacatgtctcagaatgttggggacaagagtaagaatcttgaatgccaggagaaaaggcccatagccctttatttgcggtgaaacgagttccttggtcagaacctcctgtggaataccatcgtgatgggtgcatcattctgtaatccagagataacagttttggcagaagcattgctgtcaatgaaagcaaatcctctgtacatgccaatgctagtaaggaaaaagagctgtctctcccatgatggaagagctctaatgaaattaatatcaagcaggcccctggctgttttccacagagaaggtcatcctatagggatgcctgtgttggtctctgctgttgacagattgtcacccagcagtggcttcagccaggccagctccagttagtggaaattcacattgatgagcccattatcagcctctatccctgccaccatggccacatttttttggagtctgttggacaatgacaggagtggttgacggaggctgcctggtgtccatagaacaggtcaccctactcacctgattagcaaaatcacttcattttcacagaagacttagtgagtatttatatatggaaaaaaattctcatgctttttgcccactggaggaggtctactcacacatctctccccctgacatatttgtgatcagtattcctgttgtatctctcccaagttcctgaacatccttgaccatattccaggaccctgagtcacagcccatgaattaggaacctctgcccatctctttgcaggtgacatgagccaattacactgcttaaaattctgctttaaggagaatgttcttccaccactgctgttcagggattctcagaggccaggtggagtactagcaccgttcacaccagtggtggatgcatgtcctgcagaaacatctgtaaccccagcctaattgcctcctactaggcagctgatctcagggagccactctggaggccaaggctgtagggtgagaggaaggcatggtgcagggcttgggtcatgtctgtttggccaactcttcacgcaacttacttggccctcgtaacctaatccctcaagtcacaaatacatccctgccgtgtgattggggagctgcctaaaatggccacccgggactgtgtttcagacgaaatccagcatatcagcaacttgagtctcgtggtgagctctgtggccacaatcacacagagcctctgccaaggctcaggagccctcgcagtctttctcaaatggtgttttctgctcattcaaaacaaaataagtaggggggggggctgctcacgtgcttccagtctgggacactaggaccacctaaaccacacccacgatcttgtctgattattttgattccttgttggctcagttatgcattatggcaaccaaaccacagtgtcattggccataaaatgccaatccttggtccccacctaccctgggatcccctcaaccacatcttgctacccagttaaggtttcagcaacactgagaaaaatgtatttttatattgagagaggaaacattctttcaattgtgaaaaatttataaggcaggaatgtgaaaatattttaaaagacattttacaaagggtgaaagaccctccattaaaccactcaatatatgacactgtaattggcctcccaaaccctgacttcagctctgggttgggaccttctgtaaaggggcctttcatcctcaagccctcctctcctctcctctcctctcctctcctctcctctcctctcctctcctctcctctgctctcctctcctctcagcctgtgcctcctacatacagagacagctgctctcagtcttggtggccctgagactgacaaccatgatcacatgctctggagataaactcaggataaacatacacttaggaaccagcagatgccaggccaggcctcggtgcttgtaatctggtataacagcaagtgaccctcagggacctctgcccaattcttaggctccaaatcaaggaacatggccaccatgaccattagtggggcccaggcccgcgacaaggctgactattactatactgcagataataacagtgggagcagctggcagggactcatagtaacacagagagatagggactagccacagtactgtcccacctcggcctgcctctcattctcacctgccctctgagcagctataggtcaggcctcagggtcaggtgtcctctctggtcttaacctggcccctgaggggctggaggttctgagcagcttctccatcctctcagggcctgcatgtgtccaatgagaagtggacagggtgaaggtggtcagagctgccaggacctttgtcaggtttgtggtgtacatgaacagtttaggaatccacacaaaagcacatggtcccagttgtaatcatacgtcatgcaggggaggagagagctgtcgcagagggcacagtcctgcagaatttctcctttccttgggtaaaaccagctcagtggaagccccaggggctgtgtctcctctggtttccagatgagttgacccccacattctaataggttgcctgatgcctgacaaggactggagacccagccccttttggcctcagggccctttctgtactgatatttctcagaaactgaagaggaagcacagacactacctttggtcccacctgggaactgtgtttggggcacactgacctcccatggcccccaaagtcccatcaccttccccaggtaggtcagtcctgactggatgtgcccccagcgccctgatagtttggagtttatctttgggctctgggctgctttctgaggagctcactaagaaacccttgatgccaggcccaggacctgcgcctctgctgcatgtcccagggctgcaggtgtgaagggagggtcctgctgggtgagggtgatgcccttttccaggagagatgtctgattccagtctctagggccacatttattgggctttcttttctcactaggatgtctcagtctttttatttccttctttaaaagtacaactggtttagggtgacctgctcgggtccccttccacattgtagaagctttgttatttcactcttcacaaaaaatctcgctgctgctcactctttgggtccatgccaccttaaaaaaaaagtacaactggtttaatcatgaaatcatgtgtacacactgaagtttacagattattgccatcagcatatatatatatatatatatatatatatatatatatatactgtttctggttgggacaactgtggacaaggccatactggggtctctgtctctctcgttatcacaagtgaggatactaacagctctcttttatgcagactgtggtcatgtttcccagttgcacacgaatgtctcttatggttgtttagtttccttaccagccaagacccttaagttttcatgcagacaattggatgttatttctctctgacccaacatttttcaaacagtattccttggaacccaacaaaagttccacaagaaaagctcaagtctctggtgcacagttggaccaggttcattgtgtgcagtaggaccttgctcaagtgatgggtccatttgatattttcactatcaaggggaagggtgttacgacttttgggcactgagttgatagagggaagatagcagctgatgatggccctacccaccaatgtgtgtgtgggcagtacctattgatggatttagaagttgagggaactgtttattctgcagatggaatttccagtactgaatctccagcacccagccactagcattcagcaggtgctctgtaagaagaccttcactgccaatcacagccattacacaggtgaaggagaggatgacttttaacagccactgactcacagtaaactgaggtagaaattcagcttcacaaagtgactttgagggaacagactgaggaagcaggttaattattcgctgaaggctttgcccagagcaggaacaatacagggttgatgaggacgtagggatgccctggtgtggaaggaacaaggcctgaaccaggagcaggaagaagcatgggaaagaccacgctgccacatgtgatgagtcagcacatggaaggcacagcaaatgttgcgcaaaggtttttgtgtaataacctggcaaacagctgcttctctatccagattcatgagccaaaaaatgttactgatgcattgctgtcacatgttaaaatgctgggaagcatggtgacattcaaggaaacctgttctctgcaaacacctacccaccggcacaggagacaccccagctatgccaagggctttgtcttcctctggagtaagagcctgggaacaatcaggtggcccctgaaaggggtgccgcgtcttctgctctgcatggctgagttaattggggaactcccagagaacattccagaaaacagtcaacctgtctgtgctgggtgcattgagcatgacccaggatcaatggaagagacagaagcttaatttccttatggctgcaaggtgagcactgggaggacggctgaggcaggttagccaccgcccctgagtggcttcagccccaggcaaacagggacaggtgaagggcctatctgagcgcacctgtatctaaccagtcccagcatcagcaactgcatcctgtggaccacgagggggtgtgtgtgcccagcccctcacagatcacctgagcataaacaggaaattctccaccttacacccgactgcacaacacatctgcctccagctcttcatttacaaggtgatatcacatcagacagggactgatctgggtcccagatccctcaggtttccgctatcctttccagtccccacacagagcagactcttcactgcagggtgttgagccagctcttcccctcacaatgcctgttacaggtttacaagttactgttctccaatatgattggggtttgtttcactgtttctctatatatatatatttgcattttcttgggtaagctgagccccttgtacctggtcttgagtcaggcaggggccacacagagaagaggacttcctcccctggcaccagccgtccacagatcagggcatcaaggacctgagcagcaggttctgaatccacacctagaccccggaagtccctgagctcccagccgacagtgtggagcagccaccagggggaagcagagaatcaactggcaaagcgacctggggatggggcaggcctgggtgatagggagatgctgacatgcagtaagagccagtgaccaccacctcagatttagagggaaagggtctttattgtcctagagtattgtccttgacactgatgtaaaaattctagaatcacattttgtcttcagctcttttgcatgctgactctttgtctgacacagatccaggcacttgacttctcacaacgccccctcctccacacccagttgtgctaaaactgcatccccctcatgtgcagtgtcctctctgaggtcacaggtatccccctactcccatttgatctgggaacccctgtcctgcagacatagtggctggcttctaacttcctagctgcccctccacatccaccgtccctggtctttcccgactctctcctggggaagctgccaaatcacagctcttgatttcctggtgagtcacaaaatagttgctcattaacctttagttgacttaagttcttatccattgatacattttccccagcaactggagacatcatatttataataaacattcacttctggggatcttggagtttgcagccccctctcattctctcatggagcaaacatttccttcacctcctcatctgtccctggtcctgacagcatcctggagatactgaggcacagcagcaatgacctacctagaagctcacagccaaggcagaaacttccagcatctcatggatcttccaacactctgtgcgcacttggcaaataaggaatttcattgacctctatcactcagaggttgtgggctgtggtgggacccgcacctgtccaaggtgtgcattatcacctgtacagtggagacgaagagggaacttgcattgggttctggaaagtactgtctaaaaatagatttagacctacaccagaaatgtcctctctaacataaaatatttatgataggacacattagaggcctagaccaaaatgaaatacctccctccagagccaagatagaatggaggaggggactggggaccccagataattccacagttaccagcatgactctatggtcacctcccagaccaggtcaaaacccatcccataggagggacttcatattcctttgtaaatacagacaaagtcacctctgagctctgctgtgaccaagggagcccaggagtgaggctgagcacagtgtgatgtggggatgtgtgcagagaatatggaatcaattcataaaggagatcctgtgggcaaagggtgggagggcaaggtcacccctaacctctttgggtcccttggggctgtgcccttctcgaaatcacaaggctcctccagcagcagcccctgactctgctgattggcatcatggacccttctctccaacaaggggttgagagacctgggaggagcctgcccagcctcagacttgagaagcagcattggaggcacttcagccatggcctggcccctcttttccttggtctcctgactcactgcacaggtgctgcccccagggtctcacccacctgcccagccccaggcctccaggttcagcctggccgtcagtctgagctcagcagggccctgtgtgtggtgggcaggatgctcgtgaccctgctgcagggggaggggctggttggggtgaaatgcccccactctgtgctcctgtgctcataggtgccctgagagctcttttattcctggggctcactccagccctggcaagtagccagatatccttgggttgagaccctcagtttcaagttttttctgtccccttttctttccttgtaggctctgtcacctatgagctgacacagtcaccctcagcgtcagtggccccaggacagatgaccaggatcacctgtggggaaagcagtattggaagtaaaagtgctcaatggtaccagcagaagccagccaggcccgtgtgtgggtcatctatggggatagcgggcggccttcagggatctctgagagattctctggctccaacttggggaacgtggccaccctgaccatcaacaggacccagggtggggacaaggctattactgtaagatgtgggacattagcactcctcatcccacagtgacacagggagatgaaggagcaaaacacaaaaacctcttccattggtgtcactcttgtcctccagcccaggaagacagtggacaaagccatgagtgtgtgttgcccagttaacctggatgtgagacccccaggctgccctttccacaggccctccaggcaggctctgcagagggggcatcaagagtgaatttagggctgagatgaccaggatatattgaggtgtggaggaatcagttgtgatttggggaagtggggcctggttggaagatcagaccaaggtcgacatgcttagttgggctctggatttccatagggggtgaaggctagtccttgggctgaatatcctgagtcagtttccagaactgcccagctcacgttcccgtggcatcctgccattctcttcaggaaaaccagtggagtggacactgtgggatccacccatattccctcttctgagctcacccacccagcactgctggtagctctggcagctcagagctgtgccctcactgagaagggctgtcagcagagaaaactgtctcctccaggtttatgccccttcttagcaaggtgtggtttcataactgcctgaggtgaagctctcaagactccctttcaatatgggagaaacagaaaatcctcccagcttcacagctccttattgggatggtagaagactcaatgtgggtcagagtgtccttgtgcccggtgttgcctccctcacttagtttcacacctactgtgaaagcaaagctccatctcagagtctgcttccaggcatcccaaaataacataaccagtcatcccgaacgtgagccatcaggaacctcaggaggccacagtataccagaaagcaccagtttattcctaatgatcattgtgagtttgcaaatgcccaatgagatctgagtgtttcttgcatttgtatggaatgaaaagggccctggcatgccaggcactgtggggtctgagggagagttggagtcagatctccctgcagggaaacctggggcaggaggagcagcctcatcccatgcagggaccacagatgcacctgcagggtgagctgcaggatggacactgcccacctccaccctccacattctgtgcaaaaaatcattctttccacccctccttcagcctatcaaagttgacacttaaaaagccaccacagcccacccttgtcaacaggaaacccattcacatctccatcagccacacaatctccacataaagattcttcaaaaaataataacacttgccatgcaaagtatatatataagatgtctcaaataattgtacttagattgcatatgaaagtgatactattttgatatgctaggtaaataaagtaaattatttaactcatttacttcttccctttgtatttttaatgcgatgactagacattcagatttccatgaggctcacatcatattgtgaatgaacagtgctggtctgcaccccttcaggttacagtggctgaggagtgacctggtgcaggaagccccatctccatccataggacattggtgtgaacccagggagaggcgctggtgtaagagagatgagaacacaggtgtgaaccacctgcttgtgcaggggactgagccttcactttgagccaaacaagcttcttttcctatcttcaatcctgagcaagaggactttccggacttctttttgttttcaggtttgtgcccctccaggcctgaggctgtctggatcccagccaggggacacagaggaaatccagaagtctcacaccgaccctgttgtatttcatctgctggggccatcccaaactgctgcgtaccatttcctttcctggtgctcaaatagctgctctatgcacttgtcatggtttcagagatgactctaggtgggaagacaggataatgtatgttattatatttaaaaggaacttaaattcattaatatttattttaatatgaatcattaaaaaaatttgtcataggcaatggggaaggaggaaaagatattaaaattattttgaggaaaaaaccaaaattgtatttctcgaatgtctgagtgtcttcagtgtctcagggttgacagcggtcagctttaggttgtcctgaggatgtactccattgggggaaagcaagaaagcatgaaacacacatctctgtgacctgacacataaatcacagtaaaatggaagtaaatcttttaataaatcaaacactcacaataaatatcactctggtgaacacagaaatgcctgttaacaaactttccctttcccctgctggctcatatccccatggatcacctgtgtgcagagtggactctgtggtccccatttctcaggctgagaaccagaggctgggaaggacaagtcacctgcttgtgagtggcaggggaaggattgggagcagtggactcggtctcaggactgcggccctcaggaccaatgccacctagcagaggtttccacggggcgggctgccccatttcctgacagtagggacaacctggaggtgggtgccaagcagagggcactgcagggtgtgcccaggcctggagggtcacagagacacaggcaccacacagcagagacactgagggccagaagatcactcaggtaagggacttcagcagatctttctcctgagcaaatcaggtacaaaaaaattaagatcctgccatcagaatagataaacaaggactttaatctcagctgagctccactatccaaggaagcagaagcctctgagcccaggcccaggtgagggtggggtgaagggaggagctcaaggtggagatttgcatgcaggccccaccctcctctttggcagaggagataagacagggctgggggcaggcccagtgctggggtctcaggaggcagcgctctcaggacatctccaccatggcctgggctctgctgctcctcaccctcctcactcagggcacaggtgacgcctccagggaaggggcttcagggacctctgggctgatccttggtctcctgctcctcaggctcaccggggcccagcactgactcactggcatgtgtttctccctctttccagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgaggtcagtaatcggccctcaggggtttctaatcgcttctctggctccaagtctggcaacacggcctccctgaccatctctgggctccaggctgaggacgaggctgattattactgcagctcatatacaagcagcagcactctccacagtggtccaagttcctggggaactgagaccaaaacctgccctgggctctcaggccccctccttgctctgaagatgcttcctcacccagtgcaagcggcttcctgcagtgcggccttgagaattcttctctctcagctccttccctttccaccatgaattccaaaaggaaacccgctctgtggtttctcatccaggacagggacagcttcctgatgcttgtgtgccgtggtccctgaatgtgcaactcttgttagctcttcaaatgcagggacagtgacaaggagcttcctgattgatgcagtcactgcttttttcagggatgtcttcaccctacatgcatcaccatctcccacactgtgggtagaattttagcaactacattctgatggttatcgccacaactttgatcttaaataacaatgcagcgaacatccctgtgcagcctcctttgagttcctgtgtgaatatgaccacaggattcatttctaaaagtgaaattgagggtcagaaagatgtgtgtgtgtaattttcacccgttgttgtcagattcccctccagagggattctaccaattttcaatgccagccggaagtacttgttcagagtacattgttgaaagtggaagtttttgccaacctgtcagactcaaaaatgatacctgttatggttttatttttgagtctcctgttctgcttaagtttgggccttttcagaaatagttcagtactttttcttttttaggatttgggaaactttttcttaaatatccagataagaagaattttaatcttcgtggccggacaccgtggctcacgcctgtaatcccaagtgtgttggaagggtaggatgggtcaattgcttgctcccaggagttgagattagtccgggccacacagtgaactctcatctctattaaattaaagaacataaaaataaattttaaaaggaagtattttagtctttgtggctcaagaatcaactttggggatattccataggtatgtatagcatcatttacaatgtaaccatttaaaatgataaaagccactgtcagctctaggccatacaaaaacaggtgtcaggccagggatggccacaggatgtggttgaacagtccctggtttgtagggttatctgagggttgaaaattccaccagaatatgatctaggtgggaatctctctgtgagggtcactgtatttcacctcctgtattagcctgaggtctttcattggataagaacatgctcacatcatctatttgattgtatcatgggtttaagacaaccccgtgtcacaatcacataacatttatctgcattgcttgctccgagttttgggagagctttaatttatcaggaatagactcctcctaaggcaaaagtctgagagagagggatgggcatgtgggcaagatagtttgtaccaaagctggaatatccagggcaggctcagagagaaggttactaatatcagcatttgactgcagccaaaaacagaagagaacatggaggttctgagaatgacaaataaacaaatagtttaagttttaaatgtattgaatgtttttataatccatgaaaattctagaacagaatttaacaatgggataaggaagagagcttgagatgttaaaactataaagaccccaagccaagctgccaggaaaagaacaggatctttttggtggaaatatgtttctgctgcaaattattattttatgtgtgtgtgtgtgtgtgtgtgtgtgtgtgtgtgtgtgtgtgtgtgtgtgtaaggaaacctcccatggaacatccttcttccctacagtcaagatcaccctcaccctacaagggaacctaaacaaaatgtcaatatcaaatagaaaaaaataatgcactttgtataaccattagagagtctctatttgcacatcaaaatgtggatgcttaacgttaacattggaaatagtattttaatatgcatatgagatgaattttctttagactatttttgtgaattatctttcttaataaggacatactcttctcttagaacaatttaacttgtgatattttttctattttctgtatcagttctgttttttctaaacactggcaaagatatcctatggctactgattaataaattagattaatgtgtatttaacttaggtaagttagttcaagagtggacagatgtgatttccccacatatcctatggctactgattaataaattcaattaatgggtatttaacttaggtaagttagttcaagagtggacagatgtgatttccccacatatcctatggctactgattaataaattcaattaatgggtatttaacttaggtaagttagttcaagagtggacagatgtgatttctccacatatacctcacagatgttgctggtgcttactcactcttctcttctaatcttagcaaataaagtgggaaatttgacattcctaaacacccagatgacaacaggagagaggaggtgaagccccaaagctgttattctttaaatcctcaggatgaatcaccctggagaatcacccacacttcagttggatgatacgcaaatgagagtttggtcttagagtggtgctgagttagttcaggatttgggtcactgggatggggtgaatgtgttttacaagtgaaaaatacatgagttttggggtctgcagggtagagagttcttggctgaattgtgtcccccagatctgggttgagtgacatcccaccaagaggagtccaggagaagtaaatttgtgtaaacaccaaacatgcactgccccactaggcctgagaggaaataagcgaggcctgggaagcccacctgtgctttgggttcaggaggcagagctctgggtgtcttaccatggcctggaccccctctctgcctctccttcctcaccctctacaaaggtgatgcccccaaccctgccttaggctcagcccttacaggatcctgagctggtcctgccctgaaccctgagctcagcctaggcatagcctcagggtgacaccactggaaatgtgtttgttatcttcaagccccctctcctttcctctcctgcaggctctgtggcctcctatgagctgacacagccacccgcggtgtcagtgtccccaggacagacagccaggatcagctgctctggagatgtactgagggataattatgctgactggtacccgcaaaagccaggccaggcccctgtgctggtgatatataaagatggtgagcggccctctggaatccctgagcgattctctgggtccacctcagggaacacaaccgccctgaccattagcagggtcctgaccaaaggcggggctgactattactgtttttctggtgattagaacaatctcacagtgacacaggcagatggggaagtgagacacaaatccatttttcatctgtctcatcttttcctccagcaccaggatgactgtgggccaagccatgagcaggtctggccaagttctactggatatgagacctccaggccatccttttgttcagccctacaggttggtgctgcagagggtagagcaggagtggatttagggctgctataatcagaattttcttgtgttttcaggcccctgaagtgacttggggaaataagaacgggatggaagatgagagagatgtagagaacaatcacttggccttagatttccatacgatggtgattgggtcactccttccaaatatcttacatcagtccccaaaaatgcccagctcagctcaacacctgagcttccaggcttccatggcagcctgggattttgaacaggaaaagcagaggaacaggaaaagcactgtggcatctgcctagatatgcttttctgagctcacccaccctcaactgctgggagcttctagaagcttagagctgtgccctcacaggaaagtgctattgtttccagaaaacttcctttctcatatttaggctcagttttgagagttttggtttgatgactgcctgagccaagaacccaaggccccgccttaatacaggatgacactgaaaggccttccagctccagacctcccattgtggatgcctgaggcctcagttgcaatcttatgatgggtcagggtctccttctggtgggtgatgcttctctcactcctttcagattctctgtgcatgaaaatgtttatctcaaagtctactttcagggaacccaaactaagacggccagctgtcaccaaaatgagccaccatagacctgaggtggccactataccctggaatgcatcagcgaatttcctaaatttccactgtgagcatccaaatgcccaacgatttctgagagatccttgtattcttataaaatgaaaagggatcctgaaatgccaggtgctctgagtcctgaaggagaggtggaggcagatcttcctgcaaggattccacggaaaagggagcagcctcactccatgcagggaccagagatgctcccacgggggcagctgtaggatggatgctgcccacctccatcctgcacatcctgcacaaacaatcactctttcacccctccttcagcttatcaaagttgacacttacgaagccagcacagctcatccttgtcagactccttcaaacctccatcaaccacacaatctcaacataaagaatctccccaaaataataatagtaacaaaataataataataataaaataatagtaacaaaatagtaatagtaatagtaatagattttcaggcacagaaatagtaatatagtagctatgaaaacttctataaaaatctcataaataattttagattgtgtgcatgtgtaaatattatttttcacactttgtgttaaataaagtatattattgaacctagtttacctttttattttttatgtctactatggtgactagacaataggattcacatgagactcacatcatgttgtgattgtacaatgctgatctggtcttaccccttcacatgacaggtgctttggagtaacctgcttcagcaagccccatctccacccataggacatatgtgtgaagccacggagaggcactggtggaagagaaataagaatatgggtgtggaccagctgtttatgcaggtgactgagtgctggagccctgaccctgctctaacctagatgtgtcacatccatctcaccagagaccactcctggcctgcctgagctcacaactggggggaaatcgcatttctggcaacatggtcacttgatgtccagtgttatcctgtctctcccagggcccagtaagacaaaagaagctgtttttagaaaggggagtaacactctactgcacatgacatggccttcttccaaaaacccaggagtctacattgggattctccaacggggtttgccatgtgcaggaggttttatttcccatggtggagtctgctggattctctggccccaacagcaggacactcacaaccctgcctgcacctgctgcagagccttcctgctctgggcctggaaaacaatgggtgacatttatggctcctgatacatggattggagtcacatccccagtagtaaaatatgctactcctagatcttataggccttgtgtctctttcttcctggggaaaattgaaggttataataacatcttttttttttttttttttttttaagatggagtctcgctctgtagcccaggctggagtgcagtggcccgatcttggctcactgcaagctccacctcccagattcacaccgttctcctgcctcagcctccctagtagctgggactacaggcacgcgccaccgcacccggctaatttttttgtatttttttattttagtagagatgagttttcaccgtgttagccaggatggtctcaatctcctgacctcgtgatctgcccgcttcggcctcccaaagtgctgggattacaggtgtgagccaccgcgctcggccataacgtgttgtttattttgtaggagactctcagctgctccagacaactaaagtcccaatttcagctaatatggaggaggaaacatctttgtttatttcccactctcaaaagtgcatggatctcacaaaagcttccaataggccgtgcccatcatgtacatgtgattgaactatgatatccagatggtctgagcccccatgatgatatcatgatagggaagggagagctaatgaagctgggcagaaaaagtgtgaatgtatactgttgtccattccacgtgaatgcacactgattctgatcctattctctgaggacaatagacaagacctcagtatctgcttcagtggtttaactgtgcacctgcagccatagcattctgttccaggagatccccatctggcacagatattgctaatgccactattgcccatctgggtctgtacaaatccaaattcatcttccaggatcattcaactattgtagagatcagtccagtaaactgaaagtgaggaccccagaagtaatcacacgtactgcaggagaggagagagctgtttcagaggccacaatcctgttgaaattcctctgctccttgggaagaaacagcccagaaaaggccccaggggctgcgtctcatctgggttcctggatgaggcacaccccctactgcactgagattccacagaagctgggggtgaagtgcaaacaccgtctttggttcatccttgggattttctttttatcacacactcgtcattttgtccacaatgtccaaagtttctaaagtgctgtctaatagatagaggttctttgtgcgctgaactaaaagctcttgggttggctaatggtgatgtttgcacatttttactgtacttactgccgcttaattacacacttaaaaatgattaaaaggatgaaacattttgttatgtttattttaccataataaaaatattgcatgctcaggaagcaaagtaatactagtttaattttgaaatcacacaactggtaaaaatggaaagaaaagcaccattttctctgttctatatgctacaactcaactttctctctctctctctttctctaattaacaatgatatcctgtctggtccaaggtcacacatttccagtgttgcaggaatgtctgttgaatctgctaatttgttgccaggaagaatactcaaacttctcatgctcatatttgattgtcaactgtctccagccaacatttctaaaccaggatcctttgacaagacttgtgaagaattttgtaaaaagtaccccccaagatgacagtgttcgctgttggcagcaggactgtttccacgcagtagggctatgctgggtgtgcagtggagctgtgcacactgtgctcacggggcagattctgtgctgctgactctgatccctgtgcttgggaggaccgtgtccactgctgagtctacatctgaatttgattctcaagaaaaaggtcattcatagctgctggacactgagtcacacagagagacagaaggtggctgaggacaccttatctctgatgagaataaggggattagatctgctggtggaacaggaagctgaagaaacttctggctctaaacatggaatttccagccctctgtctctgctgtccatgcccttctcatctgtatgttcctgggagatgtggaccacgggggtcagaggtgaaggggattgggaagctttcatgttctctctcaccatctcccttgtttatctaacacactcttacacacctactttattagagcttctgctctacaaacatggctgagctctaaattagagacttttgaaagtgcagacggatgcaggaactcgtccatctggagactttccaccacttgaagcagtgaacacatctctgcaaggctccaaatttcaagtgacaggattttgggatttcaaagaaaactaaatctttggtgaaccacgacagaagagggaaggttcacacatttccctgctgcttgggcctcagtgaggactgactcagccagtctcaggctcctggaaacctcctaggagatgtgcactaggaaagtcttttcagtacaacctggggcaggtaagtggcccttactctgatattctgctccctgataattttgctttcagagaagaacaaagacctgtgattctgggaagttcaaagcccccagacaaggtcttctcattctcccgtgacagcctgagctctgcattcccaaaaggaggagcatcttcccggcatgaagagccaggagtagagagggagcttctcccaggggtgagcagggcagaagccaccttggtcagtgggaaggaaacgtgctcagctcacatctgacccagaatgactcagtcacacccgtgcagggtcacctgcatgtgagcatcatctatttgctccatgagaaaataccttgtgtgactcttgggtaaaatcataccgtaggtgacatttctctggctattgcttcagccaatgtttttcaaaattcactgtaggacacttacataaggtaagcatgtcaggtgtgggatgtgttgaataggaaaagcacaggcttcctgtatcaatgttcatggcttgtattcatggccataactcgtggaaatggaaaaaaaaaaaaaacagaaaagaaaatgataccctgctcaaaaaagcactgagaaataccattgtagtaatatatcttcaacttataagttgagctaattgaacattaacttagatagatcatttttatggggggattcctaaacctaaaacattgtattaaaaattttgtcaggttaaaagatcattaaaaggccaatgtttgattaaaatctggagtcttttactttgggctgcaatcagccaatgagtgcatggagttggctgccctcccagaccctgactggctccacgtcgaggtagagcagcgctcccgacaggcagctggaggaactgacgaggggaagctgtttgcatcagggcctcaaaaatttggctcaggattttcccacgtcccctccccaagcccaagctggtcccaggacactcagaagagctcatcattatgggtctaaaacttctctgatctcgctcttctttcttccttccccagagaccttggaattgtcagtccctctcacaggcccttcctttccttgtcaagtgcactccctgaattatctgctcctgggtcagcaattctctagaacttcagggaaagcagtgctgggtcacccacatggggccccagaaagctggctaaggaccagacacacaggcagcaggctaggtccccacagggctgcatggttggcatcgggtagaggggagggaccaggaaccactcgctgagtgtccgtagggccaggtgaactagggaagggctggaacctggtcaaagaattgtgtactaagcaccactttctctgttctatatgctacaactcaactttctctctctctctcttctctaattaacaatgatatcctgtctggtccaaggtcacacatttccagtgttgcaggaatgtctgttgaatctgctaatttgttgctgggaagaatactcaaatttctcatgctcatatttgattgtcaactgtctccagccagcatttctaaaccaggatcctttgacaagacttgtgaagaattttgtaaaaagtagcccccaggatgtcagtgttcactgttggcagcaggactgtttccacgcagtagggctactgcaagccacacctgtccccacacagtagcatcttcctggaggtcaagagtgattttgtttgctatgctgccccagatcacctaatttattacctgtgaatttcacacactacacatcctgcctgtccccaaattcttcacttatgggcaaatgtcacatctgacctgaactggtttacatcccagatccccttcaggcttcccactgtcctttcagatcctcacacacccaagacccttctccgcagggcacagacacagctccctgcacacgcttccatcacttgtctcttcactccttcctcaaaggaactccacagactcttcttcagggaggccttctccaatcactgaagctacagcagccagccagtcagcttctgtcagaactttcaatgattagctgcatagagcttacaattacacatttgttttttctatcgttatcttttgactgatttatttctattaatcattgcattatcagtcagaaatgctttttcactacaagaacacatgtggcaggaaccagggagcttccaattttcttccacaaaaataagtctgcacgtgcttggtggttgttttccagatgctctccagttccataggaagctcaaatatttctacctctccattccctttcaatgagatgttgactttgttttcattgttgttgatgtaagacctcagcatggctgctgcagctccagctatcacacccaagttcaagagaaaaagcaaagcacaaacccaatctagtccttccttcataagaggaaaagtttcctgagaagaatctcagccatctgactcttacatcctatggaccaacgctgggctacatggtcactgctggctagaagaaactggaaatttgcctgactttcaagtgaatagaggggatgacacacaagtagaaggtggtagggagtatctgctgggtctgtaaacccaatctgcctactgcactgatccagcaacaggacaggaaactcctcagagcaaggactgtgtcttcctcatgctgaattcctaaaatgcattcttgccaggacagagtgggtcagggtgaatatttgttgggtgaatgagcttctgtctctgttgtattgcaggagtcaccaccagtgcacattggccctgtatttgtatccagaaccaatcaaagccacccctgagtcctgcatctctcagtaccaagctccagtcccccttcaagaccacccaccacacagacgtgcagggagcctcaggagggcactgtcacctccttctccacatgtgagtgtttgtatttccatcaggaatctgagcacctcgtgcccaggtttgaggcaggaaggggccacaaacagaagagaaatttcttctctgaagtcaacagtccatgaatcaaggaatcagggacctgagcagcagattctgaagctacacctgaacccaggaggcccctgagcctccagctgacagtgtagagtggccacctgggggcagcagagagtaacctggcaaaaatccctggaaagggggtggagctgggcatcagggagatgctgacatgcagggagggtcagtgaccatgacctgagacctggagggaaagaggttcctcttttcttagaatatttgtcattgacactgatgtttaaattcttctgacctcctgtctctcagatttgactcttggaaatggtgcttatttttctgatacagattcagacaatttgcctcttctcattgccctggcccccatctcactgtcacacatgccattccattctgtagtcacgcgtgtcccacctccctgcccttttctctggtagctcgtcctgcagacacaggggcttctccttccctggccactcctccacgtccactgtccccagtctttcccaacactgtcctggggaacctgccaaatcacagctcttgatttccttatgaggcacaaaatacttgctccttaatcttttgttgacttaagtttttatccattgatatattttcccagcaagtgaagacaacttagttataataaacattcacctccagggtcttggagtttgcagccccctctcattctctcacaaagccaacatttccttcacctcctgatgtgtccctggccctgacagcaccctggggatactgaggcacagcacctatgacctggcattagaactcacagccaagtagaaacttatcacatcccatggatcttccaaaactctgtgtgcacttggcaaccaagaattgcattctcctctagcactgaggggctgtgccctggggtggggcctgtactggtgcaaggcttgtgctgtcccctgtagagtgggaagtaaaaggtccctgcattgggttctggattgtgtcttcaaaatgaatttaggcctataccaaacatctcatgtctgacataaaatatttatgaccaggacatttctagagaagcagaagaaagttaaccacctccctcctgagccaggatggaatggaggaggggactgtggaccccagataattcccccatcaccactgtgactctggtaacctcttgaacagggccaaccactatcccataggaaggactttatatcccctagaaaatacagagaaactcagctctgagtttttccatgaccaactcagcccaggggcaaaagtgggcacaatctgggtaaagatgtgaactcagaccatgggaccagtgggtggaggagaatcccatgggctgagggggtgggcaagcagtggtcaccccttttctctctctctctgtgtcccttgggactgagcccttctctggaaaccacaaagctcctccagcagcaacccctgactctgctggtttgcatcatgggctgttctctccagcaaggggataagagaggtctgggaggaacctgcctagcctgggcctcaggaagcagcatcagcagtgcctcagccatggcctggacccctctcctcctcagcctcctcgctcactgcacaggtgctctgcccagggtatcaccaacctgcccatccccagggctctgggtccagtgtggccatgactatgagctcaggagggccctgcctgtggtgggcaggatgctcatgaccctgctgcagggtgagggactggcggagctgaagtcccctcaaactctgctcagaggcttgtgagagcctgaggggctgcacctgccaggagagagtactgggttttcagttcaaaggctccatgcagagggaaagtccatgggccactggggctagggctgattgcaggggataccctgagggttcacagactctctgaagcttttccaggacagcagggcaggggatttcatacggatcttttacctaaaagccatcctctcctttttttttttttttaatctttgcaggctctgcgacctcctatgagctgactcagccacactcagtgtcagtggccacagcacagatggccaggatcacctgtgggggaaacaacattggaagtaaagctgtgcactggtaccagcaaaagccaggccaggaccctgtgctggtcatctatagcgatagcaaccggccctcagggatccctgagcgattctctggctccaacccagggaacaccgccaccctaaccatcagcaggatcgaggctggggatgaggctgactattactgtcaggtgtgggacagtagtagtgatcatcccacggtgacacaggcagatggggaagtgagacaaaaacaccctcccagcctcggtcaccctcttgctccagccccgggaggcctatggatagagccatgagtgaatctggtccagttcacctggatctgagcctcccaggccgcccttccctccagccccctccaggagtctctatagagcatacatcaggcatacacatggcctggaaggaccagaatcatctaatgacttggggctgtcgtgtgagttagagaatgagggcctgggtggaaagacagacagaagcaacctctgtcctctgtcttacccctggatggtaatggggtggggatgaggccagtccttagaccagctatctggctcagtccccagaaccaaccctgctgaggtcctggcccccaggctgtgtggcagtctgtgattcccaacagaccaaaccagaggaggggacactgtgaagtctgcccaggtcccctcttcaatgtgacccacctagcactgctgagaagcccagcagctcagagctgtgcccacaatgggaagcgctgttggttgcagaaagcttcctcaagtttatgtcctttctcagatggttttggtttaatcaaccaagatctcaagtccctgccttaatgtaagatgccactgaatgaagggcctcccagctccagagctccctgtgtggacggacacctgaggcctcagtggcaaccccattatgagtcagggtctccttctgcccactgttgcctccctcactctcttccaaatcttctgtgcatggaaatcattgcagtcaccttccagggaaccccatctaagatggccagctgtccccaacatgggctgtcagcgacccgaggagtccactatccactgaaaattctggtttctgtcctaaattttcagagtacatgttcaaatggccaatctgatggttccttgaatttttatggaatgaaaagggagcctgacatgctctaggttgagagatagttggagtcagatctccctgcagggaaacctggggcaggcagagcatcctcgccccacgcagggaccacagatgcacccacagggtgagctgcaggatggacactgcccatctccgccttccacatcttctccaaatgtcacccctttctacaaccccaacccaaatcattgatctccagaaaaataacagtaacaatagccatgaaaatctatgtaattcatctcataatttcatgttaacatgtgaaaatgatagtattttgctttattgacataaataaaatatactatttatccaattttatttgtcttatatttttatatttaatgtggtgaccagacactaggggtcacaggaggatcgtgtcatactgttatgggacagagctggtcaggactctttcaggtgacaggtgctgttgagtaacctggtgcaggaagccccatctccaccagacccaggtgtgaacccaggaagaggcgctggaacaatggagaggagaacctgcttctgcggaatacagtgcccttgagccctgcccctgctccatcctacgtgtgccacctccatctcaatgtggatcatttcttgccctgcctgaggtcatgactgaggggatctggcaggtctggctgtgtggccactgctgtctcatgtggttctggttgtaacaaagcccaggaacatagaagaggctgttttcaaaaggtaaataataatctactgcacatgacatagacttgttgctaaatcccatgggtctacagtaggattctcctgttgaggtttgccttaagcagaaggtttcagttcctttgtccagttcctctattatgatagggtctgcagtttctctggcccaatagcaggacactcacacccccgcctgcacctgctgcagagcctttctgctcttggccccaaaacaacgggtgacacagttctcagacccatgatttatggtgtcagtattcaggcctcgggggtccctgacggcttctctggctccaagtctggaaacacagcctccatgaccatctctgggttccaggctgaggatgaggctgattattactgcagctcacataggagaggtggcactttccacagtggtccaggttcatggggaattgagacccaaacctgccctgggctctcagcctctctcttgttctgaagatgcttcctcaccctgtgcaagtggcttcttgcagcaccaccttgagaatttcccctctcccagctcctctcctttctcaccaggaagtccaaaaggaaacctgctctgtgatttctcatccaggacagtgacagcttcctgttgcttgtgtgttgtggtccatgaatgtgcaactcttcctagctcttcaaatgcaggcacatagtgagaaaagctgcctgactcatgaagtcattgctgtttttaggggcgccctcaccctaaatgcatcctcatctcccacgctgtgcaggccaatctgcacagaagtcattacagggagtttcaagaaattgcaccttagtcaactctgtgtccactatgctctcgtgaagatggccctcctggctgggctattcctctgtacctctgtcctgaagcagtgaccactgtgagagctgagcatgtttttgagggattaagaaccagaggaagctgttgtttttcattattattattattattattattattattattttgagacagagtctcgctctgtcaccaggctggagtgcagtggcacaatcttggctcaccgtaacttcagcttcccaggttcaagcaattctccctgccttagactcctcagtagctgggattacaggtgcccaccaccatgcctggctaatttttgtatatttggtagaaacggggtttcgtcatgttggccaggctggtcttgaacttctgacctcaggtgatccacccgccttggcctccgaagtggtgggaatacacacgtgcgccaccacacctggctgcgtttttcttatttttgttcctcttctttgcctcaatacctcaggttgctgagctggggagattttgagtgacagactcagtattctctcaaaatccccctctctcacatcgctgaggccctgtcctggaaactctccaaaagtggatggtctccctataggatgggagcttccaaaatggctccacagggaagagttaacctgagttcattccttcctcctcattgacatccagcatttgtaatttccatggccatcaatactactatagctgaaatcttcattaatctactaaaggtgagagtgaatttcatacatattcaaacattagtttcatccaacatttaaattttatgagtcaattggtaaacatagccatgattacatgtagtttaggcttcataaactttgattaaatggattttatttaaaacaatgtaatcattttactatatgtgtatcctacctatatcaacatgttgttacttgaaatatccacaagaaactatatttcaaaaaccaaattgtatttattgtctattgttacataaaaattgctccctaatagttagcatattaagagaacacgtgtttgtgatcttgtcactttggtgcatctggaattgagagcagcttagttttgtggttctggccctgggttggtcatgaagtcgcagccaagctgtcaggccaggctgcattcagaggccagagcaggtggccaggcccagcctgaggggcttccactgtccctaacctgtttggctgattggaaaactcagcggaaaaggagagagtgaagtgtaaggtgcctgtcctggtcccccatgtcaaagaccattccatacatgcaccatttcttattctttcctgcaacatcctaggcatagagcactgcccattcattctaaggctgtagagtattccacagtagaattttagccatgcaacctctaatggttaacaccatgattttgatcttacaaataacactgcagcaagcatccttatgccgactcctttgagttattgtgtgcatatgatcataggataaattttcagaagtggaattactgggtcaaaatgatgtgcatttgtaatgtttacccattgttttcacatgtttcaccagtttacaatgccagccctaaatattgattggaattcattggtgaaagtgcaaatttttgccaacctatcagatataaaaaagttaccttgttacacttttatttttgatttctcctattgtgcttgaagttgagcatttgctcaaatgtttcagtgctcattactttttaaaattcggtaaactttttcttaaatgtataaataagaagtattttagtctttgccacacaggagtcaactttggggatactatgtaggtactgacagcaccatctgcaatgtaaacattaaaatatataaaaaccattttaacccattaaccatccccagataatagctgatttcttattagaagtaatgcaagccagagtcagtggagttatatttagaaaatattaaatgaaaaaacttactacccaaagcaatctacaaactcaatgcaattcctttcaaaataccaatgacattattcacagaaatttaaaaaaacctctaaaattggtataaaaccaagaaagatcctgaatagccaaagcaatactgagcaaaatgaacacagctaaagatgtcacactactagaattaaaatatactacaaactatagtaaccaaaacaggaaggtaggtattggcaatcagacactgagaccaatataacagaatagacaacccagaaataaacccatctatcatatagagccaatcgattttcaacaaagatgccaagaacatacactgagaaaatggcacaattttcaataaatggttctgagaaaactggatatccatgtacggaacaatgaaactagacacttatccccctccatataaaaaatcaactaaaaatggattaaagactcaaatataagacccaggctataaaactactagaaaggaacttagagaacattggggaagaacaattctttaggacattgttctagataaaagttgtatggccaagaggcaacaacaaataatagagatatgggacatcattaaactgaaaagctcctgaaaagcaaaggaaacaatcaacagagtaaagacaatgtgtagaatgagagaaaatatttgcaaactactcacctgacaaggacctaatattcagtataagaaaagttaaaaactgaaataactcatcaacaacaacaaaaaaaactaataataccattaaatagtgggccaagaatttgaatagacttttctcaatagaagacatacaaacggccaacaggcatatgagaaaaatgttcaacatcactaatcagcgagggaattaaaatcaaaaccccagtgagatacaatctcaccctagctggaatggctatgatcaaaaagacaaaaaatacaaatgctgatgaagatatgcgacttcatatttttctagtccaattctctgggaacaatgagagtgctctctttgctctccctttagtaactatttttcacatgcaaaaatatgggccctactgggaaataatgcctaagaccaccaacaccttaactgtttgttcatcacactagaaatgaaactgttttccaaataatattaacatctatctgtgtctatcaccattgtgtcaatgtttgtgtgatcctataaagtttagaaggcctagaagaatgcccttgctttttgcaatacaaaaatggcctaacagatatagatgacatagatatagatatagatatagatgatatagatatagatatagatgatatagatatagatatagatagatagggggttgtatcttggaatttgtttctctaagggacttatttcacatctaatttgaaattattctggttttaaacattatagaatgataacacaattggtgaaccaatcattctgtgttgaggttaacagtatttttttacttcaattctcactgaatgagagcagtttttatacggaggggccatgccataacaatatcacatactggggttgttctcagactgtgaggttctgcctacaccaagccaggatgagaattttatttgtcaaactgctctctccacttgtttgtatcccataatataccccaaaaatgagcataatttcattttttatgctgtttgttcttacatttaatacatgtaccaaaaagttgtctttgtttttaaaataaaattttatgctatcttttaatctatgtccctatagaaaaatcatgatccatacacatttgttatcacagaaagaacaagataaatttcctctctctctcataaatgccatgaccgctgctttttgggattatttttcttaaattattttttaaacagaaattcatataacttaccttaatcaaatttcttttcaaagtaatcacatttcttttatgtgaaaaattatttaccttcttttatcaaaaattatcttaatacaaaatatgtattgttttacttttagaagaaatggaaactatctacacattactaatctaaaaatacatgctctgggtttatatggtgttaacatgtcttccaaattttaaggaataggtatttaaatgtcatgcactttgtttttaaatttagaaaatgtttcaaccttttgcctgggcatggtggctcatgcctagaatccctgcactttgggaggccaaggtgggaagatcacctgagctcaagaccagcctgtgcaatatggcgaaaccccatctctacaaaaaatttcaaaaattggccaggcatggtggcaccacccacaatcccagctactcgagaggctaagatgggaggattgctggagccggagaagttgaggctacagaaggtaaactgttgaggctaaaacatggtaaatatttaattgttcacttaaaagaaatgttggttacattgaaaagaaatttggttaacgtaagttagataaatatctgcttaaaaaataatttaagcgagctgttagcactactgcattccagcctggtcaacagagcaaaatctgttgaaagaaagaaaaagaaggagagaagggaagggaagagggaagggaaaggggaaggggaagaggaagacagaggtggagggggaggggtggaggaggaagagggaaggggagagagagagagaaagagacaaagagagaaagaaagacaaagaaagaaggaaagaaagaaagaaagaaagaaagaaagaaagaaagaaagaaagaaagaagaaagagaaagaaaaagaaagaaggaaggaaggaaaaaaagaaggagaaaagaaagggacagaaaaaggaaggaacgacggggaaagaaagaaaaaaagaaaaaatatttcaagcttttcagtagcagagacacttcgtaatcaataagcaacagaaccaaaacaaaaaaaaaaatctacagaacagtctaaatacaattataaacttctgattcggatatcaaaaccatttcaataataaatatatggtatgaaaacctcacaaaggtcaagtagaatgtattatatttgaaagaaattacgagttgagagtaggaaatttataaatttaatcaaacaaataagcattatgaggaagttgtattgctaatgtattatttggcaagctgttcagtggaacaccaagatattcttaaggaagttgcaaatatctttttttttttttttttttttttgagacggagtctcgctctgtcgccccggctggagcccaccaccacgcccagctaattttttgtatttttagtagaaacagggtttcaccgtgttggccaggatggtctcgatctcctgacctcgtgatccacccgcctcggcctcccaaagtgctgggattacaggcgtgagccaccgtgcccggctgcaaatatcttttaagatgttgtcattgaagtggatttaaaagtgaggacatgaatacctttaaaaaatattcagggataaagagagaaaattaaatttagattgtatacatatataaaatgtattttaaaagatcagcttggctgggcgcggtggctcacgcctgtaatcccagcactttgggaggccgaggggggcgcggatcatgaggtcaggagatcgagaccatcctggccaacatggtgaaaccccgtctccactaaaaatacaaaaattagctgggcatggtggcgggcacctgtaatcccagctactggggagggtgaagcaggagaatcgcttgaacccaggaggcggaggctgcagtgagccgagatcgcaccactgcactccagcctggcaatagagtgagactctatcaaaaaataaaaaataaaaaaataagcttgtctctttttattccttaaataaaaggagcagacacttaaattccttgccttttattttaaaatttagaaaatgcttacagcttcccacagtgaaatttatacttagataatctaatcaatggataataatatcaaaacagaattctttgaccaatctattttcttcatttttaagtctaaatgtatactcaaagaaataaaactatttataattgattctgctgtttgaaaatatttactgatcatttaccttgcaccaactgacctccagctctgaagataggtcagtggtaaagtatacaaagttgcccagcttcgttaaacttaaattctaatgaggaaaaaagaagtaattaatcagggactttaaaacaggagtgttgtgatatggcttggaattctaattgcttcctgtgcttgctgtgtggagactggattgaaaaatagggcgatgataggagcttaaattcatacagaatatggctagcctgtattttgagggcccctgaaataagaatgtatagtagttctcattatttcctcaagaaatctctgcagtagagctttggccttgggagggaagtactatagtcaccaagtggtgagggtgggaaggtgaatttgcaaataccatttggaatgagttcactttaaaggtaaagctggcaggattttcatacatgtcagatctgaaaatctgtgtgtgcgtgtgtgtgtgtgtgatagagagagagaaagagagagaattagaacaagacagatacagacagacaatgacagagctgcagagacagagagaattaaatggggacaccaagaatattgagctgagaaactataaaatgggaggtgccattaaacagaatggggaagagcagttttggggagtgtcagtggctccacgtagacttattaattttgagattcctaaaccacatccaagtggagaagacagacagtattgtgtgtagtctagtgttatggtatcatataaaatatcaggaaatgaatgacacaaaaattagtaagaaagcaaagataagaaagataaaagtcccgagcctagtggttatctactgcctaaaaagtagtaggctgggcatggtggctcaggcctgtaattccagcactttgggaggccaagttgggcagatcacctggggttgggagttcaaggccagcctgaccaacatggagacacctcgtctctactaaaaatacaaaattagccaggcatggtggcgcatgcctgtaatactcaggaggctgaggcaagagaattgcttgaacccaggaggtggaggttgcagtgagtcgagatcgaatcattgctctccagcctgggcaaccagagcaaaacttggtctcaaacaaaaaaaaaaaagaaaagaaaagaaaagaaaagaaaaagaaaattagcaaagatgagaagaaaccagcaaaaagtactaggtataattatcaaaaatgtcaagaggaaagtaggttaagtgttctagaattctatcaaagaaagttttgaaaaaaaagagggagagatcaactgcattaaatgctgctaatacataaattaagcaaaggctgaggaattacgcttcaattcatcatttaacaatatggataccatttgtgctttgataagagcaattttcttggaatgagtaggtgagaaaccatattggagtggtttctcaaaggaatgcctgatctctgggttcttaaggaaactttttattgaacaggggaggcacaaattggattagttttaattccggggtccggacacactctaaacatgtgcctctgcatgcctcgctttttaaagctaggtatcctattatctttcgataacaaaataatcacctgcaaaaccaacacacatttaatggacacacttgtaaagtgtgtactagaggttgttggagaggatgtgattccacgtgatagcttacgagtcactgatgggcaggtaagctggtaaaatatctttggaaaactcaccatacctgttatacttaaatattcagataccaaacagcagaaaatccatattgtaatatatttccatgagaaaaaacaagagctctgtattaaaatattgattattattaaaaataatcccactgggtttcctgacttttttattagcaagtcagtctccgcctgttttcagtagtacaacctctatttaacaaatgttttgtatttttaatcagccacttagaaaaaatattatattttatatcaattctacgttcagtgccaaaaccagtgttttgtacattccacagaattatttgttgaataaataatgaataacttaaataagttatagtatccatatataaataatatatcatctccgaatacagtgataacatttgttatgtagaaaatgatttcaatctcagttaaaaatattttgggcataggagttactgtcatataaagattctcacattgttttgtttatatgaaaatgtttgcagttaacgtacatttttggtacctaaggcttttgctcttgctgccatagcaaacagtgtgcctattaagaacacgaacctgagttttatttcattttaacagatttcttaataaaatatatgccaccttatttggtttaatacataagcaaagagccatccactccaccattgccccttgtccctcctccaatgcagctccttaagatgttactgatagcagaggactttgtgttcaacctaagcactttatagcccttttattttcaactaggtatgaggtaaaataattcagcaccaataaaacaaacactctttaaacaatgaccctttttcttagcctgttcaacaaaacgcagcaagacagagtacacttctctttcccagcaaatcagtgttgccactacattctctacgttctgaaaacttgtattattgactttcttacaaacaccctttgagcttataatttagatgtcatcaaataatgtacaaaaacacgctacttcctcccccttctcttctcttcttaccagactattgtcagtttgcttttctatccaactcctttcttctgtctacttgatttttaaaagactttctacatatttactatcttggtattgtagagaccaactatgtggtcaaactacacatataggaagaactgaattatatgcaagcatttttaaataaacgattcctcctcagttttctgtgattatttcatataatcaaatgtcttccagatacacatcccaaacgagtggttgtcaagctctgctttgttgtctaattttatcagaattatccaaaattcttatgataaatacagatgaattagcataactccagatttatgaaatgaaaatttccagaacccaggaatatgcattgaaaaaatgtattcctcacgtggtgctgatgtgatatgggatctgagtttagaatccaaggaaaattaccctccttgccctctagttggccagaattacctagttgaccagagttgctctcttgttatctagaggtcctcttcccttttcacattctgctctctctccttctgtaccttcctcctctcctccctccacttctgctcatccagatcccaagcccttctccattgattctcctaaaactccaaatggtcagttgccactaaagtccctctgtcccatgaacaagatttgtgggcaaatgtagaatttaagcttggacagagctgaatcagagctgcaattaaagatttccctaaacccagcagggaccagcaaatacttatagaagattagagatttcttgtgagtgcaaagggctcagagtgacctgatgctatagaccaaatcttatggtcccctcaaattcatgtgttaaaatctaattccccatatgatgggatttggaggtgaggccttggaaggtgattagatcatgaaagcagagactgtatgaatgggatcagtgtccctatcaaagggactgctgagagctccctcatctcttctgtcatgtgaggacacagtaaaaagatggcagtctatgaacaaggaaggaagccctcatcagacacgaaacctgctgacgagttgaccttggattttaccatctccagaagcatgagaaatgaatttgtttctctgctacctagtgcagtgcattatcttttggcacccagattggctacagtaccaacatatcaacttgtacacgtaatttttgaaattctgatgccaaatctttgatggcaacaggtgattgatctgctggaggaatggactgacatgatccctctttccacaataaaccagagagtaaaaacaagcaaaagtaggtcaaggtcttctaaaagccgtacctgaaaggtttccagtaacagttgattagatggtaattcaatcacacaaacaaccacggcaaagatacacaactatcagacattttcagaatagcctctaaaacaacatctgacaacattagggagttaaagaaggcacgaactttcaaaaagtcaaactttatttaaatgttattgtagaaacttgtaattttaacactatggatgaattctagggcaggtggtggcatggcatggcgatttgggggcacaagtgctgagttttgaagcttcggttttgataccctttggagatgccccctggcctccacacccctgcccacctgtcaagaagagcctgtcctgggcagcacctcagggacaaacagcccagaagcccagttgagggcagacctccaaggttggaggaagaagccgcctctgggagcaggaggagctgctggatcccctcctcccaggtttcttttcctgccccccagcgcctcttgcaggcaggcaaacaaccccagcaggagcagcagcaggcccttcagccgcagggctgcagctctgctgaatgagagaagcctctctctggcgagtcagaggagcgcaggccatatacccgggtctctacctccatgtctcccactgtgcccaggactgagcccagcgtgggagatgcgggctggggccgtgctggccaccccctctcttccacctcttgctccagccatgctttcagctccagggctgaggccagtggctagagcagatctcatgatgtcaggtagctcctcactgggctggtccttggcaggaccaggacaggggcaggagggatctggagctgctgatagctccagttctgtccctgaaggggggtcttcccctggtgctggcactggctcatcagctggcgctggaatttcctgtgttgctgcacatggaacaggagatgaaaaagaagaaagactcaccaacgtcagtcactttccactggaattttcacacacagaatcaacctcgctgaatgtaaggtattccagcccgaaaacactgcccctgcaaaggctcatagactataggccacctcaccgtgtgcctgtgcctcgatgaactccagaggctccagctggacaagaacaatgtgcagatgtggccgcgatgggatcaccggtggggcctggcctggtagggcctgccctgggctgccctgtggtacttgggggcgcctttgcccaaatggccagaggcgcctggagtgagagatgagtgaggtattgcccctcacaagagggcattagctgcggggatccgcccacagaccctgacccaaatgacggatgaataaaacgtacactgacacagagttattctgctttgccagtcctgctgagtgtcccactgcctgcacaccaagagaggtttgtcactgcagctggccgtgaatagctcgcactgcaggcatttatttagtatagaatttacaacggaagctttgagtaaatactcttgtggataattaacatggttaagagagtagttctaccaatgattaaagctcaggtaccatggtttaaagtaaataccactgggggcaatttcccgggtctacctcccccctcctccccaagaggactatctggctcaaaggctagttaatggaagtagggtaaacagacttaactggggaagcctctattgtccctaacatttaccctatgagctaatgctctaagataagaagcagctgccttcagcctgttcaattattacaagctatgtaacctttccgccttccaaaaggtttgtgactattccctgtaactttccctaatatttccctttaatatttctgccaccatcctgagtgaatcccaatagatgagcctgcgtcagcattgtgggaaaaggctctcgctctgggccctcctgaagcaggagactcgagatgtgggaatgcagcatgagaacatcttgctctcctgagcatctcccaccaagggagctggctgcgggtctgtccctaggatgtgggtgcctgattaccagagttctaagttctgttagagtccatcaccaaggaagtgaagtcacttctttaaggttccgtaccctcggctccttccttcaaaacctactcagaaccccctgggctgctggctgctcaccctccccccaggtcagctccttacctgtacacaggtaagtccacccagtgtctgcttgtacacctgtgcctgatgtgcacctggggcctgggaatccacttagggcctgtgatccaacaggggcctaatgttgattaaaactaattttgattattcctatggagaaggaaaggccttctagcaataagaagcagagttccaaatcaaatacgtaaaaatgatcaaaaccttgtaaaagaaaagtatcttaattttaatcactgaaatgttaactttttgataaatatttaaggttataatgaaaaataaaacaatactaataaaataacagttgcaggaaatgctattgagtttcttgtttgtggtttgaacactgaaaggtcccacctagttatggtcataatttcctaccttaatcttcttgttcttatgagtaatagaaaaaaacacaatgacgatgaatgtgatgatggttcaaatacacaactgaagtttagtggcagaaacatcaggtgctcccaattacagtgcagctgttcttactgaggtgagaaaaaaaatcttgttttcaatacacacgggaagcaggagtgcacgcggatatgaccgcatttctctgaacttatgtttttcacagaagagctacagtttatcctgcattctccgttctgtgatcaaaaaccatggaacagagaagagcatttcaacctgagactcaattataagaattgcgtctgccccacctccctgcaaccatatatgccacctctctgtgctgagcctgaggggttcacatatggcacagactgaggctggactcaacagtccttaccctcgcaggtgacaggcgttctggggtcacttggaggagggaagctcctgggctctgtcttctccaccagcagggggcagcacagctgcagacagaagagaggctgaggctgcccagaaggagcctaagagggaggccagccatgaaggctcaaaaggtgtccaaggatcagtcctcaatttggaagtccagtaaagtgcatcctatcccctcgggctgcagtaactccgtcctgactgtaagactcatgcagcgtcactcagggcactgacaggagcccagggacagtgagagcctcacctgggaaatgtagctggaggcgcctgggccccggtgtcagcctggggagcttccacagggctgggattccctgggagacgccccgaggtcaaggtgctctaggagggggccacagtgtgagaggacagggtttccagggcccaagcccttcacctagtattgctgcctgagcctcctgccactctcatggtcttgtccctctctgatcagcagcattctggggagctgagccctcagtcctgggcacttccagagacctccccccgccaccccttctccctctgcctttccttccagctccaggcatactgtgactcagggggcagctcctgtgctcaggggagtctcacgtgggtggggtggtgcactcaggaccctggctccaggatgtggcatttccagcctccttgaggagatgctctccacagggaaggggattctcacctgcctcaggccagagctctggccacgaggctgtccttggctcagggacaggatacacctcattgcaggaaccaaggaccacccaccctgcagaccccacaccctgtccaaaggctgtgtccctgggatgcttacagcgaccatggggcttaaagttgaatttcccatcaatatttcatgtaaacttgcaaaaagcacaagaaaaccacactgggctgagaactctggtgctattttgctgttttttacaagtttacataaaatattgattggaaaaataaacaatggcagagctgaggatggcaatggctggtctactgtggggatggggatggcctagaagtatcagccccatgggtgaaatgagaccagacgtcctgatgactccacatgggtgagtggttccttaaatgactcaactattctcactgaaatagttaactagtgtcctaatgacacaatccatcatttagatgaaatgaccaggatgggacatttcctccagccaggaagactgtggacaaattcatgaactgggctggcccagttcacctgggtctgagaccccctggatctgagtccctccagccctccaggcaggctctgaagagggggcgtcaagagtggatttagacttaggtgaccaggatgtattggggtttgaggactcagctgtgacttagggaaatggggcctgattgaatcatcagactgaggtagacatccatcagctgggctctggatttccattggtcatgacaagccagtccttggcctgaatatcctggatcagtccccagaactgcccagctcaggctcaagtcattctctacagaaaaaccagtggagtggacactgtaggatctgcccagattctttcttctgagctcacccacccagcactgctgggagcttgtggcagctgagagctgtgcctttcctgggaagtgtggctcagcgcagaaaactgcctcctccaggtttatgcccttcctcagcaagattaggtttcatgactgcctgaggccaagttctcaagactctgcctcaatataggaggaaatgaaaatcctcccagctccacagctccctgtaggaaagactgagacctcaatgtgcgtcagggtctctttccgcccagtgttgcctccctcacatcctctgtgcatgaattcctcatctcagagtctgcttccagggaacccaaattaagatcaccagccatccccaacatgggccatgcggaacctcaggaggccactgcacactggaaagcgcccatttattcctaaattagcactgtgagtatccaaatgcccaatgagatctgagtgtttcttgcatttgtatggaatggaaagggagcctgacttgccaggtgctctgggtctgagggagagttggagtcagatctccctgcagggaaacccgggacaggaggagaagcctcaccccatgcagggaccacagatgcacccacagggtgagctgcaggatggacactgcccacagggtgagctgcaggatggacactgcccacctccaccctccatgccctgtagaaaaaatcattctttccacccctccttcagcctatcaaagttgacacttaaaaagccaccacaccccacccttgtcaacaggaaacccattcacatctccatcagccacacaatctccaagattcttcaaaaaataataacactagctatgcaaagtatatgatatatatcataaataattgtacctagattatatatgaaaatgatactttttgatatgctaggtaaataaaatatattatttaaactcattgacttcttctctttgtatttataatgcgatgactagacagtgggattcccatgaggctcacatcatattgtgattgaacaaggctggtctgcagggcttcaggttacaggggctgtggagtgacctggtgcaggaaaccccgtctccatccataggacatcagtgtgaacccagggagaggcgctggtatgagagatgagaacacaggtgtgaaccacctgcttgtgcaggggactgagccttcactttgagccaaagaagtttcttttcctatcttcaatcctgaacaagagggctttctggacttctttttgttttcagatttgtgccccttcaggtttggggctgtctggagtcccagccagaggacagtgaggaaatccaggagtctcacactgactctgttatatttcatctgctggggccatcccaaactgctgtgtaccatttcctttcctggtgctcaaatagctgctccattcacctgtcatggtttcagagatgaatctaggtgggaagacaggacagtgtatgttataatatttaaatggaagctgattccattaatatttattttaatatgaaacattaaaagaattttgttataggctatagggaaagatgaaaagagattaaaagtattttgaaaaaatgtatttatcgaatgtctgtgtgtcttcagtgttgcagggttgagagaggtcagctttaggttggatgtgctcagatgaggaaaagcaagaaagcaggaaacacgcggctctgtgacctgacacataaatcacagtaaaatggaaataaatctttcaataaatgaaacattcaaaataaacgtcactctggtgcacacagaaaggcctattagcaaactttccctttgtcctgctggctcatatccccatggatcacctgtgtgcagagtggacactgtagtccccatttctcaggctgagaactagaggctgggaaggacaagtcacctgcttgtgagtgggaggggcaggattgggagcagtggactcgggctcaggactgcggccctggtcggtgctctgtgttccctccacaggatccctcccacatgtgcccgtgtggatgtgggtgcactgcctggggtggctgatgtgctccagggattcgatggtgcagatgcttcagcacaaagcttgggggtggggatgggatgaggctgcagctggggagaccagggaccaatgccacccagcagaggtttccacggggtgggcagccccatttcctggcagtagagacagcctggaggtgggtgccaagcagagggcactgcagggtgtgcccaggcctggagggtcacaaagacacaggcaccacacagcagagtcactgaggaccagaagctcactcaggtaagggatttcagcagaactttctctcctgagcaaatcaggtacaaaaaaattaagatcctgccatcagaaaagacaaacaagaactttttatctcctcagctgagccccactgtccagggaagcagaagtctctgagcccagcccaggtgagggtggggtgaggagaggagctcagggtggagatttgcatggaggccccaccctcctctgaggcagaggggataagacagggctgggggcaggcccagtgctggggtctcaggaggcagcactctcgggacgtctccaccatggcctgggctctgctcctcctcagcctcctcactcagggcacaggtgacacctccagggaaagggtcacaggggtctctgggctgatccttggtctcctgctcctcaggctcacctgggcccagcactgactcactagagtgtgtttctccctctttccaggatcctgggctcagtctgccctgactcagcctcgctcagtgtccgggtctcctggacagtcagtcaccatctcctgcactggaaccagcagtgatgttggtggttataactatgtctcctggtaccaacagcacccaggcaaagcccccaaactcatgatttatgatgtcagtaagcggccctcaggggtccctgatcgcttctctggctccaagtctggcaacacggcctccctgaccatctctgggctccaggctgaggatgaggctgattattactgctgctcatatgcaggcagctacactttccacagtggtccaagttcctggggaactgagaccaaaacccaccctgggctctcaggctcccttttgctctgaagatgcttcctcaccctgtgcaaggggcttcctgcagcacggccttgagaattcttctctctcagctcctctcctttcccaccatgaaatccaacaggaaacctgccctgtggtttctcatcccggacagggacagcttcctggtgcttgtgtgctgtggtccctgaatgtgcagctcttcccagctcttcaaatgcagggacagtgacaagcagctgcctgattggtgcagtcactgcttttttttcagagatgtcttcaccctacatgcatcaccatctcccacactgtgggtagaattttagccaaatatggctgggcgcagtggctcacacctgtaatcccagcactttgggaggccaaggctggcagatcatgaggtcaggagatcgagaccatcctggctaatacggtgaaaccccatctctattaaaaatacaaaaaattaaccgggcacggtggcgggcgcctgtagtcccagctacttgggaggctgaggcaggagaatggcatgaacccgggaggcggagcttgcagggagccaagattcgtcactgcactccagcctgggtgacagagcaagactccatctcaaaaaaaaaaaaaaaaaaaagaattttagcaactacattctaatagttatcgccacaactttgatcttaaataacagtgcagtgaacatccctatgcagcctcctttgagttcctgtgtgaatatgaccataggatacatttctaaaactgaaattgcgggtcagaaagatgtgtgtttgtaattttcacccattgttgtcagattcccctccagaggggttctaccaacttacaatgccaaccataagtatttgttcagagtacattgttgaaagtgtaaatttttgccaacctaccagactgaaaaatgttatcttgttacagttttatttttgagtctcccattctgcttaaggttgggccttttcacaaatagttcagtactctttatttttttagtatttggtaaactttttcttgaatatccaaataagaagaattttagtctttgtggcaaggcacagtgggtcatgcctgtaatcccagcagtttggaaggcttagacacgtaaattgcttgagcccaggagttcgagattagcctgggcaacatagtgaaccctcatctctattacattaaagaaaataaacataaattttaaaatgaagtattttagtctttgtggcccacgaatcaactttggggatattacataggtacttacagcaccatttataaagtaaccatttaaaatgataaaaaccactgtcagctctgggccacacaaaaacaggtgtcaggccagttctggcagggtgagggctactatggtgggaaagggaaatggaagccagtagagcttctcctacctagaaaaatagtaaatcaaaaacagtgtcatatccctggagggattgcagagattagtgccaccatcaaggacttgaaagacacagaggtggtgatcagcaccacatccctgttcaactctcccagttggcctgtgcagaagacagatggatcttggagagtgacaatggattatcataagcttaaccaaatggtgacttcaattgcagctgctgtaccagatgtggtttcattgctcaatcaaattaacacatctcctggtagctggtatgcagccattgacttggcaaatgcctttttctccattccggtccattaggcccaccagaagcaatttgccttcaactggcaaagccagcaatatacctttactgtcctacctcagagatttatcaactctccagctttgtgtcataatcttgttttttttttcttttgagacagagtctcgctctgtcaccaggctggagtgcagtggtgcaatctcagctcactgcaacctctgcctcctggattcaagcaattctcctgcctcaacctcctcagtagctggggctacacgcgcgcaccaccacgcccagctaatttttgtaattttagtagagacggggtttcaccatgttggccaggatggtcccaatctcttgacctcgtgatctgaacgcttctgcctcccaaagtgctgggattacagacctgagccaccatgcccagccctttgtgtcataatcttattcaaagagatcttgatcacttttcacttctgcaagatagcacactcgtccattacattgatgacattattggattggattcagtgagcaagaattcacaaacacaatggacttatcggtgagacatttgcatgccagagaatttgaaataaatctgactaaaattcagggaccttctacctcagtaaaatttctacgggccaagtggtgtggggcctgttgagatattccttctaaggtaaaggatacgttcctgcatttggctcctcctacaaccaagaaagaggcgcaacgcctagtgggcctatttggattttggaagcaacacattcctcatttggttgtgttactctggcccatttattgaatgaccctaaaggctgccagttttgagtgggttccagaagaagagaaagctctacaacaggtccaggctgctgtgcaagctgctctgccacttgggccatataacccagcagatccaatggtgcttgaggtgtcagtggcagatagcaatgctgtttggagcctttggcaagctcccataggtgaatcacagtgcggtcctccaggattttggagcaaggccctgccatcctctacagataactactctgcttttgagagacagctgttggcctgttactgggctttggtggtaactgaacattgactatgagtcataaagtcaccatgggacctgaactgcctgtcatgaactgggttctttctgatcaatgtagccataaaatgggtcatgcacagcagcattccatcatcaaatggaagtggtatatacatcatcaggctcgagtaggccctgaaggcacaagaaaattacatgaagaagtggctcaaatgcccatggtctccactcttcccccctgctttctctcccccagcctgcaccgatggcctcatggggagttccctatgatcagctgacagaggaagagaagactagggcctggatcacagatggttctgcaagatatgcaggcaccacctgaaagtggacagctgtagcactaaagcccctttctagaacatccctgaagaacagcggggaagggaaatcttctccgtggacagaactttgagccgtgccactgggtgtgcactttgcatggaaggattttagccaactacattctaaaggttattgccacaactttgatcttaaataacagtgcagcgaacatccctgcatccctgcatggaaggaatgccatttcccataaatcaccaaatcactcagaatgactacgcataagcccttaatatacgccagatgcattggttattgttttacaagcgggacctcaagaagactttcataatacggaataggatgatgcaaagccctatgctcaaggcccgatctttactagaaaactagtattgggaggttacatgttttccccaaacagatctttgaggaatcccgcagatgccaaagacctgctggcctaagagtagacacttattttctcacagttctgaagctggagagccaagataaaggtgtttataggtttggtttcccctgaggcctctctccttggcttgcaggttgctgcctccttgctgtgtcctcacatggtctttcctctgcacactcatttctggtgtctcacttctgcgaatgcaaatttttattagcctgggttaataatttttatatcagcctggcagattctatcactgatttacttgattatcctatttacttgattattaaactccttctctgctgaggtcacccattggtgagcactcgcatgggatacaaatatcttcacagtttttgatcactcagagggatccatccacatagctcttccccaaatttctttgtcatcaattttccaatcatgcttcttccaagtccctgatcatccaaccaaaccattggctacagcctatgaatcagtataaaattgcatatctggacatttctccttccaggcagtgctgagaaaagtggacatccacatgcagaacaatgaaactggacccatctctctccaaataaaaaatcagcccaacaaggattacaaacctaaggataagacctgaagctataaaacaactagaagggaacatagataaaattcttcaggaccttgggatacacaaaaatttttatgactaagacttcaaaagaacagacaacaaaaataaaaatagacaaatgggagtttattcaactaaaatgcttctgcaaagcaaacaacagattgaagacacccttagaatgggagaaagtattcatgtgaataggtcctaatatcctgttcatctgaaaaggcataatatccagtgtaagaatagaggacaaggctctaaaataactgattagcattaaaaaaaaaaaaagtgggcaaaggacctgaatagacttttctctaaagaagacatacaaatggcaaacaggtatgtgaaaaaatgcttaaggtgactaataatcagggaaatgctaactaaaacccaaatgagatatcatctcaccgctgctggaatgactatcatcaaaacataacaaggctaggcgcggtggctcacgcctgtaatcccagcagtttgggaggccgaggcgggcggatcaagtggtcaggagatcgagaccatcctggctaacatggtgaaaccccatctctactaaaaatacaaaaaattagctgggcatggtggtgggcacctgtagtcccagctacttgggaggctgaggcagaagaatggcatgaacccgggaggtggagcttgcagtgagccaagatcgcaccactgcactccagcctgggcgacagagcgagactccgtctcaagaaaaaacctaacaaacacccgtgacgatgaagagaaaatagaagaaaaaatcacatgactgtctcaacagtcagatcaaatgttttctttcaaggaaacatttttgttggttgttttttctagtcttgttagagcatcacgcatgataagatttgtggtacagaagttagaggggatgttgttccatgcaaaatatctgaatatcccatacccaactcttcggttacttactgataaatgctaaaaggttacaattttgtattttcaaatattctggtggccagaaacctcttccttgacaagtctggagtacaggtatctgactccagatgattagaatttaggcaggtattgtgtgagcagtgaggtcacacacaggaaacgttccagtcaaagagaaaaacagacggaggctgaaacacagagatcatatgtctgagaaataaggaaattccatactaatgggagctgagtgagaacaagatatgaaccatctatttctctctgaatatctcattgggatcttgtccctttcccagcataccactcatgtggattttaaaattgtctgctcttaaaacatttcttgcacatcattagagagtccagcactggaatcaagctcagtttgatgagaccagggcagttaagcaccaaacccaggtgttcttagaagggcttgtagaagacaaaggtgtgttgtcaaaagcagagaaagtgagactttccattgtggtttaaaccacagcttctggaatttcattgggcacacaaatcccctgaggattctggttaagatacagctgtgccctcagcacatctgggtatggccccagattctccatgtctagcagcttccaggtgaggctgatgctgctggtcctccaaggacattttgagtggcttagctcctattcaccctcctcacgcaggcacaggtaagactcacctaatgaagaaacctgagaagcacaggtgaactctccctcccctcctggtgtcttagtaccttttgtgttgctataaaggaatacctgaagctggatagtttgtaaagaaaaaaaagggtttattggggtcatgcttctgatggctggaaagatcaagattgggtatctgcgtctagtgagggcctcaggctgtctccactcatgatagaaggtgaagggaagccggtctgtgcagagatcactgggagagagaaagcaagctttttttcctaacaaagctgcagggatgtaattgagtcatattcataaagtgctcaatacagggcgtaacatattcaagtgctccttagtggacagcaattattactgaccttgctcatgaaaattagacctcagatggaggaaaggcagtgccgagggttttagattgttcgaaataagagagattaaaatgatttaaaatagaggcccaggagctgaggcaagcatccccaggtgttctcctgccaactccccccatgtctcagaagctgttttcaggcaagtcagccagggaggaaagtgggggagtttgtagaaccaaggattgcaacttcatccatgaggaggaggtgtagccagccaggtggggagaggctgctaagctcatctgaaggctgttgaaggctttctggccccatggtcctgggccatccctccctgcccagggccgcattcctcagctgacagccacaaccttgagagaggcctgtgagtctgatcagaaatcctgccagggccccgagggggcaggcatggaagggaggtgtctaaggtcacaggagacactatttgctgcctgtggggctgggacaggctccttgagaggaaattcgggcactgtacgggaggaaaacacaggacagggaggcctctccccaaaggattgtgatgatagagaccaaagcatctgcaaagagcccagccctacaggggattctctgaacacagcattcctcggggcgtctgtgttattttgccagggttaccataataaagtagcacagactggatgctcagagaaaagaaatgtcttctccactaatctgtaggtgatgttagaatctgagatcaaggtgttggcagggttggtttcttctgaggctgagcgagggcctgttctgtgcatctccctggcttcaggtgcttctggaaggatgtgctgttccctgaattacagacaaacaccccaatctctgcctccatgttcatatggcattttccctatgtgtgtctctgaccatgtttcctcggttttttgtttgtttgttttttgctgttgttgttttgttttgagatcgaatctcgctctgtcgcccaggctggagtgcagtggcatgaccttggctcactgcaacctctgcctcccaggttcaagtgattctcctgcctcagcctcccaagtagctgggattacagatgcctgccaccaccttcagctaattttcatatttttagtaaagatggggtttcatcaggttggccaggttggtctcgaattcctgacctcaggtgatccacctgcctcagcctcccaaagtgctgggattacaagcctgagccactgcattcagccatttcccccttttataacaacaccgctcctgttggattgggagcccactctacttcagtatgatgtcatgttaacccattacatctgtaaccaccccattcccatataagatcccattttgaggttctggggctgaggacttcaatatcaattcggcgggggggagcctacaatgtaaatttgtaacattgtctctgtcatgggccagctgtcaatattccctgaatatccaggatccacccatgctctctggccatcaccagagtgagcaaatccctgacacatggataagagttgcttccatgggctcccagccaggctggaaattcttgattcatggaatcaagaatctttctccagtgggtggggctaaatgcagctgcctccctgacagtctccctgggacactaggcttatcagcttttctcctaaagctgcaggtcctgactgtcctgagccccagctctgctgtggtctttgcatcttaagatcttattcaactcgcttttgtgcctcagtggactgacttacaggaaaacagtgggagatgcccctgctctctctccccagggtctcctcccctcagtggcacaagacctgccctattgactggcagtccccccatgcccatctcaacctccacactgcccactgtgcacggtcacaggtcacaaactgattgttcactttgggcagatcaccttgacagtttctgcagaactgggtgcttcttcccagaatcaggaatttacaaacaaggccagttctagagatgcaactgggagagtaatgtgcatcacagcgaatctggacaagacaaagtggttttgctgtagttctcctggaacacattctggtgatgtgtccatctcccaggatagtcttagcaagttacatccaatgctgcatcaggacccacaagaaaaggaactggcctgcatgagtggccggcagggtcctgggaggagaccctgagatgcccagtgacaggaggagtggattcttaggttggtaagcgtgtggaggaactgcgagtgatgtgctcagccaggtacaggagcaggcgtattggtgacctgtggcctcatcttatctcagttgtctctttagaccaaactccaggaaatcagcacatagagacttctgtctgtctccgagatcatcgcaggacttcacacgtcttttctatttataatacaacatcatgttgtgattgaattactttcatcacagcctcaacagtcctaggtctgaaaactaatacatatacttagaatattaattaaggaatactttcttgtcaattatgtttattaaattaaaagacttcagtatctagtgttacagctgtcctaattcaacagccttgaccttcttagaaataaaatcctgatcccaaatttttctggggatatgactggcacaaggagccaagcagacatctggatgtcccagtgtcactgctgacatgtgcttttttgttatctgtcatggggtgaacagaggaagtgtccctacctctgtccacagaacccatcaaagacagtgcacctgattaaagaagagagggttgtgatcagaggggtccggggtcctgggatgaggtgggaggaggagactcatgggaagaaaggaagcagggcaggaagaagctgaagttcaggctctgaggtgcatctcctgcatggaatcttgactccactcacttctgtcattgtgtaatctttcaatgttggttctgtcatcagtaaacttgaggagaggttatgccataagcatagggctgaggaagggttattataaatatccagtcatggttgtgcctataaaacactcaccaaagactctgaatatattaaggtctcataagtagttgttttgcataatctagtgatacatggaggatggcattcctcctgtggacagcaggaggcactgtgggtgtatcgtttggggatgctaatagctccaagtcccccagtagagctcacgtgcaaagggtgtgactgatgtttcctttcaggtccagtctttttgagtacaatccactctccactcctgacacccacttggcccttctcctgcctttgagaaatgactaccctgaggccatcagctccagggctcagctatgagctcagacagacacgcttgggaatagagaacagatttggattcaatgctccttccttcttgagcttcaagaagaggataagataggagctggttgtgtccaggctccactgggcagcctcgatcagagctctcggaagtgcctcccaccacggcctgtgtctccttctacctcctgcccttcatattctccacaggttggagcatccagagaattcagggaaaccctttcactgctatttccccccagcactggtcctcagtggcattctttccagttctcctgtgcattcagcatcattcatgaaattatatgtttccaggtctctgtgctctgtctgtgctgacccagcccccgtctgcatctgcctggctgtgagcctcagccaaggtcacctacaccagtgaatagtatcaacagagaccaaggaggtccccctagtgtataatggaggttaagagtaatggcagcgacagcaaggggaacaggatccccagtcacttattgggctccagccctggggctgaatgctacttaattatcttcaacctccaatctgaggatgaggccgagtatcactgtggagagagccacatgtttgatggtgaggatgggtgagccacagtgacacagaccaagaagtgaggccaaaacataccccctccccttcctcttcaaggactgagagtgagaagccctatgtcatctccattgaccctgagaatgttgactctccccctttcaaatttcatcatcccagatgtcctccctcaagacacccttaggcagaggcagatgcaggccatgattgaggccattttgataagtcatcaatctgtttccaccacaccagcctgtggggactacactgggagagaccagaacagcccaggcaggaaaacggccctgagagaggggtcgggctgagatgactgcatccagtgagtgccattgcaccctgcacccctgcctcaggggactgtcatggggctctgcctgaggaggcaacatggatcttgacatgtccccagccatttatgagaactgtagttgtgtgcatcctcattaacactcaatattattgtcagtttttgtttaaagccactctaatagatctgtagcgattcttattaattttttaacttgtattttcttagcaacatcaggctgagcatcttttcaggtgcttgttatctgtatatcttctttggtgaaaagcttaatcaaatcttggtctatttttaaaattcacttttccccatattccccttcatgcagtatttttcaaaaatggtgaataaatgaaagttttgctgacatttaaaaactcacagaattgttcaccaccagactgttgctattagaagggtaaaggatatccctagacagaaggaaagtgatgtcacattgaaatgtgaatttacacaaaaaagtgaaaacatcaggctgggcccagtggctcatgtctgtaatttcagcactttgggagactgaggcaggagtattgcttgagcacaggagtttgaggctgatgtgaggtatgatcataccactgcagtccagcctgggcaacatattaagaatctgtctctattaaaaaaaaaaaaggaaataaaaaaattaaatatcaggtacagtaactacatagatacttgtgaaaacctctgtattatgttaatgccaataaaatacagttcactgatcaaagataaattaataaaatacattgtgatttataatgaaaataaaggcaaattatatgacaaagacagcacaaaatctgtggtgggtgaagaacatgttatcaaggtctcatatgggaatgtgtaacaactgcaggtagattttcataagatctctatatacataaaccttaaagtagtcattaaatcaaaccttttgatcaaaaaagaattagagcgaataagctacattagggttatccacagaaacaaaattggtaagatatatatgtgtgtataacatacatatgtgtatatacacatgcatgtatgtgagcatatcgagagagagagagaaacttaaaagaagaaattggttcataggattgtcctgtctgacaaggataaaaatctcttgggcaggctgaaggctggaaatgcaggtaagagttgatgttgcgtcctgagcctgaattcagcaatacaggacttaagaaatcctcactctttgctctaaacacctaaacactttcttttttttttttttttttttttgtgagacagagtctcactctgtcacccaggctgggttacagtggtgtgatctcagctcactgcaatcgccacctcccagcttcaagtgattcttgtgcctcatcctcccaggtagctgggattacaggtgtgcaccatcacatccacctaatttttgtatttttagtagagaccggctttctccatgatgaccaggctggtctcgaactcctggcctcaagtgatcctcctgcctccttggcctcccaaagtgctgggattacaggtgtgagccaccaggcctggcctgctctatacactttctactcatgaatgaggcccaccgcattgtgatgagtaatctgcttatacaaagtctactgagttaaatgtgagtcacatctggaaaatatcttcacataaacttctatgtttgtactggacaaaatcaacctggaaccacatcctagtcaatgtgccacttaaaattaaccatcacttaagccggcatgaagatagaaaggaaccattttttaaagcaatcaaaaacagagacagagaaagggaaagaaaaacaaggaacatatccatagattgtattttttaagtcactttttgaggttttctgttgttttcctgttttctatttcattgatatttggctcttaactatattaataccttttctctatttaaattgaatttcaatgctctccttttccttagatttatgaggtagaaccttagtttattttagatcttgcttctttccactgccaaacattcaatccaatagatttatttaaaactacttacttatatctattttttaaattttaatacatttgtttttgtgttttaaaagttcagtattttctaattttgttgtgatttttttctttgacttatgaaatatgtagttttatcttctttcatttccaaaaaattgaagatttaccacagttcatcatgtatcaattccatttaattagttaattctgcattaaatcataccttgcatgagcttcatattttcaaatttgttaacatttgttttgtggcctagaataggaagtatcatgaaaaatgttccctgtgtatttgaaatagcaatgtttattctgctgctgtgggtatagttttctacgaattcaattagcctaagttggctaatagttcaaatatatattcttactgtttttttgtgtatttattttgtaggtctgtgagagagagagctattgaaatgaacaacactaattgtagaatttcccattgcttcttttgagagaggaaaatttccagtcatggttcttaatactttattctcctgacaaaaggtcacctatgattttccaacactaatcaaggaaaaaaaaaaggcagagttaaagccacactcatggatgccacgggagcagtgggtgaccacatgatgtccctccactggttcagtagatttagcgagacattatattttggcttttaaaaatcataaatctggctaagacatccatgaacaaatttgaagacatacacattgaataaaatatgaaaattaaaagaaaggtaactgcatacgtaaaacattgctatcacagcacctgactcatgggaaatggataaaaagtattataaattcaattacatttacttacacattaaacaaatatgaatttaaaccagttcactaaactgtctcatatactgtttaggtgatggagatttattggtgcacaaaaaagacaagaatacctgctctcagagtggcatcatggaagatggtggagtacgaagctccagcaaatggtccctcctgtgaaattacttgaagtggcaagagtcatgacattaactctcataaaacaacagaatcttgtcccacatttgcagtattcagggatgtgccgatgaagagagagacataaaataatctctgtcaggtcaatttctggccatggaaataattgaacagaaactgcatggatcactctgacaaggaagctggtccttaccaaaatattttggaaatgtcaccacgcaattgaataacagcacctttcagcaagcaacatcagccaaggcagagaagagagacaatctgatttcgagagtgacaatatcataacatccaaaatacccagatctcaagaaaagtttacaaagcagacaaacataaaagaaagcaagacccactaaaaggaaagaaataaatcaactgaatgcattcctcaggaagcacaggcattgcacgtgctacacaaacacttcaaatgaactgcccgtatatgctcaaaaagcaaaaggactccatggaaacagaactaaaggaaagcagggaaatgatgtttgaacaagcatgaaatatcaataatgacaagttttataaaggaaccaagcagaaatactgaaactgcaaagttcaatagctgaaatcaaaatctcaccagaggagttaagtagtggtgtgagcagacagaagaataatcggtgaacttgaagatacatcattgaaattccacaggatgagcataaatttttttagaaaagaataaatgaacaaagcctaagagacatatgagacaacatcaagcatatcaatattgctttatgggagtttcagaaagagaagaaaaacaggaaaggaaaaataaaatacataaagaaaaatagctcaaaacttctaagtttgatgaaagattagaatctatactttcgaggagctcaataaactccaagcaagttaaactgaagtctgcagtgagacacattctgatcaaagcatcaaaagccaaatacaaaaggaaaagtgtaaatagtaacaaaaggagagttggggtagctaaagcaatttcagacaatataggcttcaagttaaaaatgcttacaagagacaaagaaaggcgttataattgatgaaataaccaactagtcaagaagacagaataattatgcaccaagggatagcacttcaaagtacataaaggaagaccaatttgaaaaaaaaaatatgtagatctataatataacttggagacttcacttctccacttttactgaccacctaggccgggcatggtggctcacgcctgtaatcccagcactttgggaggctgaggcgggtggatcatgaggttaagagatcgagaccatcctggctaacacagtgaaaccccgtctctactaaaaatacaaaaaaaaaaaaattagctgggcatggtggtgggtgcctgtagtcccagctactcgggaggctgaggcaggagaatggcatggacccaggaggtggagcctgcagtgagcagagatcacaccactgcactccagcctgggcaacagagcaagactccatctccaaaaaaaaaaaaaaaaaaaaaaaaaaaaaaagataataagagaagagacacaaataagtaaaatcagaaatttgggacaatagtacaaagcttatggaaatttaaattataatagaagaacacacaagcaattgtatgccaaatcttagaagatatggacaaattcatagtaaacacagattgccaatctgactcaagaaaaaagagaaaaaaatcaacagaaatatagaaaataagggatgtaaatcagcaatggaaacttccgaaaaaagaaaaactcaaaaccagatggcctcactggtaattctgctaaatgtaaaaaggagttgatatcaaccataatcaatctcttcccaaaacagattaagaggaagtacttcccagcacattcgaagaccctagcattagcctgacaccaaaggcaaacaaggatagtattttaaaaaaactaaactaaaggctaatattccttaagaatgagcatgcaaaaatcctcaacaaaataaaagcaaaccaaatccaacgttaagttaaggggaataaaggatttcaaagatggttctacataagaacatgaatcaacgtaatatatattaacagagtgacagaaaaagtgtatgatcatctgagtagatgcagaaaaagtgtttcacaaaattcacattttcctgattaaaaaaaaaacacacactcagcaaactcggaatagaaggaaacttctacaaactaataaaggacctttatctaaagccacagtgtacatcacattaaatggtggaagagtaaaagcttccctactaagatcagggacaaaacaaggactcctgcctccacaactactatttgacattgtacagaagttttagtcaaagctcttaggcaaagaaagaaataataggtatctagaatggaaatgaaggagtaaaatcatccctatttgcacagaacccgattctaaacgtacaatatcccaaagaatacacgcacagaaaaactaacaaagtgaataaacacattgaaccaagtttcaaggtacaggaacaactggacttgccacaacttttctttgttatcctgggcattagttctcttggcctcaattttatctttaaaactgggaggcttatactgcagttgagaaaaagacacaaaaagaacctgttagttaaagatggaataagtgaatctcagagggtggacataggttggtgaggtcctgtccatctctgggggcatttttctggagtgtgggaaagcatgttcccagatgtgttagcaagatactcgcaattttctcaaaacaacagacaaggatagtgtagaaatcctcccaccacaaattgtgaacagtgtgtgatgaaataaaaataacagtcatagaaaaagatggcgatgatgatgataatgacttaagtacacaactaaggtttagtgatagaaacatcaggtgttcccaaattcaatgcagcttttcttataaaatgggggcaccagtcttagttcccatatatttaggaattgagggtccccatgaggtgtcgctgcatttctctgggcttttatgtttatcacagaagagctacagcttaccctgcactctccagcccgcaatcaaaaatcatggaccaaagaacaacatttcagcacaagactccattatgggaattgaatctgcccaccctcccgaaaccatatacacctttctgtgctgacatgagaaaaccacagtggatcacactggctcaaagtgaggctggactcctttgtccccaacctcccagatgacaggtgctgtggggtcacccggaggagaaaagctctcctaggctcagtcttgtccaccagcaaggggcagcagagctgcagccaggagcagccagaggctggggctgcccaggtggagcctaaggggtaggcagccctgggaggtctacaggtgtccaaggttcagtcctaggattggaagtcaggacagtccatcctattgcttctggttacagcgaccatgttctgagggtcagactcaaacagcatcacccaggacaccgacaggagccggggcacaatgagagcctcacctgggaaatgcagccggaggcacctgggcccagatgtcagcctgggcagctcccacagtgctggaattccctggaagatgccccaaggttgaggtgctctaggagggggcccagtgggagaggatggggctcccagggctcaagtccttcacccaggatggccatctgagcatcctgccactctcggggcctcgcccctccctctccagcagtgtcctggggagctgaaccctgtcccaggcacttccagggacgcctgacccctcctccctctgcctctccttccagctcgagactgactctgactcatggggcagctcctgtgcgcaggggagtctcaggtgggtggggcggcacattcagggccccggttcctgggtggggcttcccgggcctcctagaggagatgctctccagagggaagggggttctcacctgattcaggccagagctctgaccacaaggctgtccttggctcagtgacaagagtctgctgcattgcagagaccagggaccacccaccatccagagctcacactctgtgcaaaggctgtgtccctgggatatttgcagagaccaccgggcctaaagttgaatttcccatcaatatttcatgtaaacttgtaaaaagcaccagaaaaacacactggactgagaaccccgatgcttttctggggccttttacaagtttacacaaaatactcataggaaaaaataaataaataatggaagagctgaggatggcaatggctgatctatgtggggatgggggatggcctaaaaggagcggcaccatggctgaaatgagagcagacgtccagatgatgccacaagggtgtgtggttgcgtaaatgaaccacctactcctactgaaataattaacaagtatcctgacgacacagtacgttatttagatgaaatgaccaggatgggactaagtaatgctgggggacccagagaggagggggaatatggtgggttcttggtccacctgctgctgagtcaggtttcatcaatgatctctcagcagggccaaactcagccccaagccaggtttctagaaggcccgcagccctgctgagcctggcccaggacagaccacaggtcagagaggtttgggacagtggtcatatggccagtccccaggaaggtgactgtgatcacaggcctcagaggtcgaggctaattttctgaccaaagacccaactccttcttcagtcacctgtgctgcccccacagctagtttgagtgacatctttcaatgaggagtcccagaggatagaaatttgcatgaacaccaagcacttactgccccatagggcctgggaaggaataagagaggcctggggagcccagctgtgctgtgggctcaggaggcagagctctgggaatctcaccatggcctggacccctctcctgctccccctcctcactttctgcacaggtgcttctcccaggccctgccccaggctcagtgcccatagaccccaagttggccctgccctgaaccctgtgcaaagcccagacacagtcttagggtaggacccctgggaatgggctcttgatcttcaagccccctctcctgttttccttgcagtctctgaggcctcctatgagctgacacagccaccctcggtgtcagtgtccccaggacaaacggccaggatcacctgctctggagatgcattgccaaaaaaatatgcttattggtaccagcagaagtcaggccaggcccctgtgctggtcatctatgaggacagcaaacgaccctccgggatccctgagagattctctggctccagctcagggacaatggccaccttgactatcagtggggcccaggtggaggatgaagctgactactactgttactcaacagacagcagtggtaatcatagcacagtgacactggcagatggggaagtgagacacaaaccccttcttcatctattttaccctctccctccagccccaggaccgctgtggaccaacccataagcaggtctggcagaattcacctggttaggagatccttaagctgcttttccctccactcctctaggcagactttgcaggaatgagtcaggagtggatttgggcctggcagggccagactgccctgtgtttccttgcccacggtttgagttgtgaatggagagtatgagtggaaagacagacacagcgggacatccatgcaggcatgaacagcccagagcgacaggggaaactttcagctctcagttcaatgcagtcattgttttatctcttggaagaagcatttctccagtgcaactaagactctagactcacagagcccgaggttgtgggggaggacattaaattttgctcatggatcactaaggacgtttttgagtggagccactacaatttattcattgattcctggactcatggatcctgactgtgggagaaatagtactgcatattgggcactgctgtacagcgcatgccccatcctcaaagtcattgcccaaccttacatgtttttgccatcctgctgccacagtaactgagtcttcaagcagacactgagccattcatataagccagatgccacattggtgaagatggtaagacacttgaatgccatgaggatgggcccatggttgctgtttatttgctgtgatatgagttccttggtcaaagccccctgtggaataccatcatggtgggtgaagcattctgtagtccagagataaaaggtttggcagaagcactgcagtcaaagaaagcaaatccctgtctatactaagtgtgtattctggcaagagcaaagagctatccctgccatgaaggaacagctttaatgaaattaatatcaaccaggcatcctatagggatcttcctgttggtcttcactgttggcagatggtcactcagcagtagctacagccaggtcagctctagtgagtggtagtccactttgatgagtccatggacagcctccttttctgcaaccatagggcatttgttattgagccaattgggcaatgatggcagtggttggggcagactgccaggtgtccagagagccacccatcctaccaacctgtttagcaaaatcaattccttctcatgtcagacttcacaaaatattcacataggagataaatattctcatgctttctgcttgctcacacatctctccctcagacacagttgtgatcaatattctgattgtatttcctgtgtccctgaacatccttgatcatcttccaagtccctgagtcacagcccatgaactaggaacctctgcccgtctctctttgcagatgacatgaaccaggtacactgctctaagttctgccttaaggagagtgttcctccaccactgctgttcagggaagcccagaggccaggtgggatactagcactgtccacagcagggatggctgcatgtcctgcagaaacctctgtaaccccagtctaagtgcctcctcctaggcagctggtcccagggagcccctcaggaggcccaggctgtaaggtgagaggatggccatggggcaggagttggcccgtgtctatctggccacctcttcatgcaacttatttgtccttgtgacctgatccatcaggtctcaggtacagcccagccatgtgatggggaggccactataaatggccacctcggactgggggtcagataacatccagctcattggcagcttgtgtcccatggtgagctctgtggccacagtcacaaagagcccctgttgaggcccaggagcccccccagtcttcctctaatggagctttctgctcatttagaaaaataacaatggggaggttgctcgcctacctcaggtctagggtcactgggaccacctagaccacatccatgatcttgtctgattattctgattccttgttggcttagctatgcattagtgtaaccaagccacagtgtcttaggcactaaaatgccactacttggcccctgcctaccctggggtcctgtcaaccacatcttggtatccaattcagttttagcaccactaagagaaatctatttttatattgagaacaggaaacattagttatttctattgtggaaattttataagacaatagtgtggaaatgttttaagagacattttacttagagtgaaagaccttccattaaaccactcaataaattgctccataaatggccagcccaaaccctgagttcagaccaggcacagcctcggtgttgggaccttctgggaatgggtctctgtcatcaacccttctctaccctcctgtctgcacagccctgggcctcctacatgcagggacagctcccctcagtgtcggtagccctgggacagatgaccatgatcatatgctctggagataacctcggaataaacacgcattttggaacaagcagaagccaagccagacctcaatgtcggtcctctagtataacatcgaccagccctcagagacctctgcttaatttttaggccacaaactagcgaacatggccaccctgaccatcagcagtgcccaggccagggacaaagctgactattactgtgcctcagattgtgacagtgggggcagctggcagggactcacagtgacaaagacagatggggacttgcaacaaactgtcccacttcagcctgcctctcattcttacctgccctctgagcagctgtaggtcaggcctcagaatcaggtgtcctctctggtcctcacctggtccctgcagggccggagattcgtaacagcttttccatactctcagggcctacatgtgttcaataaaacctgtacgggggaagctcgttgaagctgcaaggaccttttacaggtttgtagaacacatgagaacttcaggaatccatatagtgtcacatggctccatgtgtaattacacgtcacacagggaaggagagagctgtttcacagggtgcaatcctactggaattcgtcttttccttgcgtagaaacagcttagtggaagccgtgtctcctctggtttcctagatgagttgaccccacattgtaatggggcacctgaggcctaaggaggacaggagacccaacccctgtgggccccaggagccttcctgtcctgacatttcacagaaactgcagaggaagtgcaggcccaacctttggttccacctggggactgtcttcagggaacactgacctttcccagtccccaaattcccaggacctgtctgacctgactaggtgtgcctccagctccctgatagcttggattttatctctgggctctgggctgctttctgaggagctcactaagaagtccttggtgccaagtgcaggacttgcccctctgctccatatcccgggtctgcaggcacaggggacaggtcctgctaggtgaggctggcaccctcttccaggagggatctctcatcccaggccctagggacaggttcactgggctttcttttctcacttagaatctcttagtctttttgtttccttctttaagagtacaactgctttttggtgaaatcatgtgtatacatcaaagttaacagactactgtcacaagcgcatatatatacacatcctcttcctagatggggtaaccgtggacactctgccatagtcgtctttttgtttctctctctctaccacaagtgagactattaatagcactcttctatgcagaccataatcatattctccagttgcacaagaacgattcttatagttgctcaatttccttgcctttcaggaccctgaagtttcccatgcccacatttggttgccatgtctctctgatccaacagtattccttggaagccgaggcttatgaaacattttgcaaaaagttccacaagaaaactcaagttccttgtgcacagttggaccatgttcattgtgtgcagtagaacctcgttccagtgttgagtccattttatgttttgaccatcaaagggaagggcattatgacttttggggactgagtcgatggaggaaagatagcagtcgatgatgaccttatgcactgacgtgtatgtggccaatgtctatagatggatttggaacttgaaggagctgttcgttctgcagatggaatttccagtgccgcatctccaccacccagccactagcactcggcaggtgctctgtaagaggaagcccttcactgccaatcagccattacacaggtgaaggtgagtgagacttaatagctattaaccctcaaaacaaactgaggaataaactcaggttcacaaagtgactttgcgggaacagcctgaggaagcaagttaattagtagcagaaggttttgcccagagcaggaggaatcacaggatcactgaggacctagtgataccatggtgtggaggtgctgtgaggcatggtgacattcaagaaaacctgttctctacaaacacctacctacccacaggcacagcagacaccccagctatgccaagggctctgtcttcctctagagtaagagcctggtagcaaacaggtatcctctgaaaggcaggtgccccatcagtcagctctgcacgactgaaacaaaaggaaaattgccagagaactttccagaaaacagtcaacctgcttgtgctggtgcattgatggtgacccaggatcagtggaagtaacagtagcttaatttccccatggctgcatgatggacaccgggagagaagtgtggaggcggattaaccaccactctaagtggcttcagccctaggtaagcaggaacaagtgagggggctgagcccacttgtgtctaatcagtcccagcctcagcgactgcatcctggagaccaacagggagtgtatgcgctcagcccctcccagattgctgagcataagcaagaaatttccctccgcacacctgacgcaccacacacctgcccccagctcctcacttacaagacaatatcaaatcagacagggactggtctgggtcccagatcccctcaggttgccgctgtcctctcagatccccacacacagcagactcttcccctcacactcctgttccaggttactcttctccaatatgatgggggtttgctttcattgtttctgtattttttgtatttttatgggtaagctgagccccttttacctggtcttgagtcaggcaggggccacacagagaagaggaattcctccccaggggccagcagtccacggatcaaggcatcagggacctgagcagtaggttctgttcctatgcctggacccaggaggcccatgagcctccagcagtcagtatggagcagccaccaggggggcagcaaagagtcacctgggaaagccacctcgggatggggtggacctgggcatcagggagatgctgacatgcagggagggtcagtgaccacgacctgacacctggagggaaaataggtccttctttttctagagtgttgtccttgacactgatgtaaaaattctagcatcaaattttatcttcagcttttgtagatgctcctatttccctgacaaaggtccaggcacttgacttccccacacatcctctcctcacacacccagttgtgctaaaatgctgtccctgtcatgcacagtgtccttcctgaggtgacacgtgtccccctccctgccctttgctctgggagcccctgtcctgtagacacagcagcttcttcttccctggctgctccccatctccactgtccctgggctttcccatctgtctcctgggaaagctgccaaatcacaggtctcaatttccttgtgaggcacaaaatagttgctcattaaccttctgttgacttaattaagtttttaattccttgatttgttttccccagcaactgaagacaacttagtcataataaacattcacttccaggggtcttgcagtttgctgacccctctcattctctcatggagcaaacattttcttgacctccttatctgtcattggtcctcacagcaccctggggacactgaggcacagcatgtacgacctgccctggagctcacagccaacgaggaaacttaccgcatcccatggatcttccaacactccatgtgcacttggcaaccaagaaattttattcttctctagcactgaggagctgtgccctggggtggggtctgtacctatccaaggcacatgctgtcacctgtagagtgtggatagagggtccttgcattaggttctggaaagtgtcttcaaaaacggatttaggcctacacccaaaatctcctctctggcacaaattattcatgatcaggatacatctagaggcctagaccaaaattcaccacctccctcctgagccagaatggaatggaggaggggactggggaccccagataatttccccatcaccactgtgactctatggccacctcctgcaacagttagggataatcacataggaagggcttcatgtatcctaggaaaaacacccaaagtcatttatgagctctaccatgaccaagtgagcccaggagtcgggttgagcacagcgtggtgtggagatatctgcagagaccgtggaaccagtttgtaaaggagatcctgtaggctgagggtgagagtgcaaggccactcctccccctctctgcatcctttggggctaagcccttctctggaaaccacaaagctcctccagtagcagcccttgactctgctgatttgcatcacaggctgctctcttcagcaaggggataagagagggctggaaggaacctgcccagcctgggcctcaggaagcagcatcgggggtgccgcagccatggcctggaccgctctccttctgagcctccttgctcactttacaggtgctgcccccagtgtcccagccacctacccagctccaaggctctgggtccagcctggcctgacagtgatctcagcagggccctgcctgtggtgtgcaggatgctcatgatcctgctgcagggggaggggctgctggaggtgaaatccccccacactgttcttctgtgctcatggtcccctgaggacacttctattcctgaaactcaggccaggcaggtgggaaggcattgttgggttgagcctctcagtttcaagtctattctattctctccccttttcttgcaggttctgtggcctcctatgagctgactcagccactctcagtgtcagtggccctgggacagacggccaggattacctgtgggggaaacaacattggaagtaaaaatgtgcactggtaccagcagaagccaggccaggcccctgtgctggtcatctatagggatagcaaccggccctctgggatccctgagcgattctctggctccaactcggggaacacggccaccctgaccatcagcagagcccaagccggggatgaggctgactattactgtcaggtgtgggacagcagcactgcacacagtaacacaggcagatgaagaagtgagacacaaaccctttcgccatctatgtcaccctctttctctaattcaaggaggactatgaacaaagccttacgcagatctggttaaattctctttaatctctgcccccagcctgtccctccctccagtccttcaggcggggtctgcagaaagtgcatcagtagttcatttagggtgatgtgatcaggatggactggtgttttggtgactcagctgtgacttgggaaaatagggcctgcatggaagatcagactgaggtagacatccacagttgtctctggatttccataggtggtgacaggccagtccttgccccaaatgtcctagatcagtccccagaactgcccagctcaggctcctgtggtagcctgtcattctttagagaaacaccaatggagtagacactgtgggatctgcccagatcccctgttctgagcttacccactaagcactactgggagcttctggcaggtcagagctgtgtcctcactggaaagtgctgttcggtgcagaaaacagactcctccaggtctatgccctttctcagtgaggttagatttcatgactgcctgaggccgagttctcgactctgcctcaatataggaagacctgaaaatcctcccagctccacagctctctgtaggaaagacttgagacctcaatgagggtcagggtctcctgcccagggttgcctccctcacctcctttcacatcctctgtgcatgcaattcctcatctcagagtctgcttccagggaacccaattaagatcaccagccatccccaacatgggccatgtgggacttcaggaggccactgtatgctggaaagcacctgtttattcctaaattagcactgtgagtatccacacgcccaatgagatctgagtgtttcttgcatttgcatggaatgagaagggagcctgactcgccaggtgctctggggtctaagggagagttggagtcagatctccctgcagggaaacctggggcaggaggagcagccttaccccatgcagggaccacagatgcacccacagggtgagcttaagtatggacactgcctacctccaccctccacatcctgtgtaaaaaatcattctttccacccctcctccagcctatcaaagttgacacttaaaaagccaccacaacccacccttgtcaacaggaaacccattcacatctccatcagccacacaatctccacataaagattcttcaaaaaataataacaatagccatgcaaagtatatgatatatatcataaataattgtacttagattatatatgaaaatgatactctttttgatatgctaggtaaataaaatacattatttaaactcattgacttcttctctttgtatttataacatgatgactagacagtgggattcccatgaggctcacatcacattgtgattgaacaaggctggtctgcagggcttcaggttacaggggctgtggagtgacctggtgcaggaagccccgtctccatccataggacatcagtgtgaacccagggagaggcgctggtataagagagatgagaacacaggtgtgaaccacctgcttgtgcaggggactgagccttcactttgagccaaataagttttctttcccaagttcgatcctgaacaagagggctttctggacttctttttgttttcaggtttgtgccccttcaggtttggggctgtctggagtcccagccaggggacagtgaggaaatccagcagtctcacactgactctgttgtatttcatctgctggggccatcccaaactgctgcgtaccatttcctttcctggtgctcaaatagctgctccatgcacttgtcatggttttatagctcaatctagatgggaagacaggatagtgtatgttacaatatttaaatagaacctgaatcccttaatagttattttaatatggaacattaaaagagttgcatcataggcaatggggaaagatgaagaaagattaaacgcatttggaggaaaaactaaaaatgtctttattgaatgtctgtgtgtcttcagtgacgaagggttgagagaggtcagctttaggttgtcctgaggatgtgctcagatgggggaaagtaagaaagcaggaaacgtgcatctctgtgacctgacacataaatcacagtaaaatggaagtaaatctttcaataaacctttcaagataacatcactctggtgcacatagaaaggcctgttagcaaactttcccttttccctgctggctcatatccccatggatcacctgtatgcagaacggactctgtggtctccatttatcaggctgagaaccagaggctgggaaggacaagtcacctgctcatgagtgggaggggcaggattgggagcagcggactcaggctcaggactgtggccctggttggtgctccttgttcccttcacagggtcccacccacatgtgcccgtgtggatgtgggtgcactgcctggggtggctgatgtgctccagggatttgatggtgcagatgcttcaggacaaagcatgggagtggggatgggacgagctgccgctgggcagaccaaggaccaacgccacccagcagaggcttccagtggggttgggcagccccatttcctgagaatagagagaacctggcaatgagtgccagaaagaagttacttcgaggtgtgcccaggcctggagggtcacagagacacaggcaccacacagcagagacactgaaggccaagagctcactcaggtgaagggcttcaacagatttttctctcctgagcaaatcacgtgcaaagaaatcaacttcctgtcatcagaatagacaatcaggactttagtctccttggctgagccccgctgtcaagggaagcagaagtctctaagcccaggcccaagtgagggtggggtgagaagaggagctcaggatgcagatttgcatggaggtcccgcccttctctgaggcagagggataagacagggctgggggcaggcccagtgctggggtctcaggaggcagcgctctcaggacgtcaccaccatggcctgggctctgctcctcctcaccctcctcactcagggcacaggtgatgcctccagggaaggggccacagggacctctgggctgatccttggtctcctgctcctcaggctcacctgggcccagcactgactcactagactgtgtttctccctttccagggtcctgggcccagtctgccctgactcagcctccctccgcgtccgggtctcctggacagtcagtcaccatctcctgcactggaaccagcagtgacgttggtggttataactatgtctcctggtaccaacagcacccaggcaaagcccccaaactcatgatttatgaggtcagtaagcggccctcaggggtccctgatcgcttctctggctccaagtctggcaacacggcctccctgaccgtctctgggctccaggctgaggatgaggctgattattactgcagctcatatgcaggcagcaacaatttccacagtgttttaagtcaatgaggaagtaagatcaaaacctgccctgggctctcaggccccttcttgctctgcagatgcttcctcacgctgtataagggtttcctgcaggatggccttgacaattctcctctctcagctcctctcctttcccaccatgaggtctaaaaggaaacctgctcgtgatttctcgttcaggactgtggcaacttccttttgcttgtgtgctctggtcccttaacgtgcaactattcctagctcttcaatgcagggacgtagggacaaggagtttactgcttggtgcagtccctcctgttttcaggaacatcctcattctaaatgcatcccccatctgccacactatgcagatcaatctggacagaagccatcagggggatggcttccagtttccaggaattgcatcttgttccactctgtgtccaccacgctctaatgaagatggccctcctagctggtctattcctctgcacctgggtcctgaagcagtgaccactttaagaagacttgaagatgtttttgagggattaagaacaaagaggatgctgctgtttttctttttattgctcctgctctttgccgaaattcctcaggttgctgagctggggagattttgagtgacaggctcagtgctctcgcagaattctcctcccctcacatcgctgaggccctgtcctggaaactcctcacaagtggacggtcttcccataggatgggggattccaaaatggctccacaggaaagagttaacctgagtccacctcccttcctcatggacatcgagcatttctaattttcatggctgtcaatacttttgtacctggaatccctaataatctaatggtgagaattgatttagaacacattcggacattagctgggtccaatatttaaattttctgagccagttgttaaatacagctattatcatatatagtttaggctccttaaacttcgattatacagattatatttaaaacaaagtaactagtttactatatatatttacaaagtaactactatataacatcatgttgtgtacctgaaatataaacactaaaatttatttcaaaaaccaaagtgtattgtctattgatgcataaaaaaacactcacaaaacttagcacactaagagaacacatgtctgtgaccttgtgacttggatgcacctagaattgggagtagcttagtttggtcattctcgctcctggttaatcacgaggttgcagccaagctgtcaggccaggctgcattcaggctacatctgccaaagaggttaggaactgtggaagcctccctctggctgtggaagcctccctctggctgtggaagcctccctctggctgggagacttccgcagttcctaacctctttggcagacgtagatcatctcaaggataaaggagagagtggagtgaaggcccctgtccttgtcctccatgtaaaaggccatcccatgcatgcactattttttattctttgctgagacatcctaggcatagagcactgccccattcattcaaaggttgtagagtattctatggtagaattttagccaactcacttttaatggttattatcactattttgatcttataaataacactgcagcgaacatccttatgtagactcctttgattttatatgtagacatgaccatagaataaatttctagaagtcaaattgctgagtcaaaaggatgtgtgcttgtaattttcactcactgtcctcagattctcctctagaggggttatctacaaattcgcaatgtcagccataaatattcgaacagagtacactggggaaagtttaaatgtttttcaacctagcagatttaaaaatgttatctttttttagttttgatttctcctgttctgcttgaagttgagcattttctctaatacttcagtgctatttatttttataatttggtaaacattttcttaaatgtccagataagaaggattttggtctgtggttcccaagagtcaactttgaggatattctgtaggtatttttagcaccatttatagtgtaaccatttaaacctataaaaaccactctcagctctggggccatggaaaaacaggtggcaggacagggatggcccacaggatgtggtttaacggtccctgatttgtagggtaatttgaagtttgagaattccaccgcatatgttctaggtggagatctctatttgaaggatactgtattttacctcctatagtggcctgaggcttttggataagaacatacttgtatcatctatttaattggatcttgggtcttcccaggacagccctgtgtcacagtctcatgtttttcatctcatccatttgctctgagttttcagaaagctttagtatatcagaaatagactgaccctaggtggaaaatcagaggtaccgggagcagcaaatggtcagggaagcttgcaccaactctggaataaaccagtacaggctcagagaaaaacatcataaaatcagcattgtagctgaaaccaaaaacatgcatgatctttgaagttctggggattataaataaataaatgaagtttaaggtttaaatgtgttgcaaatttacataaagcatgtagattttaaaactcagaatgcagcaatgaaatatggaagcttgagattttaagctgttaaggccctacaacaaattgccaggaacagaacaggaacttgatagtcataatgtcttatgctggaaattatcattttctctaaatgaaatttttttcccttttttcttagacataaggaaacatctcattgaacacccttcttttccactgtcaaacacccttacccagaaaggaactgtaacattaagtaggaaacaactgctttttttcataactattgagagatttctttatttgcacatcaaaatgttgattgtcaatgctaaaattggaattagtagtttaatatgcacacaagagattaattttgtttggattatcccatttctgtctattatttgtcttagttaactcagacatattctgcttttggtattttttgttttattttctttgccaactacatgtaaaccaaaaataaaattctaatgctcccccaacaaccccaccatctgagtggactctcttctcttggtgggggcactccaaagttaatctgaaagactggttcaggccatggcagaaaaggggtgtcagacatgtctcattaagcccttttcctttttggaattcaggaaaagccaacctgcacttaacatcaatacaaatcttaagtctgataagaaacatttacaatctattctctctgaagcctgctacctggaggcttcctctgcatgataaaactttggtctccacaacttattataacccagacattcttttctattaatactttcaaccaactgctatcagaaaaatttaaaatctatctataatccagaaggccccacaaccctgcctcccatcaccctcttgttttgacttatcctgcctttctggactgaaccaatgtatatcttgaatgtatataattgatatatcttgtctccctaaaatatataaaaccaagctgtgccccaacctccttgagcacaagctctcagggtctcctgagggttgtgttcaccagtcatggtcactgatacttggctcaggataaatatcttaaaatattttacacagtttgactctttgtcaacatatggctcttttcaaaacaccatttgacacccagacataacccgctgctaatgattacaaaattcaattttattagcatttaaattattactttaaattatttcaagaatgcatggatgtgatttcccccacatctaactcacaaatgttgctgatgctgacttgctcttttctttcagtcttagcaaataaagagggagtttacttttcttgataccagaagataacaggagaaagtaggtgaaactcccgaaagctgttatcgtttccaccctcaggatgaatcacacaaggagtcacctgcacttcatttggatgataaataaatgagatggatcttagagttggtgctgatctagtcaatgatttgggatgttgggctgaggtgaatgtgtttcacaggtgagaaagacatgagttttagagtccacagtgtggagggttattggctgaagtgtgcccgagaattcatacaatgaagctctaatcacagtgcatgaatgaattggaacataggtctttaatggggtgattaagtgaaaatgaagccagtaggatgggttcttttccatctgacaggtgtcctctgaagatgaagaaatttgagcacacagaaatgagacaccatagatgagcatgcagaggaaagatcacgtgaggacacagaagaagggagtgatttgcaagccaaggagatgttacagtagataactaggcagacgtgacagggcaggagaccccctgccccaggaatgtcacgcaagcatcagatgatggtcaggtagttgttaaactgtctctgtgaattaataattagtcacagccggcaccaaggaaaggcggtctcccaatagatagaaaatacctgaagctggtgatcagcagctttctgataagatctcaggccttgggtgagtgggctcaagcaggcaaactaaaaggcaaaacagaggccaggcatggtggctcacccctgtaatcccagcactttgggaggccgaggtgggccaatcacttgaggtcaggagctctagaccagcctgaccaacatggtgaaaccctgtctctactaaaaatgcaaaaattagccaggtgtggtggtgcatgcctataatcccagctactcagaaggctgagccaggagaatcacttgaacctgggagatggaggctgcagtgagccgagattgcatcactgcaccccagcccaggtgacagagcaagggtccttcaaaaaaaaaaatgcaaaatagcagagtttaacctggatctgagactcccatgctgcccttccctccagccctacaggcaggctctgcagagagtgaatcaccagtaaatacacaaacaaatatgattacgttccttttgtttaagaagtagaggaatgattgaatatattaagtgaaaataaggaataccaacacaaagaaaaatttaactgtaagtatggttaaaaatacactgggtgagatagacaagttagatgtcgcaaaacaagagattagcaaactgtatagtgtaacactagaaactattcaaaatgaaacacatagcaaaaaataacgataaaaataaacagcatcaatgagatgtaggagaacttcagacaggctaatatacgtgtaattgaagtcctcagaatagaagatggggtaagaatgaaaagaaaaaatatttgaatgaataatgacaaaatatgttccacatttggtgaaaaccataaactgatataacccagaagctcgataaaacttaagcataggaaacacaaagacaacaactccaaaacacatcataatcaaattaataaaatctagtgatgaaaagtagtcatttaggacaaaactacaaagagcagatttctcattaggagcaatgcaagcaagaagatagtgaagcaatgtcttgaaaataataacatgcaaaatccaacaaccttgaattctttatccaccagaaacatctttcaaaactggaggcaaaataagactttttcagacatgtgaaatcctacagaattgatcaccattagactctcgctattagaaatgataaaggacacccctaaacagaaagaaaataatcctacattgaaatgtggtttgacacaaagaaatgaaaaatcagatatggtagctacctggatcaattagaaacctctgtattatgtaatgtctataaaaagaacagtaatgtctataaagagaactgttcagagaaaaattaataagaatacactatgatttgtaataaaaataaaagcaaactatatgacaaagcagaaaagcgaaggtgggtgaagaacatgtaataatggttttgtactatatgtgaatatataatagcacctgaaggtagattttggtaagttatgtatttactgtataccctaaaacaaccattaaaataaaaccctcaacaaaaaagaaatatggctagtacgctatattagacttgtccaccaaaaattaataggatatgtatggatatgaatatatatgtataatgtatctatatggtgagagagacagacagaaacttattttaagaagctggttcatacaatagtggtggctgatggacaaaatctgttgggcaggctataggctggaaatttaggtaagagttgatattgccgtcctgagttcaaattctgcaagaagctaatgtttccccaagacagcatcagctgttattatgcacactggctccaaatcgaggaaagtgtcccccctgaccattagcagagctcatgccaagaacaaggctgatcattaacatcaatcactgggaaacttcagtatttattctaaaaaccttgaactcattaatgagactcacacacattgtggaaagtagtattgatacaggagacagaaattatttaggcagatagtgagggtgacagggtcctcagcagagcttctcatctaacaaaaagcagccctaaaaatcatttcttttataacaaagagcagcctgaaaaaatcgtgctgcaaacatagataagcaagctggaagcttgcatggggcaatgccagcagctatgccaatagaaaagtactacctgggggtcagccatgtccaacatggaggctccatcttccctttttttgtcaccatgtgtatagcaatagagaaatgggcaacatggagcagctcaggcagataacccacctgcgtaataacagattagggcagggttggccagaaatgtgcaccctatgcaaatggtacacctagtcctaatcagtttttcatgccctgtgcaagtagcacacctggtctaaccagtctttgacacccaccttatgtagatcagatactgcctcctcaccagctcatctataaaattccctacatttcactgcagatccggcaacccatttttctgggtcccctctctgcagcagagagctattatctttctttcacctattaaacttctgctgtcaacctcatttgttgtcagatcatgtcctagttttccatggccctgagacaatgaactttgagtattcaccccagacaatgaggctatttcaatatgcttatacaaagtctactggtttgaatatttatcacatttgaaaaatatcttcatgacaatgtctacactggtgcttaacaaaatcaacctggtaccatgtcttagccaatctgacacttaaaattcaccaccacttaagccaggagctaaagaaaaccaatttttaaaaataaatttcaaaagagagaaaaaggaaagaggaacaatgaacatataagacaaatagaaaaaaagagcaagatggtatattttaacaaagtatattcctaatcacattaactataaatggtctaaataccacaattaaaaggcaggtattatcatctatattctaaaggagttcaggtagggttggtatgctttcttccataaaaatgtgataccagtgaagctatttgggtataggtgggcttttcttagcacggagattttaaattgctactttaatatctttaagtgtcatagacttattcagattttctatgtattcatgagtcaattttcataatttatgtctttccagaaattttacttcatttatctataattttggcatttactgttcataatattccctataaccattctcacccttttagtgtctatagtgatgtcattattttagccatggttttggcaacttgtgtttctttttcttttttttatcatggtcactttacctaaagataaaaatctattgattttattaatctttttgaagagccaagtgttttttttttttttttttgaggttttctattgttttcctattttctatttcatgaatgtttggctgtgatccctattattaccctctattcacttagaatttgaatgttcaccttttttaggtttatgaggtagaagcttagattattttctttaattctttcttctttccaatactaagcatttaatgccatagtttttcttcaaagcagacttagctgcattccttaaattttaatatgttgtgtttttatgtttaaaaaggttcagtatcttctaatttatgttgtgatttttctttgattcatggattacttaacagtctgttctttcactttcaaataattgaagatttcctatggttcttccggtattaattcaagttaattagttaattctgcattaaattatatcttctatgattttcatcctttcaaatttatcaatatttgatttatagcctaaactatgaactatcatgaaaaatgttccatatgtatttgaaaagataacatgtattctgctgttgtgggtgcagttttctacaaatttattataattaagataacttggcaaatggttcaaatctatattcttactagatttctgtgtagttattttgtagatctctgagacagagctattgaaatgaacaacacaaactgtagaatttcccaatgattattttgagagagatcatttttaaaatcatggatctaaataatttattctcctcacaaaatgtcttctatgatttccaaatactaatcaagggaagaaggcagagttaaactcacacttgtagataccacgggaacagtgagtgatcatgtgatgtgcctccagaggttaggctaatgtagttagagtggtttatatttatttatttatttatttatttatttatttatttatttagacagagtctcgctctgtcacccaggctggagtgcagtggcgctatctcggctcactgcaagctccgcctcccaggttcatgccattctcctgcctcagcctcctgagtagctgggactacaggcacccgccaccacgcccagctaattttttgtattttttagtagagacggggtttcactgttagccaggatggtctcgatctcctgatctcgtgatccgcccacctgggcctcccaaagtgctgggattacaggcgtgagccaccgcacccggctggttttttttttttttttaaacacacagttgggctaaaatatccatgaaaaaatttgaagcatgtaccttgaataaaatatgaaaatcaaaaaagttaattgcacacgtacaacattgttaccacggtgcctgccgcatgggaaatgaacaacaagtgttattaattcaattctattttcttacacattcaatgaatatgtattgaaacaaattcactgaatggtcccagatactgaataggtccttgagatgtactggcaaacaagacaaaaaaaaaaatacatgttctccgggtggcctcatggaagatggtggagtaagaagctccaagaaatggtccctcctgtgatataactattgaagtggcaagaaccatcagcattcactctaataaaactatggtatctcatcccatatttgcagcatccagggaagagctgaagaagaaagagacaggcttaaggaagtctctgtcaggtagatctctgaccacagagataactgaacagaaatttcgtggatcactctgacaagaaaggtagtccttgcgaaaatattcaggaaaagtcacaacacaaataaacaactgcacccctcagatgaacaactgcacaatatcagccaaggggcataatctgataatctgatcctgggagttaacaacatcacaatattcaaaatactcagatctcaacaaaaatttgcacagcatacaaagtcacaagagagcacgactcattcccaggaaaataatcgactgaaaatcttccttaagaagcattcatttgctcccatcttctcccttggttatataacacgtccttccacatatacttgattagagcttgtgccccacaaacatgcctggcatgtacattagtgacttctgagagggaggtgggggcaggaaacagtccctctggatacatttcgcatcacatgaaccagtgaacacatctctgcaaggtcctgcattctaataaacaagatttttctgtttaaaagaaaacttaagtctttcagaaaactgcatttcaaaagggaaccttgtctctgctgcttgggctgcagtgaggacagatttactaagtgctggttgctgtgttttgtcttctagtgtgggtacacacatctagaaaagttttaaagaagattggggaacccccacccagcactggtgggactttgagtttgctacggttgtgaacagaacatggaacagaggacaaggtggcccctcctgaagatgagagttttgcttcttgctggaagtccctggactcctggagtgttctcaggggacctcttaacaggatctcaagggaaagaatccagggtactggatccacacaatcaacctcacggatttctgagtaggtcattaacctatcatgcctttagcgttatctcaaattatacatggtatcatctcaactaatgtctaaaacaatatacggcatagatatctaaagaactagtggtacatggaggatggctttctacctctgagccctagaagggactgtgggccttggtttggggactctaatgactctaagtcccctggtagtgctcaagtgcaaagggaatgactgacgctttttttgaggccccttctattgtgtaaaatttattctgtacttgtgacacccacctggtccttcttctgaacatgggaaattgccaagatgaagtctccaggctaacggctcagacaggagctcagataaacatgctgggaagtggagagcaaattgacattcaaagctcctcccaacaagcttcaagaagagggtaacacaagaagtccttgtaaccaggttccacggggcagcctcaagcagagctcttggaagtccctcccaccacggtctgggtctccttctacctcctgcccttcattttctccacaggtcagaacatccagggaattcagggaaaccctttcactgctatttctccacaagctccaatcctcaggggcattctttccagttctcccgagcattcggcatcattcatgaaattctatgtttccaggtctctgtgctctggctgtgctaactcagcccccgtctgcatctgcctcactgggagcctcagtcaagctcacctgcaccctgagcagtgagcacagtacctacatcatcaaatggtatcaacagagaccagagaggtccccctagtatataatgaagtttcacagcgatggcagacacagaaaggaggacaggatccccaattgcttctcgggctccagctctggggctgactgctccctcaccatgtccaacctccagtctgaggacgaggctgagtatcactatggagagagccacaagattgatggccaggatgggtgagccacacacagtgacacaaagggaaagtgaggccaaaaccccccacctcccctttctcctcagggactcagagtcagcagtcacatgtccccttccaagtccctgagacttctgactctcctcctgcagagacacccctaggcagaggcagatgcaggccatgatttaggccattttgacaactcatcattctgtctcctcaacaccagtctgtggggaccatactaggagagaccagagcagcccaggcagaaggaccctgagagagtggccaggctgagatgaccgtgtcccagtgtctcactgtgccctgtgctcccttaccgggctctgccccaggaaaggacatggatcttgacctgtcaccccccatttatgagagttcaatgtgtgtgcatcctcgttagcacttgatattgtcagtttttccttaaagtctttcagatagagctgtagcgatatctaattatgtttttaacttttatttctttaatgacttattatgctaagtatcttttcaggtacttatctgtcctttgtatgtcttctttggtgaaatatttaatcaaatctttgcatttttaaaattcaggtttctcaggttcacatttcctcatgtatttgtatgagtttatatgcatgcatgtgtgtctatgcattccattctgtgtgatttcccaacatgtatcagcacaggtatccaccactacaatcaagacacaaaccaggtccatcacaacatttcctggtgtttccctttgataatatctacctcctcccacccagttccctcccttgcccaaccctggcaaccactgatttggttccctattcctaaaattttgtcttgcaaaaacgtgatacaaatacaaccctattgtagtagacagactttggggttggaattttttacttagcatcattccctataaagtcattggaaaggtgtgtgtatcaatagtcagttcctttcaattgctgagcagtatctcttggtattagtttaacaaaacctgatgaattactcacccaccgaagggtatctggattgttttcagtttggagctactacacctgagggtgctacgaacatcagtttgtatgtttcttgtgaacataagtattcagttctttgaaatgaaggtccaatattataattgctgtgtcatacactaattaggtctttagttttctgagaagctgacaaactgttccctgaagtgaatgtaacatttttttctggccagtaatgaaggaatgatcaaatttctctgcttctttgggaattgtgtgtttttactctttttttaggtaactattgtgataggtgtgtagtgatattccattttttaaaatttcatgtctctgatcgttaatgatgatcaccttgtcctgtgcttatttgccatctgtatgtcctctttgatcacgtttgtgccctttgcacattttctaattagattgtcttttgttttgctcttaactggtattcagtgttgggtgttttgtttttttgagacaggattttactttgtcattcagcctggagtggagtgatgcaatcacagctcactgtagcttggactttcctgactcaagcaatcctcttgcctcagcctcccaagtagctgggacaacacgcacacacactgcctcactaatcgtttacagaattttctttgtagagacaagatctccctatttgcccaggctggccacgaactccttaggctcacgcaatcctccctgctcaacctcccaaggtgttagaattacaagcatgagccaatgcactcggccagttttcactgttctttatgtattttttatactagtcatttactggatatgtgattggcaaatacttaatgccagtctgtagcttctgttcacatcctctcaagagagatttttgcaaagcaaaaattgatggttttgttaaggttcaatttatcagtctttcatttcatgacttgtgtacttggtgaagtctaagaattctttgcatagacatagatcttgaagattttctccttttttttttctttttttttgacagagtctcgctgtcgcccaggctggagtgcagtggcgtgatctctgctcactgcaagctccacctcccgagttcacaccattctcctgcctcagcctcctgggtagctgggaccacaggcacccgctaccacactcggctaatttttttgtatttttagtagagacagggtttcacagtattagccaggatggtctcgatctcctgacctcatgatctgcccccttcgacctctcaaagtgttggtattacaggcgtgagccaccgcacctagccgattttctcccatttttaatataaaaataatagtatcgctgggcacggtggctcacgcctgtaatcccaacacgttgggaggccaaggtgggcagatcacaaggtcaggagattgagaccatcctgacacggtgaaaccccgtctctactaaaaatacaaaaaattagccgggcatgatggcaggtgcctttagtcccagctacttgggaggctgaggcaggagaatggcgtgaacccgggaggcagcgattgcagtgagccgagatcgcgtcactgcactccagcctgggtgacagagcgagactccgtctcaaaaaaaaaaaaaaaaaaaacagataaataaaaaataaatctgagagatggctgagcaatttcactgagtttcatcatggaattctggcctcccaaacaccagcatggcccctgttcctacaatctcctgcttcaagatcaacccaaccctgctacccagaccagatgctagatggtcaagacagggctgtgagagctaaagaatcttcagggtccacgatgaatttacattggagcttccttttccacggatattcacatcaatagagaagatgactgagttcttgcctacctctgtgaatacctgagacatgaactgagatgtgtgtgtgcatatggtgcgggcagcacttcctcactcaatactagggagagtgtgaggaaactggatacagacctggagatagggcacatttttacactctctattaagccctgtccttctgtgctcaccaaggagtcacccaacaaggccacaacaggaagagaagcaggtttctatgaagagacttctctttttgtgatgagggcccaggaagtccactgtctagctatgaactcagaggcagaactctgatgcatctccaccatgacctgaatccctctcctctactcacccttcctgctgtcggcacaggttctgccttccagggctcagccccataagactagggatcagcctggccctgaccttcagctcagcacagggagtgacgcagtgtgtggggctctgagaatgagaccctcatcttcagactcacctctcctgtcctatcttgtaggctcagtggcctcctctgagcggactcagttgcctgcagcgtctgtggctttgggacagagggccaggatcacctaccagggagacagcatagaatacttttatgcaaacttttgtaccagcagaagctaggacaggtccctgtgctggtaatctatggtgacagcaactggcactcagtgattcctgaacaactctctgactccatatcagagaacatggccaccctgataatcaatgggccccaggctggaaacaaggctattactgtcaatcatgagacagcactgatactcatctcacagtgacacaggcagacaggaaagtgagacacaaaccccttcccacctatgtcaccctccccctccaacctcaggaggacagtggtcagagctataagcaggtctggcccagttcactcagatttgagacccccaggctgcccttccctccagccttccaggcaggctcagcagagtgtaaattaagagtggatacacaatgaattattagaattgtatttcagtttttcaagaagtagaggaatgattgaacatgttaagtggaagtatagaataccaaaaaaggactaattgagcttgtactgctaataattacagcatctgagacattaaaaacacactggatgtgattaacaacagatgatgcaacacaaaagattagcaaactcaataatgtagcactagaaaatattcaaaatgcagcacataaagaaaaaataatgatgaaaatgaagagagtgttacagtatatttatagaaaaaatgaagagtgagttataggacaacttcaaacagcctgaggttggctgggaggggtggctcacacctgtaatcccagcactttgggaggtctcggagggagaatccttttgagactagaagctcaacaccagactagacaacataacgagacttcatctctacaaattttttttaagaaaattaactaggcatcatagcctgcagctgtagtcctacctacttaggagcctgagacaggaagattgcttgagcccagaaattcaagatggcagtgagtgaggtacgatcatgccactgcactctaacctaggacacagagcaagttcctgggtctcactctgtggttcaggctggagtgccatggtgcaattacagctcactgcagccttgacttcccaggcccaagagatcctcccagctaagcctcccaaagtttctgggactacaggcatgcatcacatgcctggttaattctttgtattttttgtagagatggggttctccctatgttgcccaggctggtcacaaactcctgggctcgagcaatcctcccgactcagccccgcaaagtgttgggattacaagcataagccacgccacctgatgtgaagaaatatttaaatacaacaacctaaagtatgtataattgacatccatggaatagaaaagatgaggtggagggtcagtagaaaatatatttgaataaataatggccaaatatgttccacatttggtgaaaaccaaaaattggtatatccaagaaggtcaacaaaactcaagcacaggaaacatgaagaaaacaactccaaaacacatcataatcaaattataaaatctagtaatgaatacccactttaaagtttaattccaagagcacatctctcattagaagtaatgcaaggcacagtggaacaatatttcgaaaatgctgaaaggaaaaacttgtgaaccttctgttatttatctaacagaaataacattcaagagcggagggtaaataaaatgttttcagacacataaaaacttacagaattgatcactatcacttttggcattagaaatggtaacagacatccatagacagaaggaaaatcatacccagttgaaaagcaaattcacacgaagaaatgaaaacttcagatagggcaatgacatggatacctatagaaacccctgtattatgttaacatctatgaaagataactgttcaaaggaaaattagtaaaaaaatcactgtgatttattgtgaaaacaaaattaaattatatgacaaacagcacaaaagcagagaggagtgaagaacatgttataatggtcttataccctgtatgaatatctaatcacacttgaagacagattttggtaagttatatatgtaccattaaccctgaagtaattattaaaataaacccttttaacaaaaaagaattatgactagtagtaacctgtattaggattctccacagaaacaatatcaatcagatatgcgtgtgtgtgtgtgtgtgtgtgtgtgtgtattgagagaaaaaagagtgaaagaaatgtattttgaggaagtggatcatatgattgtagtggctgacaaggattaaatctgttgggcatgctgaagtctggaaattcaaataagagttaatgttgcggtcatgcatgcaaatttagcaagccagcacatcaggaaatctccatatttgttctaaataccttcaactcactaatgagtcccacctacattgtgcagagcaatctgcttatacaaggtcaactaattaaaatgttcatcacatctgaaaagtatcttcatgttaactcctatactggtgtttgacaaaatcaacctggcccatatcctagcctatctgacacttaaaattaaccatcatttaagccagaaagaaaattttaaaaatatttctaaaaataaatcagaaaaggaaacaatagaaggggaaaaataacgaacatatgggatgaataaaaaatgaggagcaagaaggtatatttcagtaggattatattactaatctcattaattgtaaatggtctaaatatcacaactaaaatattgtcaaattgaaattaacagcaagactcaactatatatgctacctagaataaacctacttgaaattttagaaccacaaaaagccaaatacaaatcaacgacaatcttcccaacccctggtttcccaacaaagcattacaaaccgaattcacagggattaacacatagttaaaaaatatgtctcacttccaccaacactcttacctctcttcagcctctaatgcctagatcccagtaccagagttgcaagaaaacagggcacacaaatgttaaatcaaggttactaagggtcaccctcaagaggtaggtgaaaagagaatgagggaattgaagccacaagggtcccacttgcatggggcagctcctgcatcacaatgttgattgatacattattgatgagtttttgtccatgttcatggtggacataggtctataactttcttttcttgtcatgactttggctttggtattggagtaatgcaggcctcaaagagtaagtagaaaaatgtttcccctgctgtataatctgaagaagttcttgtaggattggtatcatttcttaattaaaaatttgatagaaatttactatttaaaactgggtgagcttttcttagcaggaagacttttaattgccaattcaataccttcaaataccatagatctatttggattttccatttcttcctgagtcagttttgatcatttatgtcttttaaggaatttttccacttaagtcatttatacttttggcattaattgcttgtaataatttccctaaccattttaacttttgtaaggttggtagtcatggcactcttttatcatggttttagtactttgtgtcctctttcatgttttcctagtcagtctacctaaaagtaaaatcaataggttgtatttatctttttgaagagccaagttttgttttttagaggctgtctattgtttttttttgctatttcattaatatttggctctgatctttcttattaacttttcttttttttgctttgaatttaaatgctcacctttagcctaaatttatgaggtacaagcttagataattcattttagatctttcttctttccaacattaagcattaaatgcaatagatttccttcaaagcactgatttaagctgtatttcttaagttttgatatgttgtctttttgtgttttaaaggttcagtatcttctaatttatgttgtgttttttctttagctcatggattacttagttgtgttctttcctgctcaaataattgaagatttcccatagttcatcaggtattaatccaatttaattaattattttggcattaaataataccttctatgatattcatccactgaaatccactaagatttgacttgtaacctagaacacagattatttcaaaatcatttaaaaatgtgctaaatgtatttaaaagcataatgggtattctgctctcatgtttgaaagtgtaatgggtattctgccattgtgggtgtagttttctacaaattcaattaggataaattggctatttgggaggctgaggcgagcaggtcatctgaggtcaggagttcaagaccagcctggccaacatggtgaaaccccgtctctactaaaaaataatacaaaacttagccaggcgcggtggcaggcaccttaatcccagctacttgggaggcagaggcaggagaatcgtttgaacccaggaggcagaggttgcagtgagcctagataaagccattgcactcaaacctgggggataagagagggacttctctcaaaaaaaaaaaaaaaaaaaaaaaaaaagataaattggctgatcattcaagtctgtatcttgattgaatttctgtatagttgttgtgtggatcaatgtcagggagctactggaatgatttaacactaattttagaatttctgattgattttttgagagaggaaattttcatgggtctaagtactttattcttctgacaaaaggccttttatgatttcccaagactaatctaggaagaaaaggcagagttcaagccacagttggtgataccatgggagcactgaatgatcatgtgaggtgcctccactggttaggtgtatgtaaatgaagattttttaaaaaactaattgggaggccgggtgcagtggctcatgcctgtaatcctagcactttgggaggctgaggcaggtggatcatgaggtcaggagatcaagaccatcctggttaacacagtgaaaccccgtctctactaaaaatacaaaaaaaaaaaattagccgggcatggtggcaggcacctgtcgtcccagctactcgggaggctgaggcaggagaatggcgtgaacccaggaggcagagcttgcagtgagccgagatcgtgccactgcactccagcctgggcgacacagtgagactccgtctcaaaaaataattaaaaaattaaaaaatacaaaacaaatctgggctaatatgtccagaaattttgagaaaatgtatgttgaataaagcatgaaaatgtaaagcaaggtgattgcatatgtataacattgctaccacaaggccaacctcatgggaaagaaacaaaaactgttagcagttcattatgtttacttacacactgaacaaacatgaattgaaaccaattcaatgaactgtcccagatactgtttaggtacttgagatgtattggtgaacaaaagagacaaaagtacctgatctcacagtggcattatgaaagatgatggagtaggaaattccaggaaatggtcctttctgtgaaataactactgaagggtaagaaccatcagaattaaccataataaaatgaggaaatctagtcccacattcgcagcattgaggcaagtactgatgaagaaagaaacaggcataagaaaatctctgtcaggttaatttttgcccatagaagtaactgaacagaaactttatggatcactctgataacaaagtccttgcaaaattattttggaagagtcaactacacaaacgaataactgcacccttgagcagcaacatcagccaagaaggagtagggagacaatctgattttgagagttacaacatcacacattcaaaatacacagatttcaacaaaaacttaaaaagcagacaaagttaaaaggaagcatgacccatttacaggaaaaagtttaatgaactgaatgtactcacaaggaagcaaaggcattggacaaatgacacaaatacttcaaataaccatttacatatgttcaaaaattcaagaaaaccatgcgagtaacaaccaaacaaaactggaagaataatgttagaacaagtgaggactatcaataaagaaaaagaagttataataaaagaacccaagcagattttctagaactgagaagttcaatagctaaaatcaaaatttcatcagataagttcagcagcagtttgagcaggcagaaaaataatcagtaaacttaaagatacattgttgtaattacacagaatgagcataaattttaaaagaataaataaaatgagcagagcctaagagatacatgggacatcatcaagcatatcaatatacgcattgtgggagactcagaaggaagagaaaaaagaaagtataaaatacatgtaaaaataatggctagaaacttccaaaattgatgaaagatatgaatctatactttcaaggagctcagtggccttcatcaggttaacctgacacagactcacagtgaggcacaatatgctcaaaccatcgaaaaccaaatacaaaagaaaaatattgaaagcagcaagagaaagagactcatcacaaacagtagattctcatgaaattaacatttggtctttgatcagaaacaaaacagtccaaaaggcagcacaataatctataaagtgatttataaaaatatattatctaccaattctgcatttagtcaaacaaatcttctaaaataaaaaataaaataagataatcatagataagcaaagtttagtagacctggtagatctgccctaccagaaacactacaggaagtccttaagtctgagaaaagacactacataatttgaatacatgtgaagaattaaagatctcttttaaatataaagctagtgctgttgtattgttggtatggagctgctgtgttttccatgttatttatgagatatatggaaaaaaatcaataattataaagccatgtacataggcacaaaatgtttaaagatgttatttgtgacattaacaaggtctaaaaggagaggaaatggaactggataggaacagaattaatggatattattgagactaagttcgtagcaattctaacaattttaaaacattaatcgttactccaatgataactagtaaaaactaaattgagtgtataagggaaagaaaatgaagaaggaatccaaatggacccagaaaaaaattaatagaacacatgggaaacaattattggggtaatttaggaacaacaacaacaaaagataaaagatatgtagaaaacaaacagcaaaatgacagactttctttgttatcagtgattactttaaatataaatggattagattcaccacttgaagcaaaataacaaaatgaaatttttaaaagtaaaaaaaaaaaatagaatccatgatctatctacatggtgtttatggagaaccaatttagacccaaagacacaaataggttgagtaaatagtaacaaaagaactggtgtggctgtcgtgacatgatgcaatattgacgttaagtgaattatagttgtaagtgagaaaaaagggtattccttattgataaaatggtcaattaatcaagaagatataatagttatacacacgtatgcaccaagcaatagcacttcaaaatatgtgaaggaagacacatttaaaataaaagctagagagatctataatataaattggagacttcagtaccccactttaaaaaagaatagaacatatgaacaaaagattaatagaaaatgcagctattgaacactataatccagctagacctaacagatatatacaaaatactgcacaaaacaaaagcagaatacacatctactcaagagcacatggaacattctccagaatggacgctattttaggccttaaaacaattctcaacagttttttaaaacttgaagtcatacagggagtcatctaaaaccaccaggaaacgaagtttgggtaggggaggaacaatatttccttctactcaacttagatttattggccagcagtccctatcacacaagacagattaaaaaataaactcatgcacatttattaaatataatttttacttggcatgggagctttaataaggaaatgaaaactcagagaaatggctgaacctgaggactttacatttaggtatgatgaggagaatacaggtgtggagaaatatgactaagaatgaagtaaatgcagtaaatgggggaaagagcaaggcctgtgttcattcttctcagcacaccttcattttagaggaaacaatgctctcttttcctcttctttctaatcaacaactcaactttacagctcatggaacaagaaagagaaaagcaaacttaaaccaaagtccacagaaggaaagaaataagaatcattagaccagagattaaagaaatagatgagaaaaaaaactataaagaatataaatggcataaaaagttcctacttggataagaagaagaaaattaacaagctgttaggcaaaccaactaaaaccataagagagaagacacaaataacaaaaataagaaatttgggataatacaaccaacgttatgggaattaaaatgattataagagaacaccataagcaactgtatgtcaaatctagaagaaattgacaaattcatagaaaaatacaaattaccaatctaactgaagaagaaataaaaaatcagcataagaaatagattaagtcggcaattgacaatttctctaaaaagaaaagcccagagccagatgtcctcactggtaattctactagagatttaaggaggaagtaataccaatcatactcaatctcttccaaaaatagatgaggagggaacactgcctagcacattctagaggccagcattagcctcgtagcaaaaacaaacaaggatactataatacagaaaactattggctaatactcctgaagaataagcatctaaaattcctaaattaaataagagaaaaccaagtctaactacacattaaagagaacacatggaatgaaaaagcgagatttatcccagaattgcaaggatggttctacataagcaaatgaatcaacgtaataaacaatatcaatagagtgacaagaaaaagcatatgatctcagaagatgcagaaaaagcatttgacaaagttcatccactttcaagacaaaaacacttagcaaactaggaacagaaggaaacctgcacaaattgattaaagaagggcctttatcaaaatccacagtgaatctcacagtaaatggtgaaagagtgaaagcctccccacaaagatcagaagcaaaacaaggactcctgctttcacagctgctattcaacattgtccaagaagtcttaaatttcattaaaacaaaaaaggctagtgctacctcccaccacaagcatggatcagcgttaggaaattaaaataatggtaatagaaaaattataatgacagtgatgatggtgatggttttttaagtacacaactgaggtttagtggcagaaatccggtacttccaattacagtgcagctgtgcttattggggtgacggaatcaatctcgttttcagtatacatgggaagcaggagtacatgtagggtacaactgcatttctctggaactgtttttcacagaagagctacagtttatcctgcactctccattctgtgatcaaaaaccatgaaacagagaaaagcacttcaacctgagactcagtcacaagaactgcacctgccccaccttcccgcaactatatatgccacctctctgtgctgaaccatgaaggccagaggggttcacatgtggcacagacggaggctggactccctggtccgcaccctcccaggtgacgggtgctctgggatcacctggagaaggcaagtgcctgggctctgtcttttccaccagcagagggcagcagagctgcagccagaagagaggctggggctgcccaggaggagcctatgaaggaggccagcctttgtggggggtggtcaacaggtgttcaagggatcagtcctcactttggaagtttggtatagtccctcctgtcacctggggctgcagtgttcatattctgagggtcagacacacagcatcacccaggatactgacaggggcccaggcacagtgacggcctcagctgggaaacacaactggaggcacctgggccctggtgtcagcctgggcagctcccatagggctaggatttcctaagagacgctccgaggtcaaggtgctctaggagggggaacagtgtgaggggacagggctcccggggctcaagcccttcacccaggatggctgcctgagcctcctgccattctaagggtctcattcctccgtgtccagcagcatcctggggagctgagccctctacacttggcacttccagagacaccctaccaccccctccctctccctctccttccagctccaggccgactctgactcagaggcagctcctatgctcaggggattctcaggtgggtggcgtgggacatttgggatcctggtccctggatggggcattcccagcctccttgcggagatgctctccagagggaagggaatgttcacctgcctcaggccacagctctgaccatgggactatcctgggctcagtgacaagatctgtctggctggagggaccagggatcccccaccctccagagctcatgggtgttcagagaccacgacgctggaaccctcacagagaccaaataacctaaagttagtttctcagtcaggtctgggtttctggtgctttttacacatttatatgaaacactgatgagaaaaaataaagaatcaaagagcagaggatggcaatttctagtctattagagagatggggggtgtcatacaaggagcaactcaggtgagaaacgagactagactgtgtaatgaatccacatgagttgtggctgctcaaaggaccaaaccatggtaatggaaatcaagtttaggatataagtatcctaaagacacagaaccacattctaattaaactaccaggacaggaccaagtgagtctgggaaacccagagctgacttggaggaggaggaagatgatgggttcctggcccacctgctgctgagtcaggtgtcattgatgatctctcagcacggcccagctcagccccatggccaggctcctggaaggtccacagccctgctgagcctggcctaggacacagcacaggccaggatggtataaaacagtggtcatgtggccaaactccaggaggtgactgtgatcacaggccttcaaggatggagtctgatcttctgaccagagaagcagataaagtgagctgggacccacttcttcttcctcagtctgctgtgcttcccacagagctggtttgagtgacatccttcagtgaggagtcccagaggatgccgatttgcatcaaacactcactgcctcaaacggcctgagaggcaataagagagagctggtgagcccagctgtgctgtgggctcaggaggcagagctctgggtgtctcaccatggcctggatccctctcctgctccccctcctcactctctgcacaggtgctgcccccaagcccttccttcaggctcagaacccataggatcctgagctgggcctgcccaaacatgagttcatcccaggcacaacctcagggtgggaccccctgggaacagattcatcatttacaagcctcctctcctgtcctctcttgcaagctcctatgagcttacacagccaccctcagtgtcagtgtcaccaggacaggcagccatgatcacctgctcttgagataacctcaaagatgagtatgtttactggttctggcagaagccagaccaggcccatactggtgatatatgaaggcagcaagcggccctcaggaatttctgattttctgagtccagctcagggaacatggccaccctgaccatcagcagggctcagactgaggacgaggctgactattactgtcacaggtacaatagaaacagtgatgagcccacagtgacacaggcagattaggaagtgagacacaaaccccttcccaatctgtgtcaccctctttctccagccccaggatggctgtggacaaagccatgagcagggctggtccagttcacccagttctgtgacccccaggctgctcttccctccagccctccaggcaggttgtgaagagggtgagttaagaagagatttgaggctgtgtgacaggctatcctggggtttttctggccaaggataaagctggtgaaagagagcctgaatggacgggcagacagagtggcccatgcacgtagtggcaaaagacctgggtttccacatgccagcccttcaggcaggctctgcagagagtgggttaggaggagatttgaggctgtgtggacaggctgttttggggttttctaacccaggataaagctggtgaaagagggcctggatgaaaggacacacaaagcgtatctttcatctagtggtaaaggatgtgagttccatatggtgaagcctgggtcaccccttggcccagacgtcctaggttagtcctcagcatttccctagcacttaagttcctgaatctcctggcagccttatattcaaaacggtgtaagctggagtggacgctgtggggtccacctagactccacgttaaggtcgacccacacactctcagagcctacgagtggatacccatgctgtggggcacatgtcacctgacagagtggctgaccacccctgatctcttctttctgaccacttgggtgtttggcactatgtccatcatggacactctatgggctattaacctatgattcaaagtttcttctgtgtggtgcccgtgcccaaagaccacccacaggcttctgcccatactccacttcccccatttccaagtttttctcttgcagtccctggaacacctgcccaggtcatttcccactgccctaagcccctatctgccctggcatccggccactcacctttcctcacaaaatgaatgaccaggcgccatgccctcatgcaggaaagatgtcccctctccattgtctcttaatgccaccccttagtacacccatatagtgcagctgtgctctacttcatggtgatccagttcattgctgggctactctggaaatttttgctccatcagctgagcagagggactgctacccacacaacgtaagtgtaaacccagggagcagtgctagagcaagagagatgcaaacttggctgtggaccacccacaggttactcagctctggggccctgctcctgctccatcctagctgtgtcacatctgtctcaccagggatcgctgctggggtctgcctgagcacacgacgggggaatctggcagttctggctgcttggtcactgaatgtccgatgctgtcctgtatctaccagggaacaagagcacatggggagagttgttttccaaatgaatataattctctcttgtggatgacatggaattgttccaaatcccatgggattggaatcccattgggaaaatctcatgggattttcccatgagagattgcgtaaacatgagttttcagttcctatcataaattcttccattcctatcaccaattctgtgactatggtagagtctgctggattctgtggtcccaacagcaggacactcatacccctgcctgaacctggtgcagaacctccctgctctgggctccaaaacagtgggcgatgttcatggctcctgatatatgagttggagccacatccccaagggttaaatatgctgcctctagacaccagaatgaccttaaagctttgtgtttctttctggtgggaattgtaagatctaataacgtgctctttattttgtgagagatactaagctgctccagagaactcaatcctaaacatttcagctactacacaggatgaatggtcttagggcttgtttcgcactctcaggaatgcgtgggtctcaccaaagcttccaatagacagggccccctcatgcacatctgatccaaatacagaatagagccctaggaggttctcctgggtgttcagatggtcaaagcccctatgacaatatcatgaaaaagaagggagagttaatgaagttgaaaaaataaaagtataaacctatactgctgtctactccttgtatgcacaccgtttctgatcctgttctgagaggaatagaatgagtttctgcattgatggtgcctgctgtgcacctgtagccatgcatggtggtgtgttctatcagggtcttcatctggcacagcaatggcagatggaactaccagctgactgcgtctgtagaaatccacttccatcttccaggatccattcaacaattgtaggaatcatttcagtaaaccaaacacaagagcctcaactataactacaagtcctccaggagaggagaacgctgtctcagagggtgcattcctactggaatttctcttctctttgggacaaaccagcccagaggaggcacaggggctgtgtgtcatctggtttcctagatgaggtgtctcctcctcactgtcctgagattttgaagaaactggggagattggtgcagacactccttggatccttacaggaaacttccttcagaccacacactcctcaatttgttcccaagctccaaagtttctaaagtcactgtctaaagggcccacagtgtttttgtggagtggtggaaaagctctggggatggaaagtggtggtggttgcaaagcattctgaatgtacttactgttgctgaatgcacacttacaaatgattgaaatggtttaaaaattgttcattttgccataataaaaatactgcacactctggaggaaagtaaacctagtttaattttgaaattgttcaatggataccaatcaaagaatagtgtagcaagcaccatttcccctctcgctatagcagcaactgatccccttgtgctcttttggactctctcccctgctctctctctctcaataataagcaatgctcttctctccagtccaagctcacacttccccagttgtgcaggaatgcctattgtaactgttaatttatttccaggcagagtcctcaagattcctctgctcatattctgttctcagctgtctggagccagcatgacaagtgagccaagatcacttgtcatgagagacttgtggaaggttttgcaaaaagttccccaagaaaaaacaatgctcattgttgacagcaggtccatttccacacagtagggccatgctgggtgtgcagtggggctgtgcacactgtgcccacaggccaggctctgcactgctgactctgatcctgtgcttggtaggaccttgtgcactgctgagtccactgcagactcgaccctgaatgggaaggtggttcctagctgctgggcactgagtctcatagagggacagatggtattgaggatgcccggcccctgatgtacataaggggacaaggtctgctggtagaacaggaagatgaaggaacctgtggctctaaaggtggggtctccagccctcagtctcagctgcccatggcctcatctgtgtgcaccttgtcaatccagaccatgtgaattagaggtgaagggaattgaaggactttcccattttctcccattttctctcttggttacagaacgcacccttccacatatactgtattagagcctgtgctctacaaacatacctgacactaaattagtgacttttgaaagtgcagataggtacagcaaccagtccctctggagacatttcccataacatgaaccagtgaacccatctctgaaagccctcatgttttaaaagacaagatttttgaatttcaaggaaaactaaacctttgaaaaaaacatgattcaaaagagaaccttgccactttccattcctgcttgggctgcagtgaggacagatgcagcaagtgcttctgatgtctgtgtctgttcccctgtgtggacgcacatatccaggcgagtttcagtgaggtaggagacttcggcagcattggccgggctctggtttgcttctggtgctaacggaacatggaagagaggacaaggtagcgtgtcctgaagatcacatatttcctttttgcaggaagtgcctgggctcctggagtgttctcagggctttgatccaggccaccggctccgcaatcaacatcactgatatttcagcaggtcattgacctaattccattttagtgctatctcaaatggaaacattattttcttgtaactattcatatagcaacatagcacttaaatatctaaataacacacacagaaacagtagtctcaaatgcaaagctgtcacctccccacaccacacactttctcacccgagcccctgagcccacccttccctcggccccccctctcctgtgctgttagaaatctctgtcttctaacagggacagtgacacaaaacagccccccctcccgcccagcactcacaccgcagagcccctagtccatctcctgagggaacgtttacgtttctattctgacagagagaagtcgccgtgaatggagtctttaccccaaacccaggagtttctgaggaacacatggggtcagccactgtctgtgtggggaggcttcacctcagggaggcgcccggctctgggctgagggggactcaacgtgcactaaaaggcaggactaaggcaagtcccgggtcacagtgtgagggacgcacgcgccctgaggaggggtccctggtgctaggcctgacccaattctaaccccaggcacctttcctcagctcctgtggccctgggacacctccctaccctgcttcccatgaggctggtcacagctcttgtgagcaccgcctcctccatgtcacactttttctgtcaacattttgaggagccagttggttttctcctcattccatgttcctgtcccacctgcctgctgggggtggatttatttcatgtatgaggtttcctcagcctgagccacagctgcctcaaggacaccaaccctgtgggacactcctctgggaaaagcaaacaagtgccaagaggagcatctgaagctctggtgtgggagatgtcctccaccctgggtcaggggagtctggaggggatgagaagggaccaggggcctgggattgagctgtgaagggaaccaaaaggcaggagggacagggcaggggctgtcagctatgactcaggggaggttcctgggcctcaggatcctccctctgaggccaccagggggcgggggtggcacatgcctggacctgggaggtccctgctgggcttcaccctgggtgggtcctaggagctccttcctcctaagtccccctaaagagacagaggcattctggggtcctaaatctgtcatgcccccataaatgcatttctacgagggccaataaatgaactccaggtttatccaagcagcagcttcaggcgtctgcagacacagagcggggaggaattagccaacctgaggcaccctagaagggctgaagggggctgaaggggactgaagggtccctgtggggcctgtggtcctggggaggggagagctggggtgtctcccagccactctgggccctgtcctgacacttctcccacaaagaagggaagggaaatcctgggaccccacagccaggaccaaccgtgaaccacaggacaggaaggacagggacccccaaggctggctccatttcccaggcactgtcatgggctgagtctcaggaaatccaagtcaaggagtttcaatccccctggctgagccccactgtccaaggaaacagaagtctacgggcccaggcccaggtgagggtggggtaagaagaggagcttaggatgcagatttgcatggaggccccgccctcctctgaggcatcagggtaagacaaggctgggggcaggcccagtgctggggtctcaggaggcagcgctctggggacgtctccaccatggcctgggctctgctcctcctcacctcctcactcagggcacaggtgacgcctccagggaaggggcctcggggacccttgggctgatccttggtctcctgctcctcaggctcacctgggcccagcactgactcactagagtgtgtttctccctctttccaggctcttgggcccagtctgccctgattcagcctccctccgtgtccgggtctcctggacagtcagtcaccatctcctgcactggaaccagcagtgatgttgggagttatgactatgtctcctggtaccaacagcacccaggcacagtccccaaacccatgatctacaatgtcaatactcagccctcaggggtccctgatcgtttctctggctccaagtctggcaatacggcctccatgaccatctctggactccaggctgaggacgaggctgattattagtgctgctcatatacaagcagtgccacttaaccacagtggtccaagttcttggggaactgagacgaaaacctgccctgggctctcaggctccctttttgctctgaagatgtttcctcacccagtgcaacgggcttcctgaagcacagccttgagaattcttctccctcagcaactctcttttcccaccatgaaatccaaaggaaacctgctctgtggtttctcatccaggacagggacagcttccttttgcttgtgtgttgtggtccctgagtgggtgcaactcttcctagctttttaaattatgggagggtgacaatgagctccctgactggtgcagtccctgctgttttcaggaacatcctcatcctaaatgcatctgaatctcccactgtgtgcagaccaatctggacagatgttattagggggagtttccagaagccacatcttactcaactctgtatccaccacactctggtgaagatgcttttttggtgcccatcctcttgggtaaagtccactctctactcatgacagccatgtgtcccatcttctgaacttgggaaattgccacaccaaaccctcaggctcagggcccacataggagctcagaaagacgcactgggaaatggagaagagatctgcatccacccctcagtggagagacacctaactagataataagataaggaagtaggtttgcatgatgagtctccccttcttatgataagagagacctagagacccccttctcaggtgtgcgctcagaggcagaactctgaagcatctccaccatggcctggacccctttcctgctcaccctgctcactctctgcacaggtgctgcttcccagggctcaacccccacagcaccagggaacagcctggccctgactttcagctcatcacggcagtgatgcagggtatggcactctgagaatgagaccctcatcttcagactcacctctcctgtcctcgcttgcaggttttgtggccttctctaagctgactcagctgcctgaagtgtctgtggctttgggacagatggccaggatcacctgccatggagaggacttagaaagctattatgcacactggtaccaacacaagtcagtccaaacccctaatctcattgtatacaatgatagaaagctgtgctcagagatcactgagcgattctctggttcctgctcagggggaacagccacactgaccattactggggctcacgttgaagacgaggctatttttgtttttctggagataaaaacacattcatagtgacacagacagatagggaagtgaggcacaaaccccatcaccatctgtatcactctctttcttaagccccaggagtattgtggacaaagtcgtgagcagggttagcccagctcagctggatgtgtgaccccgaggcacctttcactctagtcatccaggaaggctctacagagggtgggtcaggagaaaatttggggctgaaaactaagctgtcctggtgttgtttagctaggtatgaattggcttaagatgacctgactggtaggacagtcacagcaagataaccattgagtaatcatgttgcctggatttccttttgtttaatgaccaaacctaaggtagctctctggtccaaaatgccctggattagtcccctggactcctcattctttaactgagacctttgatcccagctgtcatggcatcatgatgtcgtgaacagggaagtccattgtaatggcaactgtgacatcaggggtcatttacccactatctacccaaggccgcagggaatccttggcttctcacagctttttctcaccggaaaatgccattgagtgcagagtactgtgtcttccaaggatgtgccccctccataatgtggtttgggagcaatgattgcctgatgcctagattccaaagccatgctttaattcaggatgaccttgaagtgcctcctgctgagtgctcaattgtaacacattcccagaagagcctcccacacttattttctgggactatatacccgaaccctactgcatggaattcaacctctcagagtaactttccaagaaacccaaaaattaaaaactaaacaacaacaagaaaacaatatagagagaagagtatcaaagaaaagcaagttgtacaaagagagaactctggagtcttcaaatattaataagcatcaagcagcacatgtgtggacggaaactccattttcagacaaacagcagtccaaagacactcgcgggaacactccacagagcattctttctctctctctctctctctctctctcacacacacacacacacacacacacacacacacacaaacacaaaatatgaatcctgcttgttcctacagtcacagaggaaaggcctgagttaaggagcatgaggtcgaatcctcggaacagctttgcctcagtcctggagaaaatgtcagcctagacaataggctggtctggtctcaactaagtaagttaaaaagcaagttttaaaaagtaccaagtttccgagtaattatactaaatccaagaataaaagaccaaatagacagagaagtgcaagtatattctaaatccaacaaggaaaaactcaaaatgtctagcacctatcagatttccttgcaagaaccaagaaaatacatgctataaaaagcagaaaagttcatcagtccaaagtctccctgaaattgcacagatgatagactttgtaggaagaatacaaaagcgatacttataactatcttccacttgctcaagagggtacgggattgattgaacatgttaagtggagacacggtagacataaaaagatcaaagttgaacttacagaaattacctctaaaatgtccgcgataaaaataaatacataaataaataagggccaggcatggtggctaatgcctgtaatctcagcattttgggaaatcatggtagaaggattatttgagcccaggagtttgagaacagcctgggtgacacagggagaccctgtctctacaaaaaaataacaaaatcagatagatgcatggtgcacacccatggtcctagctacttaggaagtggtggaagaattgcttgagctctgtaggtcaggatggcagtgacctgtgatcatgccgctgaactttggcttgggtgatagaatgacaccgtctcaaaaaaaaaatgtctgagaataattgtagattagctcccgcaaaataatagattactgaacctgaagatataacaatgaagctcttcaaaatgaaacaccaaaaaagagaagataaaaaattacactgagcatcaatgagttttacgacatcttcaaggagccttaattgtataattaaatgaactaaaggagacaagattggtggagggagagggagggtacaaaaaccacttaaagaaataaggaaaaacgtgcaaaatttggtgaaaactataaacttatgatttcacatagtttaacacaacccagacacccacacacaaacacaaacacacagacatcatatacacaaaaaaacacacacataaagaaaacatcaacacccgccataatcaaattgcaaaaaaaaaaaaaacaaaaacaaaaacaaaaaaaaactgtgatggagaaatgctcttaaaagcagccagagagaaaagacatgtttgatgcaggtgaacaccataatgatgagagtagctttcccattagaaacaatacaagcaagaaggcagtggaggtacattcataaaactttttaaaacttactacgcacagcattgtacatattcagtgtaatccctatcaaaacaccgatgtcattcttcacagaaatagaaaaaaaaaatcaatcttgaaatttatatggaattacaaaagacactgaatagccaaagcaatagtgagcaaaaagaataaagctgcaggtgtcacaccacttgttttcaaaatatgctacaaggatatagtaacccaaattatactatactgttttatagtataaaacagacacagaccagtgtaacagaataggaaacacagaaataatccacatatttacagacaactggtttttgtcaaaggcaccaataacatacattggttaaaagacagccttcttggtgctgctgagaaaactggacattcacaggcacaagaattaaaatagacctcgatctctcaccacatacaaaagtgaattcaaactggattaaagacttaaatgtaaaacttgacactactaaactactagaagaaaacacagggaaaatagggaaaatgcttccggacttatgtgtagacaaagattttatacctaagctttcaaaagcacaggcgacaaaaacaaacatagaccaatggagctacattaaactaaaagtttctgctcagcaaagaaaacaataagcaaagtaaagagacaacttgtagaacaggagaaaatatttacaaactgttcatctggcaatggattcacatacagaataagacaataagacaagaaagcaaaacaattcaacagcaaaaaaaaaaaatgccaaataataccattaaaaagaggtcaaagaatttgaatagacatccctcaaaagaaacatacaaatggccaaagggtgtattttttaaaatgctcaacatcactaatcatcagggcaatgcgaatcaaaatcacagtgagacatcatctcaccccagctagagtgactaatatcaaaaagacaaaacataacacattctggcaagaacgcagtgtaaaggaactcttatacactgttatatactgttggtgagaaggtaaattttaaattaatacggccattatgaaaaacatgatagtgtttcagaaacactaaaaatagactatcatcatacaatgcaataatcccactactgggtatttaatcacaggaaaaaacgtcagtatatctaaggaattcctgcactcccacgtttactgcagcactattcataatagcaaagctatagaatcaacctgttttcatcaacagatgaatgcataaggaaaatgtggcatgcatacacgatgaaatactttccagtcataaacaaaagaatgaaatcttatcctctgcagcaacatgatggaactggaggtcattatgttaagtgaaattagccaagcacagaaaaacaaatgtcacatgttctctctcatgtgggagctaaaaaaagctgatctcatggaggtatagtgtagattaatagttaccagagaggctgggaagggttaggggttgtggggatgaggggtagttggtcaatgggcacaaacatacggttacataaaagcaataaggtctattgttgtatatcacacagcagagtgaacatagttaacataatttattgtacatttcaaaatacatagaagatttgaaatattcccaacatatagaaatgacaaatgctcaaggtgatggatatcctaaacactaattcgatccttacatactgtattcatgcatcaaaatagcacgtataccccataaacatatacaattataatgtatcagtaaaacatgttctttaaattaaaaaaaactgtcaattctgaattctttactcagtgaaaatatctttcagaagggaaggcaaaataaaatggttttaaccataaatatacttgcactattcatgacctgcagacacacactatagaaaataataaagaacacttctcagatagaaaatcatactaaagatgtgactctgaataaagaaaacaaaaacatcaaatatagtaactacataaaaacatatagaaatggtaaataaacatagatataaacgacttaaattacattacaaaacaactagacttaatagacaactatagaacagtccatccaacacagcagaatacataataatctcaagtgcatatggaacactctccagggtagaacctgcaaaaaaaaaatgagtaccttaaaaaaatagaaaatctataaagtatattctttgtgttacttcactcttgtattgctataaagaagtacctgagcttgggtaatccataaagaaaagaggtttaattggctcatggttatgcaggctctacaggaaatctggtgccagtatctgctgctggtgagggactcaagaagcttacaattatggtggaatgtgaatgaggagcaggcatgtcacatggtgagagtaggagagagagaggtggaaagtgccacactcttttaaacaaccagtctcacatgaactgggagcaacaactcattgtcatgagggcagcaccaatttattcacgaaggatccacgtggccccatgacccaaacacctcccactaggcccacctcaacactggcagctacatttcaacataagatttggatgggacaaatattaaaagtatataattccacccctggcccaccaaatctcatgcctttctcacattgcaaaatgcaataatcccttctcaataatcccccaaagttctaagtcgttccagcatcaagtttaacatcctaagtctcatctgagactaacctcctgtcacctatgagcctgtagaatctaaacaagttatttacacctaagatgcaatggtggtacaggccttgggtaaacattaccattccaaaagggagaaaacaaccaaaagaacaggccccacacaagtcctaaacccaatggtgcagtaattaaatttcaaacttccacagatctctagggcatgaaaagaattcagccaagctttttactaaggcatcacaagggtgaactttgctccagttcccaataactatctcattccatctgagacctcagcagcctggacttcactgtccgtatctctatcagcatcttggtcacaaccagctgaccagtccccaggaagctccaaactttccctcatctgtctgtcttcttctgagccctctaagctcttcaaacctgtactttttacccagttccaaagctgctttcacatttgcattatccttacatcaacaatctacttttggtaccaattttctgtgttctttcattcttgcatttttatagcacctttatagcaccgctataaagatgtacctgaggctgggtaatgtataaggaaaagaggtttaattggatcactgttctgcaggctgtataggaagtatggtgccagcatctgcttctggtcaggcccttaggaagcttacaaaaatggtggaaggtaaagtgaaaccaggcatgtcacatggcaagagaaacaaaaagaagaaagagagaaaggaaaggaaaggaagagagggaaggagggaagaaagaaagaaggaaagaagcaaaaaaggaaaggaaagaaacaaaacaaaaggaagaggaaggaaggaagagagagagagaggaagaaagaaagagagagagagagaagagatgagacgagacggggggggagagaggcagggaaggagagagggagggaggaggaaggagggagagagagagagtgaaagaagaaagagagaaagaaagaaagagagaaagaaaaaaagaaagaaagagaaagagagagaagagtggggaagtgccacactcttttaaacaaccagatcttgtttaaactagtggttagaattcattcgttattatgaggacagcagcaagccaatcatgaagggtcagccctcatgacccaaacacctcctactaggcccacctcctacagtggagttcatcttccagcatgagatatggaaggaataaacaatgatatcatcctctgaacactgatattgaaaaataaaaggtattatatgagaacactgtgaaaagctgcataccaaaaattagatgaaaagaaaaaatccctaaaaacataaaaactactaaactggctcaaggaggtatagaaagtctgattaacactataacaagagtttaaattagtcattgaaacctcccacaaagaacggcccaggcatgaagggtttcattgatgaatattatgaactgtttaaggaattaataataattattcataaacccttccaaaaatataagaaaggggaacatgagcagctcattctatgaggccagaagtatgctgatacaaaaacaaaagacatgaaaagtgaactggagcacaacagcctctatgaaaacagatgcaaaacaaccacacttcaacaaaatactagcaaaatataaaaaggattaaacaccataactaactagtattcatccccaatattcaagggattcttaacctatggaaattaattattttaatgctccctattaaagaataaaaccacatggttatttcaacagtcacatcaaatgttttcatgtacgcagacaggacttcctgttgttttcccattcctgttaaagcatcataaaaggcacgatttgtggtgctactggatggggtgctacttcatgcaaactggatatgtcatgtccaaccatgaatatacttagccataaatgctaaaagattgtaatttggtgtcagagacttggtggtcagtgaccacttccttggcaagtggtaagtacagacatctgaaaggataactaggatttaggtaggtattggataaggaggtgagttacacacagaaaaagtttcacttaaaaactcatagacgcttgaacacagaagatggctcaataggtctgagaaataaacaaagtccagaataactggagctgaatggaaacaaggcaaatgacatgaaccatctgtttctctctcgacaactcactggggcattgtctcctccctataccacccacgtggattgtaaaaacatctgttcttaaaactttcttgtgcatcatgacagcatgtagcacctgaatccagctcagttaaatgagggcaggacagtcaaccacaaaacccaggtggcccaggaagcacatcagggagacaagaccttgctgtcaaaagcagaggaagtgagattttccattgtggctaagcccagagcatatgaaatttcaatgggtacacaaaaaccatatagggtttggttaagctgcagatgcagtctttgcaggtttgaatggggccccagattctccatggcaaatagcctccagttgaggttgattgatgctggtcctccaaggaacacactttgggtggcttagctcctatgcaccctcctcactcatgcacagctgaaactcacctacataacgcaccttctgagaagcataagtgacctatttctcctccactaatgtgtctcagtcccttttactaaaaaggaatatctgaagttgggtaatttgtaaagaagcaaaggtttatttgggtcatgcttctgatgtctgtaaagttcaacagtgggcatctgcatccagtgaagacctcaaactgcttccactcctgacagaaggtgaagatgagccggtgtgtgcagaaatcaattggaaacagaaagcaagttctttcctaaaaatactgcaggagtttaatgatcatatttacaaagtgtttaacacagagcctgacacaccctagctgctcatgagttggcagcaattattgctgatgtcattcatgaaaattggacctcagatggagaaactgcagtgcagagagtttgagaagtttagggacaagaaagacttagtgacttaaaatcgagttctaggaactgaggagagcatccctgggcattttactgccatcttttccaatgtctcagaaactgtttcaatgtgacgtcaaccagagaggaaagcagaggggtttgcagaaccaggggctacaacttcatccacgggagagtgatgtagtaagcgggtgggaaggggcagctgagctcatctgaagggtgtttaaggttttctggcccagggatctttggccatctctccctgcccagggcctcattcttccactgaccggcaggagctggagagtggcttctgagtctggttagagatcccagcagcacccagagggggaagacattggagagacgggtctaaggtcactggagacactgtttgctgcctagagggctgcgacaggctccttgaaaacaaaattcagacactttaggggaagaaaacacaggatgggaaggctcctcaccaggggattgtggataacagagaccaaagcatctacaaggagcccagccctactggaggtgccctgaacacagagatcctaggggtgtctgtattattttgccagggctgccatagcaaagtagcacagccctatggctcaaagaacacaaatgtattttctcactattctgcagatgatgttagaatctaagatgaaggtatctacagggttggctccttctgagcactggagaatctgttccatgcctctcccagcttctgctggctgcggaggtgtttgctgttccctgccatggagggaaatcaccccaatctctgcctcacattcaaatggagtattcctcatgtgcgtgtctgtgtcacagtttcccctttttataaggacatgagtcgtgttggattgggtacgtactctgctgcagtatgaccttttcttaactaatttcaactgtaatcaccctatttaaatataaaatcccactctgaggtccttgcagtgaggacttcattatacaaatttgaggggactgaaattcaaattcctaacagtgtgtctgccatgactcaggcctctccttggggctctgcaggtgggatgtgcaccaccaacctctcaggtggggcattacctgacagcccagaaggaccccaggccctctgaaaaatgacgtctctttcatccaccttgagggacatgttttctggctgtccttctcatcctttgcatgctgacatgggagacatcatcctctgctttttaaagaaggactccttcaccttcccaatcaccccaagtagatgcccatgctggttccacagaatcaaaccacggtgggttacgagttatattagccaccagctgacaatattccctgaatgtccaggatccacccatgctctctgaccatcaccagagtgagcaaatctctgatatgtgggtaagagtttctcccatgggctcccagccgggctgtaagtgaggcaagaccccttcttcagtgcacggggctcagtgcagctgcctccctgaccaagtcttcctgggacactaagcttatcagtttctctcccccagggacagtttttggttgtcctaagcctagctcagctctgctatgaactttgcatcctaagagcccattaaacacccccttgtgcctcaatggaataacctggagtaaatagtgtgaggtgcccctgctttctgctcccagggcctcttctcctcggtggcaccagcactgccctattgaccagcaatcctcacctgcccattcaggcctctacactgcctaccgtgaacagtcacagatcacaaactgattgccaaatttgtgcagatcatcttgacagtttctgtggaactgggtgccttctcatagaaccaggaagtcacaagccaggccagctctagagaagcaactgggggagtaacatgcatcacagcgcctggacacaacaaagggattttgctgtagtcctactaggacacatcctagtgatgtctctgagaaccagtcttggtccctgcaacagaaagcctactaaacaggacagtaggctgcaaggttgggcacaatttgtgccgtgtgtgagccatgtagattgtgcatgtgtgtatgtgtgtacatatgtgtacatgtgcatttagtgttgcaaggaagggttgtgtcaaatgtcccaactcaaaacttttctgttttcctaagttatctgcttctatctttactacctttgtactatcataagaataaggataatgattagggttgaaataggagaaggaataatgtttaattattcattcttatgtgtttaatacatatcaagcactcttcaaaacaattcatatttattaaatcactcaatacgaactactccatgagccaaatattgtcattatctctccatttccagttggagaatctgtgatacagattttgacacatgggaaagctaaggcaaagaaaggaaaaggactttgcccgatgtcagaactagaaagtgcctgacccaggagcagaacctgagtcttccagtcccagagaccctgttctttaacaacagcctgtgggcctgtcactgtgctttaaggtaaagcactgacatctccctaagactccagaaagttctctgtactttttgaatcaagtaactcatacttgcagtgatttccaatgcagtaggaattctctggtgctgaggagtctactaggaatataatttcaatgcctttaaaatttttcagtagccacattttaaaagtaataaagaacgggtggaagcaactttcgtactatattttctttaactgagcttacccaaatattatttcaatatgtaatcaacataaaaatattgagatattttatgttattttcctacaacctttttgaaatccggtgtgttttacccccacatcacatcttaacttgaactacccacattttaaggactcagaagctccctgggactcatggttgctatactggacagagcagatccacatgaatgatgatccatttggatcacagcccctgcagtacttacttagaaccatcttggggcaatggagagtcctatgacccagagggcctccttagggaagaatggctgttccattttccaaccaaagtagaaatatggcgggctctcagaaaccagggaatttttacaatgtgtttcacacttcttcccttctcaaagacattgactataacttccagttcgaagataaatctgagccatcaaaggcatttttttctattggtcagtggaatgaatggcaatggtccctgtggattgtgctccaaggatccctttctgtgggaagattcttacaataaaaccaactaaaagtaggaagttattgtttatatgtagatctagatgaaagggggctgatcatgaggaatatagtattgaaggtgagtgtgttgctattcttcacaaagggctatttttgcctaactcacaagcatcaatcatttttatgaaggtgtattttcccagagtggtcttagcaagttacatccaacgctgtatcaggacccacaagcaagggtgtcagaactgacctgcctgagcggtcagcaggaaccaatgtggagactctgaggtctccacaccaccaaccatgtccaacctccagtcaagtgacaggaggagtggaagcattggttgggaagggcttggaggagctgcagtgacatgctcagccaagtacaggagcaggcatattggtgtcatgtgacctcatcttatctcagttatctcttttcaccaaactccaaggtgcaatgtgtggaggcatctgtctgtacccatggacaccttgggcttcacacattatttctatttctaatgaaccagtgttttgttaatgaattcatttcatcacatccttagtacttctaggttggaaaagcaatacatgtctctaagatattaggtaggaaatattctcccgccactcgtatttattaaagttaaaatgcttcagtatctaatgtgacagttgtccaaattcaatacccttcaccttgttagaaatggaatcctgatcctaacttgtctggagaggaggctggcatgaggagcatgaccacacatctggatgtccccagtgtcactgctaacacacgctcttttgttacttgccgtgaagggagcagagggagcatccacacctttgtccaaaggacttggaggacagtgcacctgattaaaaaatgcagggctgtgataagtgggttccgggtcctggatgagggaagagaagatgaggaggcatggggtaggaggcagggcagggaggagctgtaaggtcaggctctgagtatgggtgaaatcctgactccactcactactctctgggaggatttgataaatcttgtaacctcctgatgttggttctcccatcaataaactaaaggagaggtcgtgtcttaagcgtatgcttgctgtggggctactgtgaatgtgtggttgaggtggtgcctgcaaaacactctccaaagggcctggcacgtattaatgtctcaaaggagtcattctgcttaagctcgtggaggatgactttcctcctgtgtgcactagagggccttgttttgaggaccccagtgacttccctggtagggctcaagcacaaagggcatgactgatgcttcctctgaggccccttctattgggtaaaattcatgctccactcatgacacccacctggcccttcttctgaccttgagaaattgccaatatgaagccctcagactcagagctcagacagtacctcagacagacatgctgtaaagtggagagcagatttgcattcaaagctcctcccttcttgagcttcaagaagaggataagacaggagctcatagtgtccaggttccactgggcagtctcgaatagagctcttggaagtccctccaaccatggcctgggtctccttctacctactgcccttcattttctccacaggtcagaacatcccagggaattcagggaaatgttttcactgctattttcccatgagcaccagtcctcaggggcattctttccagttcttctgtgcattcagcatcattcatgacattctgtttacaggtctctgtgctctgcctgtgctgactcagcccccgtctgcatctgccttgctgggagcctcgatcaagctcacctgcaccctaagcagtgagcacagcacctacaccatcgaatggtatcaacagagaccagggaggtccccccagtatataatgaaggttaagagtgatggcagccacagcaagggggacgggatccccgatcgcttcatgggctccagttctggggctgaccgctacctcaccttctccaacctccagtctgacgatgaggctgagtatcactgtggagagagccacacgattgatggccaagtcggttgagccacagtgacacagatgaaggggaagtgaggccaaaacctcccacctcccctttctcctcagggactcagagtcaacagccctgggttcctctccagtaccctgagacctctgactctcctccctccaagacacccctaggcagaagcagatgcaggccatgactgaggccattttgaaaactcatctttctgtttcctccacaacagcctgtggggaccatgctgggagagaccagagcagcccaggcaggaaaaggaccttgagagagtggctaggatgagatgaccgtgtcccagtgtctcattgtgccctgtgctctattaccaggctctgccccaggaaaggacatggatcttgacctgtcagccatcatttatgagagttcaatttttacattttttaaaatataaaaactacaatctccaagatgctaggagcaatttcactgagtctcatcatggaattctgacctcccccagcatgtcccctgttcctacaatctcctgttcaagaccaactcaactccattacccagaccagctgctggatgatcaagacagggctgtgagagcctaagaatctttaaggtccacgatgagaacacgtcaagaaggatttatgttggaacttccttccccatggatattcacatcaacagagaagatatctgagttcttgcctacacctatgaatacctaagacatgaagtgtgtgtgtgcatatggtgtgggcagcacttcctcactcaacaccagagagtgtctgaggacactgggtacagacatggagacagggcatatttttatacactcaattaagccctcgtccttctctgctcaccaaggagccacccaacaaggccacagcaggaagagaagttgatttccatgaagagccttccctttctaagagtcctggaaacccactgtctagttgtggaatcagaggcagagctctggggcatctccaccatggcctggaccctcccctgctcaccctcccgactctctgcataggtgcttcctcccagggaataagccccatggaaccaggggtcagcctggccctgaccttgagctcagtgcagggagtgatgcagggtgtggggctatgggaatgagaccctaattctcagtctcacgtctcctgtctcctcttgcaggctgtgtggcctcctctgagctgactcagctgcctgcagtgtctgtggctttgggacgtacggccaggatcatctgccagggagatagcataggtgactctgatacaaactcgtaccagcagaagccaggtcaggtccctgtgctggtaatttatggtgacagcaaccagccctcagtgattcctgagcaattttctgactgcatatcagaggacatggccaccttgattattaatggggcacaggatggaaacaaggctattactgtcgctcggaacagcactgcttctcatctcacagtgacacagcatacagtgaagtgagatgcaaaccccttcccatctatgtcattctctcccttcaaccccaagaggactgtggtcacagccatcagcaggtctggcccagttcattcagatttgagacccccaggctgcccttccctccagtcctccaggcaggttcattagatggtaaatcaggggtggatacacaactattaaatatcatcatgttccaatttttcatgaagtagaggaatgattgaacatgttaagtagaagcacagaataaccaaaaaaggactaattgagcttgtgtacagctaataattgcaatgtctgtcaactttaaaaacatactggatgtgattaacaacagattagattatgtaaaacaaaagattagcaaacttgatcatgtagcactagaaaatattcaaaatgcagcacataaagaaaaaacaatgacaaaaatgaaaaagcattatcggatattcataaagaaaatgaaggtgagttataggacaacttcaaacagcctgaggttgactaggagtaatggttcacgcctataatcccagcactttgggaggtctaggagggaggatcttttaagactaggaattcaagaccagactaggcaacatagctctataatttaaaaaaaaaaaaaaaacttaaaaattaactgggcttcgtggcttgcacctgtagtcgtacctacttataaacctgaggcagtaagattggtagagcccagaaattcaagactgcagtgagtgagctatgatcatgccactggactgcagcctgggcaacagagcaagttcctgtctctaatatagggtctcaatctgtcattcaggctggagtgcagtggtgcaatcatggatcactgcagcactgacttcccaggcccaagtgatcctcccagctcagcctcccaagtagctgcgaatactggcgtgcaccaccatgcccagctaatttttgttttttctggagagactgggtctccttatgttacctaggcttgtctcgaactcctggactcaagcaatcctccagcctcagcctcccaaagtgttgagattacaggggtgagccgctgcacctggcctaaaaaaaaattttttttaatacaacaacctaagtatgtataattgacatccatggaatgtaaaaggtatgggtgggtagaaaagaatatttgaataaataatagtcaaatgtgctccacatttggtaaaaaccaaaaactggtatatccaagaagttcaacaaaactgaagcacaggaatcatgaagcaaatgactccaaatgacataatagtcaaattagtaaaatctggtgatgaagagccacttaaaagtatgattctaagagtacatttctcattagaagcaatgtaagcaagaagacagtggagcaataattttaaaatactgaaagaaaacagctgtcaaccttaaattctttatccaacaataataactttcaaaagtggaggataaatataatgttttcagacatataaaaacttacagaattgattactatcactcttgtcattagaaatgacaaaagacacccctagacagggggaaaatcataccaaattgaaatatgaattcacacaaatatcagataatgcaactccatttgaatatataatcacatttgaagacagattttaataagtgatatatgtatcacaaagcctaaagtaaacattaaacttttttataaaagaattatgactagtaagctgtattaggattctccacagaaacaacataaatcagatatgcatgtatgttatacgtgtgtgtatatatatacatatgtgtatagtatatatatgtgtgtatatatatacatgtgtatagtatacatatgtgtgtatatatacatgtgtatagtatacatatgtgtgtatatatacatatgtgtatagtatatatatgtgtgtatatatacatatgtgtatagtatatatatgtgtgtatatatacatatgtgtatagtatatatatgtgtgtatatatacatatgtgtatagtatatatatgtgtgtatatggtgagagaaaaagaacaagagagaaactaattttgaggaattggatcatatatttgtggtagctgacaaggatgaaatatgttggtcaggctgaaggctggaaattcaagtaagagttgatgttgcagtcctgcatccaaatttagcaaggcagcacttcaggaaacctccacatttgttctaaaaacattcagctcactaaagagtcccacccacattgtgaagagaaatctgcttatacaaagtttactaattaaaatgttcatcacatctgaaagttatcttcatgtcaactcctatactggtatttgataaaatcaatctggtgcatagcctacccaatctaacacttaaaattaactatcacttaacccagcaaggaaataaaaagataatttaaaaaatcaatcaaaaaaggagacagcaaaagggaaagaaaactaacgaacatatgggacaaatataaaataaagagcaagaagatccttccagctcagcctactgagtttctgggactacaggaaggtttgtagttctccttgaagaggtccttcacatcccttgtaagttagattcctaggtattttattctctttgaagcagttgtgaatgagagttcactcatgatttggctctttgtctgtctgttgttggtgtataagaatgcttgtgatttttgtacattgatgttgtatcctgagattttgctgaagttgcttatcagcttaaggagattttgggctgagacaatggggttttctagatatacaatcatgttgtctgcaaacagggacaatttgacttcctctttttctaactgaataccctttatttctttctcctgcctgattgccctggccagaacttccaacactatattgaataggagtggtgagagagggcatccctgtcttgtgtcagttttcaaagggaatgcttccagtttttgcccattcagtatgatattggctgtgggtttgtcgtagatagctcttattattttgagatacgtcccatcaatacctaatttattgagagtttttagcatgaagtgttgttgaattttgtcaaaggccttttctgcatctattgcgataatcatgtggtttttgtctttggttctgtttatatgctggccacttctcaaaagaagacatttatgcagccaaaaaacacatgaaaaaatgctcaccatcactggccatcagagaaatgcaaatcaaagccacaatgagataccatctcacaccagttagaatggcgatcattaaaaagtcaggaaacaacaggtgctggacaggatgtggagaaataggaacacttttacactgttggtgggactgtaaactagttcaaccattgtggaagtcagtgtggcgattcctcagggatctagaactaaaaataccatttgacccagccatcccattactgggtatatacccaaacgactataaatcatgctgctgtaaagacacatgcacatgtatgtttattgtggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccgcatattctcactcataggtgggaattgaacaatgagaacacatggacacaggaaggggaacatcacactctggggactgttgtggggtggggggaggggcgagggatagcattgggagatatatctaatgctagatgacgagttagtgggtgcagcgcaccagcatggcacatgtatacatatgtaactaacctgcacattgtgcacatgtaccctaaaacttaaagtataataataataaattaaaaaaaaaaaagaaaagaaaatgtctctagacagcttggttcctgagctgggaatcaaccgtcttttctctccctttcaacccagagtgtggcaggcgcgccccctacaggcagctaaaagagctgactgagatgccgtctccatagggagggatttgggctgagaatttgggctgaggattttcccatgccctccctggcaggctggtcccaggacactcagaagacttactgttacaggtccagagcatttctcgtcttccttttctctctccttgccaagtgaccttggaattgttcctccccatctcagccccttcccttttgtgttaagtgcagtttgcagattttgtgttcctaggtcctgtatctgtagaattttagggaaagcagtgctggtcacccacatggaattcaagacagcgagcccaggaccagaaacacagacagcagtgggggtccccacagagcagcatggtgggcaccaggtggaggtaagaaaccaggaaccactcccctgagtgtcttcagccccaggtgaactagggaggggtcagtgggctgggctcaacccaccggggactctcctgtcactgccccagcagcaccatcctggaagcccctatatgtgctaagcagctgccaaagaacttgattaattacctgtaaatttcccttcaccacacctgaccacacatgactcctgcccccaaattactaatttattaaaatggcacaattagccgaaatggcctgaatccaggacccctttcaggtttgccgctgacctctcaggtcctcacacatgccagactctttccacaggggcctgactccactgtttccaacacaaatcccaggactcatttttctctgtcagtcctgacagcagttccagagacacttccccattaagatgtccccaggctcttataatacaacctgtctgttattttctgcctaaatctttttaattatccccatagcatttacaactgtaggaatctttgcctattgttaattttattaattgattggtgttaaatatttacttaattggtcatggatgcttttttaccacagaatcacacataaaaaacagacacaaacagctaagggtgtatttctcgctgcaataatacccaccactttcacgaagacaccagggtctttctcactttttgtcccaccatccctatgatattggctttattttcatccctgctgatgtgtgacctcagggtggctgctgcagctccagctatcactcccatattcaaggagaaaagggcctcatgaatctagtgctctttcacaagagcaaagctttcctaagaagaatttcacccactgatctcacaccccactgatcaggcctgagtcacatggtcaatcccagctgagcaggacctgggaatcacaggcaccagtcttttcggtgaatatagaagacagtgctcaggtggaaggtgacagggactgtctgctgggtctgcaaacccagttttcccgcacagccaaaccagcacgatgaacaactcacttcaagaaggctgtgtcttgttcctgctgaattcaccgcatggaacgtgtcccagaccacagtgggtctggattaacatttgatgggtggatgttcttctgtctctgactttggtgcaggagtcaccactgtacgctggtcctgcatccacagcggggaccagtaagagccagtccctgagtcctgtgatccccgccctgcatgccaagccctggtattacccccatgaccacccaccgcccagacacatgtgcaggcagcctcagatggaccttcctcctcctcttccaaatattcatgttcatattgtcatgagtaatctgcacccctcgcacctggtattgaggcaggcatgagtcacaaagagaagagaaaaatttcctccattggcaccagcagtctgcagaccagggaatcagggacctgaacagaagattttaattatacacccggacccaggaggcccttgagcctccagcagccagtatggagcagccaccaggggacagaacagagtcacctggcaaagtcacttggagatagggtagacctgggtgacaaggagatgctgacatgcagggagggtcagtgaccacaacctgagatctagaaaggtgtcgtttttctacagcatcatccttaacatcgagtacaaattctccaggctttgtgtttctcagctttgtctctggccaatgttgcatatttgacacaggtgcagacactttgcttccccctacacactggcccactcttctgtgctaaaacgctgtcattgccacaaacgccatcctcccctgtgggcacatgtgtttcatcaccctcctgtttgctctgagagccccctcattctgctacacagcaaagttttctttcagcatctaagctgtacctgaccatgaccacatactgggggtacataggcacagcacctgtgccctaccctaggagctcacagccaaggccaggaacttacagcatctcctgagtctttcaacactccgtgtgcacatgacaagggtgaagtttgattgtggaaagcaccactcagaagcaatggcaggtccctgcatgtgtgccagccttacggtgtcacctgtagagtggggtcatgagggtcactgcactgggttgaaaagtgccctccagagggggagctagaaccacacctaacttctggattttgccacaaaatatttagggacaggacacccctggagtcctcaattacccaagttattctgagccagtattcaacagaggaagtaccttagatctcagaataatccctcagtcgccattgtaagtcagtccctggccatctccacgcaggacaaggaatggccacatgggcaggacatcatactacctggaaaacgcacaaagaattcctctcagagttctgcatggccagatcagctcaggagtgaggccataacacaacctacagtgacgatgtcaacccagatgatgggaccagaaggagaatgagaattctgtgtgctgagggtgggtctttaggggccccctctctctctgtcccttggggctgagcccttctctggaaaccacacagctcctcctgcagcagcccctgactgctgatttgcatcacgggccgctctttccagcaaggggataagagaggcctggaagaacctgcccagcctgggcctcaggaagcagcatcggaggtgcctcagccatggcatggatccctctcttcctcggcgtccttgcttactgcacaggtgctgcccctagggtcctagccactggtccagtcccagggctctgggtccagcctggccctgactctgagctcagcagggcccccgcctgtggtgggcaggatgctcatgaccctgctgcaggtggatgggctcggcggggctgaaatccccccacacagtgctcatgtgctcacactgccttagggctctttcatccctggatctgtgtccaggccaggcacgtgggaagatttacttggagttcagctcctcagtttcaagccttttctctcccgttttctctcctgtaggatccgtggcctcctatgagctgactcagccaccctcagtgtccgtgtccccaggacagacagccagcatcacctgctctggagataaattgggggataaatatgcttgctggtatcagcagaagccaggccagtcccctgtgctggtcatctatcaagatagcaagcggccctcagggatccctgagcgattctctggctccaactctgggaacacagccactctgaccatcagcgggacccaggctatggatgaggctgactattactgtcaggcgtgggacagcagcactgcacacagtgacacaggcagatgcggaagtgagacagaaaccagccacctcggcctggctcacaagacccttccctctctcctgccctgtcacactgagcaggagggagccttccatgtggaatggaagtttccagtcctatccctgcccttatgttcctgagagacgggagcaagttcctgcccacctctaggctcagcttatcccagaataaactgagctagtcattttgatgatcaaatgccagctcccaaaagaccccagaaaccctgatatctaagtagcaccgactctattagtatcaagggagactagccctagggtggaatcattttagtgtctcagaaggcacagggcaatggaaagtgtttatgaggtttcaggatatgcacgtgagcagttaaaggcaggtcttacaaggaaggaacctactagaattggggcccatctgtgacatcatagcacagcctggtggacacagagaagggaaggtcctgaatcaagtcttgatcagtaaatatttattggataagtgagcaatttacataggtgagaactgtgtgctctcttgagcagaacacttacctggataattggttttcaggaattccctgaagcaatgagtgacattctttattgttttcaccctcatccacctgggaaagagtatcctggaaccagcagttaacattgacacagctggtctcggtcctcagcacaaacattcattgcaggctgaaaagtgacaacggaagagaaaggagtttattaaatccctagacacaaacaaatccataagcagagatgagagatgcgggctcagctggcccagtcccacaggggtcattcctcttgtgatggaaatgaccacatgagggtcccccaagcggtgttggggggcagtcatggggaactggcctcccagggctacctgctgcttgggctgggcagaggttagagggatggaagtctggtccagtccttcccagcagcatctccaggctcctcctccctctactggggcttcccctccactccccagaaccatcattgcttcctcatctcctgtctcctccctgccccaaggccctccctgtgctcaccctggctcctccccctgctccatgcccagcctctgcagagcagcccaggcccagagacttgggcagaagcttccgtcccaccagctgcagaaccttccctacagaaccaggccagtccctgtgtctcatatttgtagagatcccaatcaccctcagagatgacgggtgggaaaccagcccacagtgacctaggctgttgggcatatggccttcaagctggccttcaagcccacttggctgcatctccttggccaactccaacatccaggctgggagtctggaatcctagttcccctggcccattcactcccactagggttgcttctaaactccctgggcctcagcttcctagtctgcccactggaagcagcgacaggcattttccagggctgcggtaagggccctggaacaccctctctcaccctctctctccctttctctctctctctctctctctctctctctccccctccccctccccctccctctccctctctctctctgcctctgtttcctcctcagtagtgggaagaccccctgtcaggtgggccagtccatgacatctacagagggagcaggaacctctcctatttcctggaggagagctggggtggaggctgcaacccaggatcatcagaggagctggggtcttcaaggttcctagggaccccttaagcgggggtcagagtggcttcagcggtcttattgctcggtccagacagaagatgtttccagttgtgaaaaacgacttcagggacaacaaaaacagagattcgcctctccagacaccagtggttggtgtgcctggagtactcctcgtaccaggcaggggagagagtcctagacagaggaggttctaagtgtcacctagatttcaggcctcggggcctgtattgggtaggtgatgtcacagtgagttgatgctctgtagccccttccctaggaggtggcagagggaagagctggtggtcctctgaggtgtgagtgagtccaaccctgagggtcttcccaagctggaggtccctgggtgtagacggaagaggttctggtcaaagaggcctggtgttgaatcctggtccatttattcatttggtcaagaaatattcatggaggacccaatatgtgccaggtgccaagccaggtgactggggacacagtgttgagtgggacagttggctccttcactgctagaggtattatattctcaagccgagactcggctctacgattgtatgtcagatatatagcctctatgtgcatgtctccagagactggtttcctggagttccaagtgacagccatcactcacctcgaatgcaaaaattaaaggagcatccaaaaacctagtgacccagataaataatacttaatgcaatattttcaaaaatcaaaattaatgcccaacaaacccacaatgaacaaaatttcaggatctgactcactcacctcagtggttttgttcttggtcctacccacagtcccacaggtgagtgagtacccacagggatgcaaaaccagagtcaggcccctgcaccgccttctgcccggccaccagagccctcccctgggtcttggcctttctcttctgaagagctccagccagttcctcctcaggcttcctctactgctggtctcttctgccccctactggattctccccttacagctgcactccaggcagctggtggaggttaaagaacagaaacctcccaaaactccaccctccagttccaggctggctccacctcatgtccaaaaaggctggtcctccaggtctttgattgctattagtaagtcccaagacacagtctttacaccaagtcgctgtgtgccttgggcaagaaactctccctctctgagactgtgtttccacactggtagaagtagctagaagacctccctgccaggttggcaagtccactctgtgacatctacaaagggagcagggatctcttccatttcctggaggagagctggggtggaggctgcaacccaggatcaccagaggagctggggtctttggggttcctgaggactcctcagagggggatcaggagctgcagagccagcttctaactctggggactcagagatccagaacctttgtcatatccccagccaatactttgtcatcctgtgcctcagactcccccagatcccaagagtgagaagctcaagacgagacaagaaagaccagccagcttgaatttagggatggtggggagtggggagctggggacccctggacctgggggagaggagtctgcagtgcctgcaggtggagtttctgggacctgggggatggagactgggcaggggactgaccagcagaaggccaaggtgggggataccctcagacatggagcagggcagaagcaactggatggggtacatccctctgctttgggagagaagggccagggcgggacccagagagctctgcagaggcaccacagaccctcagcagggggtctgccaaacaggacagctggacttggctgcttctgcccaggcctggatccagcccttgcacatctcagggcaggggataggcctgggtggccagagctgcagctgcacctgctggggaggcctagtccagtcctccagggtccccagacagactcggatttccgactgcagccaccatggaaggatgtggtctgcggtgacgatgtctatccagaggccatggcaggtgcaagggtgggggtaggggcagcagctggggatgctacatttagggacagcccctttttatccccaagacctgggactgtccctgaaaggaaccacagcttctgggtcctgagcagtgggtgagtgtcatacccacagaggggctggaagggagcagcttcagcctagactcccagggcagaccctgccccagccccgaatatccaaggagcccaagatcagaggcaggaataggccaagctccccagtggagaagctgtgctggaccaggggtttcccagggccctcccttgtgccctgaatgatgtctgttagggcacctacaccctgttactgctcagtgccttgcctattttgaaggacagggatgtgtggtgattatttgtataatccagcccccagcacctggtcctcaaaagttacccaagcaatgtgtataaagatccagcctggagatctttgaaaaccgattcgatgagtcgaaccattaagtcatgatcaccatcctcaacttcatctctttcttcctcctcctcctcattatcatcaccttcaagaactgttaagagtctgagacttcatcctatttgcagactaaaaagtaagcctgccacagtgccatggatgctggcagaagatacaagactcctgggtcagagacaacgaataatctgtttttcacagcaatagcagttgccaaggtatcagcattgtcttgcaccagttccacaaggtgatgcaaagagggccaggtgacatctgcatgccagagctcagggatcccaaatatttcatacttgacagtaagcatatatctgtgttttgctccaaagagaggcattctctgtaccttccgaggttgttcactccacaaacactcttgaaaagataatccacaatcagtgcctttgcccgagagacatgcagaaatgcagagatccatagtagaccactgtctcccaacaaccatcaactttatcaatgaaatgaagtctcaggctatttgtctgttaccatagcccacaaaaatgtctggcttgattgtcaccaaatgtatcaaggaagttaaggagtatctgacacaaaatgtgaaccaagcaattctcaaaggagcctcccaggaaattcactttaggaagtcctaggaggctcctctgagagttgctaaaacaaaacattgagagtcctagagggctgcagatctgaacttgagcagatatttttaaagattttgtggcagaaaaagaaactggaaagcaagagggcagaccctcattgcagttctgtaatgtaagggggcagagcaggggcctttctcaccagagtatggggtcctgaagatctcctcaaacatttttatactaggctctcagggcaacagaaaagatgggagcgatgaatggggcgtaaaggagtgcaaatgacacaaggggtcacatgaagcaaaagaggtttattcaaccagatttagtccatgtttaattgagccactcctttgtgccaagctctgggttttcccatgcaccaagcagtgtgttaccacctagacccagagagccatgtcatcatcagcaaagcacgccctagtgtcatgcaaggaccaggcctcagattccgactccagacctactgcctcttggccctgtgacattaaaagagtagggaatcagcctgagcagcatttcctcatcttcaaatgtggaggacagtagatgatcttagctcccaggattagtgcttgtaaagcaataataatgtaatgcattattattgtattatgcatcatattcccatattatagtcaaaaaggaccccaacttaaagcacctgccagccctctcctcctccaccactgccgaatggagccaggcacgagtattccaggtggacagacgaatagaaatacaggggacgagccccttcctagatcctagcgcagcttgctccctacttaaggaatgatattggaccctgcattcatcttctctggatggtaattttctcacctgtaaaacagagacactggccccaaggacaccccacaagtagttgtgaatcccaaagtaagagaagaacaaaaaaagaaccagaatttattcaacacccactgagtgcttagcaaacacatggtttctttaactctcataagcttcatgctgcagaggaactctccccattttacagataaggaaactgaggcccagaggtaacctaggtctagatagactccacatttatgacttcaccactcttccttgcctgaaggatatagaatcactccctgcagggctcttgcctgactcaggaaagggccacaggatagccagccaggcttaaccaacccagccaagaaagggctggtcccaactggctggagtgcagtgtacaggcacccagcctggaagactgatcagaaaagaagccacagctccagccccagccccaaccccctgagctcaagcccttggggactcctgctgggcagctctctaggccctagggagatgctccacagacccaggctgccctttgggaagtggggaagacaagtgggtcaggtgtgcaccacccaggggcggggccaggcagccggctgtggtgggaggcagttgagccctggattgtgaccgcttcagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcggggacccagaccctggagcctcagttggaagcagccgatccagcctgcggagcctgtggggcaggtaaggggcaagagattccaggggatgtgggggtcctgcagcagagctgggaaagggtgaccaaggggagacaagccagaggagtgaggaggaaggttaacccctaagaggggcctgggctgacactggctttagtaatgggttgatattttgtccatcacagatttgtttgaattactgtttttaatatcatattacgatattatttttcttgatttctgagttttctggcgccacttaaattttcaccagggtcagtgcctcaatcacctagtcctagtcctctgggtagggaaggaacagaggcagggacaggacatccacagggggtggtggccactgtccccacagggtgcccaggcctgttcctccccctcctcctctctgcccatgtgcctcctgcccagtgagggcaggggccactccctggagaaggcagcaagggcttggtttggtctcccccaaggctgtctgttcaccaacttgcacataaatgcttactggggccaggctcaaggacacagggagggtgggatgaaccgaggggagctgtccagtcattggaacaggcccacggcccatgtttggagcaataaagggagaggggatctccctctgggatgatgcccaggctggtctcacagatcgaggggcactggctggtgatgggtgcccccaaaagacagagcagcgtcagaggagaggagagcacaggatgaggctgggagctcctgggtgactgggaaggggaggcaagaagaccatagggtccgtgcaccattcccagtccaggacgagtccttggatggatttaggtagattgattatcagagtcagatttgtgtttttggaaaaatcagcaccggattggaggctgatgcgacgcccgattagaggagggaggagagggggtgatggccaagtccagggtaggtggggatcctggaggaagccgtgccttggggatggggaggacactcagattcagagcacccaggggcccagtttcctatgaaatgggagcatgaagttgaagtgagggctgagcagaggggagcagacacgctcggggactgtctatgggcattaaaaatgtataaccattttagcaacaggcggcgagtcaaaaaacaaagtgtgtttatctaaactgggcaattccacttctaggaatttatcctaagggttggttgggggaataatcaaagctgtaaccaaatctttataacaagggtggttagctcagcattattagtgatgggagaaaactggaaaaaatccaaatatctaccagaaagggtgtgaaaaaacacaattgtatttgggggactgttgttgtttttgttttgaaacagtcttgatctgttgctcaggctggagtacagtggcgtggccacagctcactgcagcctcaacctccagggctcaaaagatcctccagcctcagcctcctgagtagctaggactacagatgcaggccactacacctggctaattttgattaggattattattagtttagagacagagcctcgctatattgctcaggcctgtctcaaattcctaagctcaagcaatctttctgcctcagtttcccacgtgctggaattacaggcgtgagccactgcacctgacccaactgtgtttttaaagtatatatgcattttcaaaaacctgtcagaaaatatagaaaaatgtcaatggtgtgtctggctggctgatgggatttcacctaattttaatgtggctttataattttctggttttgtgaagttgttcacaaaaagagacatttcttctaatataatttttaatacaacagtaatgtactcatgtgcattactctttttgtaatgagtatattacaaaatgtaatgacttttgtacattactcttttttcttgccaaaaaaaaaaaagattaagcagagaagtatataaagtaaaagcaagtgcttctgcttaccatctctcacctcttcccagagatagccactgtcaggttggtcaatatacttccagaacttttcctgtgtgtgtgtgtgtccctgaaaacacacacacacacacacacacacacacacacagttggtgctgggattttattttgcaaaagtaagagccatattctgcatattaccaacttttaatctattattgacactttctgtatcagtccatatggattaaccacattcattgcttataaactttgttttataagcaaagtttagatgagccagaatttatttccactaaaaaatctaaatgacaaatgatgctgcagtggaaatttgtgtgtgtgtgtgtgtgtgtgtgtgtgtgtgtgtgtgtgtgtgtgtatgtgtacaaagtgcacttatatatctccccaggatagatgcctaaaagtggaattgctggatcagagagaatgtacttttgaaatcttataggtagtgtttccaaaagtctgtgtccactcactccggtgaatggtagtgccttcgctcctacattcttaccaataatgcaaaattgttgatctttttatattctgcccatctgatgagcaaaaaattgaatgtgtttatggttttattgtgtattttattactggtgaaattattttttatatttttatttattggttttatttcgtctgtgaattaactggtcatcatgttgcccgcctttccattcagttgctttcatctttttatatatcaataacatattgggatatatttgggattttaaccacttgtttagtgtatgtattgtaaatatttttccctggtctgttttacgggtcttttgtttatggggtctcccaccataaaactgtggtaaatttttatgtgtcgaactggtttaatcttttctttatggtttctgtgacctccaccatgtgtaggaagttgtctttatttcaatattataaactcatttttctgttttattctggtacttttggtgtattggtgttttatttttttttctttacttcccctggagtttatttttgtggatgtaggaataagaccttattttccaaataggaaagccaatcatcacacatttgttgaatataaatgcaacttttctcaattactacattactgatttattacattctttctgtggttctcttggtttattgagctattcctgcgcccaccctgttttgattattttagctttatggtatgttcggtaactggtagggaaagaacccgtcattgttactttttctcaaaatagtcatgtctattatctgtcattcttagagttggactgcagaattggttctctaattttcaaaaatcattcttgtgttatgtggtaatatcacagaatatgggattaatttgagaactgctatctttataatgctcagtgtttttgttcagagacatgatgtactctccattcactcagataagtggtttaatattttattcatgcaaatcttgcacactttgttttttattcataaagggtttgtaaatataattttattgaagttataaattttttcacaattttatatcgtaaatgattactgtttctatagcaaggaaccctattaacttttctatgttgctcttgtatccagacactttaactcttgtattaattccagcagttcttcagctgattctccgtgtgtgtgtgtgtgtttgtgtgtttagttaactatcacaccatttgccaagaacaattttctctctttttctgtaatatttatacctccttctctcccccttttatgtcatttcattggctggaatctatacaatatgctgaataataaaagtgagactagacaaccttgccttgtttctgattctttaaatgttttgcctttaaatatgaaggttgctgtaaatttggggagatattcttcactgagttaagaaaattttcttcagtaacttaataaaaggctaaatgtttgctttctttatatgagaaacaagtgttgaatttatattactattatattaaattctgtttcaaaaatcttctgcacatgtcttaaatacaaatgtattaaatacaagctgctgctaagatgaaagttgctggccccatcacaatgggtatcttccaatgtgaataaattgccttggggaataaaatcagatttggaaaaacctgaggatggttgccatcataaactcttagagtgtgacctgggtgtttttctttttctctgtaggatgttaatagtatcttgtgtcatgctaggatgtctaggacagagggcaatacaatgaggggaaggcattctgcgatgtccccaggcctctggcttgaagagtaacttgctgaagtgaggactctgtggaggagcaagttatacagaaagaagtttagttgtgatctgttgagttggaggtgtctacagggcatccaagcagacataggttgaggaggcagaatatatgtgaatctggagccaagaagagaggtaagggctggaaatagggatctaagacccctggacagttgtgagtgtgcacaatgagggtcagatgcagagaaaattaggagactacagagagcagaacccagggtggggatctgggagtcagcagttgggcatgggcctggtagaaagggaagccaaggaggaggagagggggcagtctcagacaccaaggaggggagagtgactagaaagaaaaccttcttgcagagacataggggatggggaagaactgcagactgaactggggcaaaggactgttggccttaaccagagagatttgagggagagatgaggctgagagccaggggatcctgccatgtcccagcataaaaacagtacctgacacagatgggtgcttgggagctgttgtcggatgaatgagtggacagatgcatggatggacggatggatggaaggatgatagattgatggacaaacagatgaacagatgaatagctggatggacaactggatggatgggtagacagaatgatctcagagatcagaaaaagcttcatgcactaagtgggactgaaccgcgtctccatgggtagaaagcagaggaatctccacttgagtcaggaatgacccagtgctctcaatccagggagaaagccagcctggcttcactggggacacttgtgtgggggactcagaggccctttaaatgaggccagacgaggttggacaggtccaagccaactcagcactcctctgccacactgcacaggaggggatgtgtcactcagggagttgctgggacctatgggtcccagtgttgtcatcagcaccgacagcctcagagaggaaagacacacactggggtaactccaaggctgtgtgtggcacttgccttggacagcagacaggcacagggacacctctagggggctggccacccccctgcctcatgtctaggtcccagccccgcccactgcaaccctgtgcccgtcatgcccagcaggctcctgctccagcccagcccccagagagcagaccccaggtgctggccccgggggttttggtctgagcctcagtcactgtgttatgtcttcggaactgggaccaaggtcaccgtcctaggtaagtggctctcaacctttcccagcctgtctcaccctctgctgtccctggaaaatctgttttctctctctggggcttcctcccctctgtcctcccagccttaagcactgacccttacctttctccatggggcctggaggaggtgcattagtctccgggtaaccggcaggaagggcctccacagtgggagcagccggatgcagcctggtcccggggcctgagctgggattgggcagggtcagggctcctcctctcttccagggcagatgtctgagtgagggacagaggctggttctgatgaggggccctgcagtgtccttagggacattgcccagtgactcctggggtcaaggacagaggctgctggggtgggcctgggagctgctgagtctcatagtctaggggagcagccccaagaacagctgagggtctaggctgaggactggatgccaatccagcctgggagggccacacggcctggtgacacagaggtcaccccaaggggagaccaatggagggcacagagagggctctgggtctaggctgcagctctgtggcctgtgctgggtcatgaggacatggggacacagagggacgggtgagactgggtgaggtgccagaatccaaccctcccaggacagtcaccagaaaggagacagtctcttagggcagagatgtgtctgtccctggagccccgtcacctctggggcccagtgtctctctgttcacggatcggcctcctgccttcctcaaagggcatgttagactcaggaaatgaccagaggggagtgaatgaggggtgcagagaactccatggctaccaggtgaagtttggggtcatcacaggctgctggggtgggcctgggggctgctgagtctcatagtctgtgggagcagccccaggaacagctgaggtgaagggttctgtggtcgggcttgtggagacaggaaacatctcagagcctcagaggagccctgaggcttgtctaggtggagcccactccttgccaggagagccaagtgggctgggctggggcagagcccggtgcctgtgagggataggaagctccagttcaaagcaggcttgggtctccccacacactgcctgccaggacagtcctacaggatgagcaggggacccacagttcacggaggaggctctaggtcctggaagaataaagtgggtgatggaggggggtatagggatggaaatgagggatccaggggtcaaggccagattctaaactcagactccagagatcagagaagaaggaacacagcctgccctgggtatatggagaaattgaggctgtagaggagaggggctgggccaggacacctgtgaaaggtgacttgggagggctcctaggaaggcacagagctgtctgctctccacagggcatgagtggaaaggatggggaaagaagaggagagaaccccgggtggaccggatggccacactgtgaaccctcccagagactttagacagagagaggggctccacaacaccccggtattctgtctgccctctctcacccccttccctgtccacacaggtcagcccaaggccaaccccactgtcactctgttcccgccctcctctgaggagctccaagccaacaaggccacactagtgtgtctgatcagtgacttctacccgggagctgtgacagtggcctggaaggcagatggcagccccgtcaaggcgggagtggagaccaccaaaccctccaaacagagcaacaacaagtacgcggccagcagctacctgagcctgacgcccgagcagtggaagtcccacagaagctacagctgccaggtcacgcatgaagggagcaccgtggagaagacagtggcccctacagaatgttcataggttcccaactctaaccccacccacgggagcctggagctgcaggatcccaggggaggggtctctctccccatcccaagtcatccagcccttctccctgcactcatgaaaccccaataaatatcctcattgacaaccagaaatcttgttttatctcattttttttctcacataaattgctagcctccccggggttctcagtgtggggtacagggaattctgcacccagtgtgaaaatcacccaagggaggaggctcacagcctccctgagtcatctccccagagggtccttcctctcccagtcaccccttctccaactctccactgtacccctgagctaccagtctggcatcagttcagaccagtcccacaccctcctaaattttacttctcaataaatacctgatcatgtaaaacgcagcatttctaatgtgcagtctctgtctggtcatgtgtctgggctgaagggtcactgctcagggacagggggcagttccaggtgagatcccatgtctccgtcatcccacaccccacccaacctgccagggaaccgggtgagctccctgtgccagtgggaactgcaatccaaggcacaaaattgtcctgcagtccttgcccacctgggaagggacaggggcccagtgagaggtttgctggcgccctgtggggagattcaggagaaatgaagggggtccccggagaccagatgagggctagaggcagaaataatggaaaaaggacacccttgactcaaggccacggtctcagcaggaacagaaggtgaaattccccattgcatacgaggaaccagtcaggagagtgtttactgggtgagggataaataactgtgctgccactgggaacttgtaaaaacattgggaaaggaaacatgcaagtgtctttctaagacttgtacaatggacattggctaagtaaacatactgacaagtcctgcactagggaaccagtttaatatgatgagccacagcatatccaaaagcatgttgatctccttcttcacctttagaagacccaaaacactctgaaagataccagcgtttcctggaactagtttgtggaatatggggtgaggttgatgcacatgatgttacgggtatatgatcacatggctgtgggttggggatcaggctcaaagttaacactagcgtggggctggatgtcaagcatgaagggtgtggaccactaagtcaggcccaggtagagttaatttctgattggtttgtggctggagcttgatgatggtcagtctgcaggagcaggaggatgtggggaaattgggaaaatgagaaaagtcacaaatccaagctcaaactctgcatctattgattgcctgggggaggctaatcagagttgaattcaggatgagcttcagggctgggtcagactgaataagagctgagtgaatgtgggctgatggctccaggcaagtcctggcctccactaggagtcagatcccacaaaccctcctgcccgcagagcaccctctccctccgtagctcatggtggcgcagcctccccaccccatcccatgtacacctgctgcctcatctcagagacactcattccagtgtctctgacagcagatgatgtcagcctcctgggtgtggagaccccagctgtcttggagagtcctcagtgcctgggtactctcagaccccctgtctctgcctccagcacatcagagacatagcagctgcctccaccagagctgctgggtgatcccaacaggccagggacagagcctgcaaagacaggaatctctgcagtcacaatgaggcaaagaaagagccccttagagcttgatcacagccacccctgatccaaatcccagcctctcattagaaggaggcttgagggttctgttgccacagcacctgtctgagcccatttcatggaggggaaaactgagatgaccaagggccagatccatagtcctgctgggcacaaggccatccccagcagctgcctaatctttgactgtgttataagtttccattatggaaaactttgaacacatacataaggagacagagaaataataatgcccccaagttcccatcacccagcccccccaataagcaattcacagacattactgacccacccatagcagaataacccctccattacacaataccagacatcacatcttttcagctgtaaatatcccatttctatgctggaaagatatgggcttaaaagtaactgcaatattattaccaaacctaaatagaaattatcactaattccctaatatcaagaaataatcatgggctcctcaaatccctcacaaatgccagaagcgtattgacttagttaagtgttggtgctgtggttattttggggttttgggtggtttatttcagaattcaatatggcatcaaatggtgatgggcgcatgtgctgtcaggccagttgtcactggtgaatatttcctcaattgctctagtgctgcctggcaaggcaggagctgcaggagttgagagctgtccggggaccttcccacggttggaatacagccacacctcccaaaacaagaacccagggctatcatctacttctttttttttccccctgcaaaatggttctagcatggagggacttaactggattcagactagacattgcaaaatagcttccaaggacagggagctgctaacagcgagatcacccatgtcagattctcactcttgtagtaatgttagctgcataggatggtcaatagctacatccctcagaagggaaggaaggcagagggatgaggcttcagttcacctccttctcatgagtgctgcagagcatctgtgaattcagaggtctgcagctgggctctgttcacccaggagtgtgcttcatgctctaggaaggagccactttgcacacagatgatccggggcccagccatccttccagggtgaataattaatgtcttctctcatggtgaactctaggattcaagccatctaatgtttttgaagccactgtcattatatttaattgatgatgacaggtggccaccaatgatgaatattttcccagggggagtctccctaagtggctttagacttcctcacatggccccaggggattaaatggctcctgattactcagaggataagaggttctgtcttatcatgttcctttcttatttgtcttatgtgtctttcctgccccaggcctgggatcccccactgatctcccttcccttagtgagaggtggtatttggagaccacattctggaggctcccttatgtcccccatttgaaaaagacaacggcagccaccaccccagctgtcccacccaacatgaggccagattcggggtgcagggatgctcccaaggttaccctaacagatgtgactggcacttcatattgggaccagccaggcctcactgaccaggcctatccaactagaactactccagaaggtggggctgaaacccaccaaggttcccagaacactgcactctagggcaatcagcctctgcatgggaggagaggggcaccctctgcaccaccccatggtgttaccaaaagttgaaccatgggttggttcaactttgcagagaagagaccacctaacccatctgtggaaattcactccttagcgatactgatgctccctaagaaattcaatcctgggcctgagtgatggttggtgcaaaaaacaaattcaagatcccagtgtcctccagaagcctggatttccagggatcctgctgtgagtcacaggacgtcaccggtccccttctctttgtgggttgagtgtgggggccatgtggactccctcatgagcagatgccaccagggccactggccccagcttcctccttcacagctgcagtgggggctggggctggggcatcccagggagggtttttgtatgagcctgtgtcacagtgtgtggtattcggcggagggaccaagctgaccgtcctaggtgagtctcttctcccctctccttccccgctcttgggacaatttctgctgtttttgtttgtttctgtatcttgtctcaacttgtggtcagcctttctccctgcatcccaggcctgagcaaggacctctgccctccctgttcagacccttgcttgcctcagcaggtcactacaaccacttcacctctgaccacaggggcaggggactagatagaatgacctactgagcctcgtctgtctgtctgtctgtctgtctctctgtttgtctctctgtctctctgtttgtctctctgactgtctgacaggcgcaggctgggtctctaagccttgttctgttctggcctcctcagtctgggttcttgtcggaacagctttgtccttgggttacctgggttccatctcctggggaattgggaacaaggggtctgagggaggcacctcctgggagactttagaaggacccagtgccctcggggctgatgctcgggaatcacagagctgggacccagagccaggatccagacccagaatgaggtaggaggtggaggggctgccctgggcgtctgggggctgccagggactgagccctgagccagcctgagactcaggaaaccccgtcaggagggagaagggagaagcagactctggacaccagaaagccaggggaagggtcacaaaaggagtggatgtgacggaagggcgggctcctgggtctcttcagaacatatcccctgtgcccagggggatcagaggggcagagtccactgcgtgaaagccccactgctatgaccaggtagccgggacgtggggtggatgccagaaaagactccacggaataagagagagcccaggacagcaggcaggctctccgatccccccaggcccttgccccatacacgggctccagaacacacatttggctggaacagcctgagggaccaaaaggccccagtatcccacagagctgaggagccaggccagaaaagtaaccccagagttcgctgtgcaggggagacacagagctctctttatctgtcaggatggcaggaggggacagggtcagggcgctgagggtcagatgtcggtgttgggggccaaggccccgagagatctcaggacaggtggtcaggtgtctaaggtaaaacagctccccgtgcagatcagggcatagtggaaaacaccctgacccctctgcctggcatagaccttcagacacagagcccctgaacaagggcaccccaacacctcatcatatactgaggtcaggggctccccaggtggacaccaggactctgaccccctgcccctcatccaccccgcaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttcataggttctcaaccctcaccccccaccacgggagactagagctgcaggatcccaggggaggggtctctcctcccaccccaaggcatcaagcccttctccctgcactcaataaaccctcaataaatattctcattgtcaatcagaaatcttgttttatctcattttttcttttctcacatataattcctagcctttcctgggttctcaatttgtggtggaaagaaccctgaacccagtgggaaagttgcctatgtgaaggggttctcagttccctgggcatctctgcaggtaaggccttcctcacccagacaccccttcctcagctctccactgtacccctgagccaccagcctcgcctggctgggaccaggggggtgtcacactctcctagattctgcctttcaacagaaacctaaccacgcatcacacggcacttctcgcatgccttctgtgtctgctccagtctctgggctaaagagttgctggtccgggacaggggataggtccgctcttggtcagatgccaggtccctgccatggcatccctgaccctatgcaacaagccagtgactctggtgagctctctgtgtcaggagaatccatgatccagagtttcatattgtcctgcaagcatctggtgggctgtagctcttgccaaactgggaaataccatggcccagcatcaggatgcaggacagtccggagagggaaatcaggagaagtgaaggggtctctggggagcccagatgtgggctagaggcagaagtaagggtgaagagcacctatgagtcaatgtcatggtctcagcaggaacacagttgaaaatccccattccacacaagaccgtttagcaggaaaggagtccatacttgtgctgccaccaggatgtcctgagaagccttggagaatgaaacatacaggtgcatttcctagacttgacaatgcacgttagccaagtaaaggcaatgaaaagttctctactagggaaataatttcctgtggtaaagcttagcttatgtaaagtcacatttatccatctggcacctctaaaagccccataatattctgcaagatactagtatgtcatggaagtagtttatgaaacataaagtgagatttaagaacaaagatgttacgggtgtatgataagatggctacaggctcagggtcaggctcgaggagtgaaggaggccgtgtcaaattcatgacaagagttggagctgggccaggctgggtcagggctgtgtgaatgcagacagagggctacaggcaaggtcaggcatccatgaacactcagctcccccagaccctcctgcccactgggaccttcgccctcccttggtcacagtggtggagccttcctacccaaacctctatggaggccctggatgactgtgcgttcttagtgcccacgcaaacttagactccctgtctctgcctccagcacatcaggaatgtggcagctgagttcaccagagctgctgggtggtcccgacaggccagggacagagcccgcaaagacaggaagctctgcagtcacaatgaggcagagaaatggccccttggtgcttgatcacagccacccctgatccaaatcccagcctctgaattagaagaaggctaaaaggttctagtggccacagtccctgtctaagcccatttcacaaatgagaaaactaagaccacccaaggagggccagttacgtaggcctgctgggtacaaggccaaggtctacttcacacccagcagctgtccaaagactgagctgtgtcataagtttatattatgaagaactctgaacatataaataaggagacagaaaaataacagtgtcccatgttctcatcacccagcactcaaaataagcaattcacagatgatgccgacccacccacagcaaaataaattctcccttacacaacatttagaaagaaatacaagacatcagatctgttcagctgtaagtactccattactgtcctggaatgacatggaccttaaaataactataatatcactaccaaacctaaatagaaattatcactaattccctaatatcgagaaataagcagggtctcctcaaatgcatcagaaacaccagaagtgctttggcttagttacatgttggtgctgttggtatttgggggtttaagtttatatgaggagcaatatgacatcaaatggtgatgggtgcatgtgccatcaggctggttgtcactggtgaatatttcctcaattgctctagagcctcccggcaaggcaggagctgcaggagctgagagctgtctggagaacttcccctggctgctatacagccacgcctcctggagcaggaacctagggcttccctcagcttttattttcctggaaaatgattctagcatgaaggggattaacttgattcagattggacattgcaaaatagcttgcaaggacagggagctgctaccagcagagtcacccatgtcagactgccactcttgtagtaatgttagctgcataggatggtcaatagctacatccctcagaagggaaggaaggcagagggttgaggcttcagttcacctccttctcatgagtgctgcagagtgtctgtgatgtcagaggtctgcagctgggctctgttcacccaggagtgtgcttcatgctctaggaaggagccactttgcacacagaagatccggggcccagccatccttccagggtgaacaattcatgtcttctctcatggtgaactctaggattcaagccatctaatgcttttgaagccactgtcattatatttaattgatgatgacaggtggccaccaatgatgaatattttcccagggggagtctccccaagtggcttcagacttcctcacatggccccaggggattaaatggctcctgattactcagaggataagaggttctgtcttatcatgttcctttcttatttgtcttatgtgtctttcctgccccaggcctgggatcccccactgatctcccttcccttagtgagaggtgatatttggagaccacattctggaggctccctcatgtcccccatttgaaaaagacaacggcagcctccaccctagctgtcccacccaacatgaggccagattcaggggtgcagggatgctcccaaggttaccctaacagatgtgactggcacttcatattgggaccagccaggcctcactgaccaggcctatccaactagaactactccagaaggtggggctgaaacccaccaaggttcccagaacactgcactctagggcaatcagcctctgcatgggaggagaggagcaccctctgcaccaccccatggtgttaccaaaagttgaaccatgggttggttcaactttgcagagaagagaccacctatcccatctgtggaaattcactccttagcgacactaatgccctctaataaattcaatcctgggcctgagtgatggttggtgcaaaaaacaaattcaagatcccagtgtcctccagaagcctggatttccagggatcctgctgtgggtcacaggatgtcaccggtcccctctctctgtgggttaagtgtgggggccatgtggactccctcatgagcagatgccaccaggaccactggccccagcttcctccttcacagctgcagtgggggctggggctaggggcatcccagggagggtttttgtatgagcctgtgtcacagtgttgggtgttcggcggagggaccaagctgaccgtcctaggtgagtctcttctcccctctccttccccgctcttgggacaatttctgctgtttttgtttgtttctgtatcttgtctcaacttgtggtcagcctttctccctgcatcccaggcctgagcaaggacctctgccctccctgttcagacccttgcttgcctcagcaggtcactacaaccacttcacctctgaccgcaggggcaggggactagatagaatgacctactgagcctcgtctgtctgtctgtctgtctgtctctctctctctgtttgtctctctgtctgtctgacaggcgcaggctgggtctctaagccttgttctgttctggcctcctcagtctgggttcttgtcggaacagctttgcccttgggttacctgggttccatctcctggggaattgggaacaaggggtctgagggaggcacctcctgggagactttagaaggacccagtgccctcggggctgatgctcgggaatcacagagctgggacccagagccaggatccagacccagaatgaggtaggaggtggaggggctgccctgggcgtctgggggctgccagggactgagccctgagccagcctgagactcaggaaaccccgtcaggagggagaagggagaagcagactctggacaccagaaagccaggggaagggtcacaaaaggagtggatgtgacggaagggcgggctcctgggtctcttcagaacatatcccctgtgcccagggggatcagaggggcagagtccactgcgtgaaagccccactgctatgaccaggtagccgggacgtggggtggatgccagaaaagactccacggaataagagagagcccaggacagcaggcaggctctccgatccccccaggcccttgccccatacacgggctccagaacacacatttggctggaacagcctgagggaccaaaaggccccagcatcccacagagctgaggagccaggccagaaaagtaaccccagagttcgctgtgcaggggagacacagagctctctttatctgtcaggatggcaggaggggacagggtcagggcgctgagggtcagatgtcggtgttgggggccaaggccccgagagatctcaggacaggtggtcaggtgtctaaggtaaaacagctccccgtgcagatcaggacatagtggaaaacaccctgacccctctgcctggcatagaccttcagacacagagcccctgaacaagggcaccccaacacctcatcatatactgaggtcaggggctccccaggtggacaccaggactctgaccccctgcccctcatccaccccgcaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctacctgagcctgacgcctgagcagtggaagtcccacagaagctacagctgccaggtcacgcatgaagggagcaccgtggagaagacagtggcccctacagaatgttcataggttctcaaccctcaccccccaccacgggagactagagctgcaggatcccaggggaggggtctctcctcccaccccaaggcatcaagcccttctccctgcactcaataaaccctcaataaatattctcattgtcaatcagaaatcttgttttatctcattttttcttttctcacatataattcctagccttccctgggttctcaatttatggtggagggaattctgcacccagtgggaaagtcacccaagggaggaggcttacagcctccccgagtcatctctctggaaggtccttcctcttccagtcaccccttccccaactctccaccatacccctgagcctccagcctggcctcagctcagaccagtcccacaccctcctcaattttacttctcaataaagacctgatcatgtaaaacccagtttccaatgtgtcgtctgtgtctggtcatgtgcctgtgctgaagggtcactgctctgggacaggaggcagtttcaggtgagatcccatgtccccgtcaccccacaccccacccaacctgccaggaaaccgggtgagctccctgtgccagggggaaccatgttccagagcagaaagttgtccctgcagagtggtccctgaaatgcagttcttgcccacctgggaaggatgtggagcctagtgaggacagagtggtggccctgagcagggcatcggggagaaacgaggagtgttccaggaccccctgctttgggctagagacagaaaacccttgagcccaggccaagatcagagcagaaacagggttgaacttccctgtcccatccatgatacccagttaggagaccatttactaggtgccatcaccttacgttacattacaacattacgtgattgtgccatcacccgggagacatgaaaaaggctggaaaatggaacccttcagtgtagtttacactttcacaatgtacgttagctatgaaagatgctgacaagtcctgcagttggaaaacagttcatgttacataaccttgcaagtcaagaattctattcagtgtcccaacccacttagccctagagcgctcttcaagacactggtgttcatgtcactagtgctgggacatgggctgaggctgaggcacacagatgattcgttgtgatcaaatgggtcaggctcagggttaacactggccaggtcagaaagagagcatagggctgagatctcaaccatgaagagtctcgaattctaaagtcaggggacgcagtagagttagattatggttatggctggagccatgatggccagcctgtgtgagggtaggactcaggtggactgggtcaaatgagaaaggcaccatcccaagcatagaatcggcatccattggttgtctgatggaggctgtgtcaaaatcatactcgcccaagaatcagggccaggtcacactaggtcagggcagggtaagtgtgacttaagggctacaggcaggtcaagttttcatgggactcagctaccttagacccctccccaccagggcctactccctccctcaatcatgtggttcagcccctccatgtgcacctacaccctgatgtcagagacacaatcatcccagggtccctgacagcgagtgaggtggccttgggagatgcacttcccagccctcctcatcagtcttgggcactgtcaggccccttcttggtgcctccagcacatcagcggtgtggcaggtgccttcaccagagctgctgggtggccaggccaggcctgagacagagcctgcaagggcagagaactctagggccatagtggggcagagaaggggttcctcttggagcctaatcatagaacccctgcctcaagtcacaacctacaagttagaaggaaacttaagggtcctgattcccaccaccctgtctggccccatttcatagatgtgaacgctgagacccctatagcaaagaggaccgctttgatctccaccttctcaatggccctgctgggtaggatcccctctggatgtcccctggtgctgtcccaagactaatctctctaattactgccttgtaagatattacggaaactgacagcaagaaaataaaaaaacaggaggataatacagctcatgttgacccacccacaatcaagtaacctcttttacacagttgtttgaagcaaattgtagacatcatgtccattagtctaaatattccatttgtgtctctaaaaatatggacccccccaaaaaaactacattcttacaaacctaaatataaatatctaattctttcatatcaaaaaaagaatgtttcccatcaaatacttcacaaatatcctatgcttctttcactagacctgtgtttgtgttgttattctgtggttttccatttcatttctatgaggattcaatatggtttgaaattgtgactggtgactgtgtttttagacctgttctgtctgcaggtatcttcctcattgatttttaatttccttgcaaggcaggagctacaggagctgggggttggtcccaggaccttcccatggtcaggatacagcctgtggcctccccaagctggaaacaagcgctcctctctgcttctgcgtttcctgaaaattggttcttggccagaaaggtttaacaaggctcagtgtgacttttcagcaagaccgcttggctactgggctcccatgtggggtcatctatttgtgacgttagctgggcttcacactttgtatccagtgccattagatggtatatggatgcaaggtgactgcatttcagttcgaccaccttttccttctactgactgtctgtaaaaggtgtgccctcatatgttctttgctcctctgggagtgtgattcttatttcagtaagaaatagcatagacatgttgagtctttcctttcatttagcatcttaataatgatgaccatgttgcctgccatctcgtgaagatgaacaattatttcatggtgagctcaaagttatgttactgtatgtgactcacttgagtccaccatggttctattttattgatgatgacaacgacccaccgtggcccactcagtgcctcttctggtggccccaggatcctcctgaaggaacccaggagacctcgatggctttccactctctgttcacaatctatcctgggcacatctttctcctgccttgtgcctggaattgcccattaaccccaagtggactagtccccataactgggaggtgggatttagtgaccacacttggggtgcttctcacacagcccttttgagtcagacactccagacatacccagaaatgagacaagaccctgaaagggtaacaggggcttgcttccaacttctccctggaggttgaggctggcatttcatactaaaacctagtgagacccatcccaaactaagacaacacaaggaggacggaagtgagacgccctggagttgtggttgtggtcacgttggagcttcccatgactgctgactctggggcaagctgcccctcctctaaggcactcactggggacacctgaggacgcctcctgctcttaccctgtagtcacaccaagagatcagggttacaacaaccctatagagaatccctgtccccttccatgtcacttcactccttcgtgaagcaaatgccctcaaggagctcattcccattcctgggtcacagtcacctggaaaacctgatccagacaccaacctcctcaggcctcgccatttccagacgtcccgttactgcatacgcttggtcgactgtcccatctcagcttgagaagggcaggcaggtgtgtggactctgctgagcaaatgccttccaggggcagtggtctggcttcctgcaccatagcttcaggtgggggatggggagggggagttaggggccccagggaagagtttttgtatgaacctgtgtcaccgcattttgtatttggtggaggaacccagctgatcattttagatgagtctcttcttccctttctttccctgccaagttggtgacaattttattctgatttcgatctttgtctgtgacttgccacagcctgtggtcagggtttcctttgggacctcggtcctgggaggctgatctctctcctccctattcagacccctgtatgcctcagctggtcactgagacaccttcatctcctctgaccccagaggcagggagctccaagacaaggccacactggtgtgtctcatgagtgacttctacccgagagccatgacagtggcctggaagatagatggcatcaccatcacccagggtgtggagaccaccacaccctccaaacagagcaacaagtatgcggccagcagctacctaagactggcacccgacagtggaagtcccacaacctctacagctgccaggtcacgcatgaaaggaacactgtggagaagacagtggcccctgcagaatgttcttaggtccccgaccctcacctacacacgggggcctagagctgcaggatcagggcatgtgtctcccctcccactccaagtcatccagcccttctccctgcacccagtaaccctcaataaatatcctcattgtcaaccagaaatcctgctgtctgtcttcatttcttatctcatatttagtttgcaacctccttaaattctaagcaaggatgaggaaaatccaggtgcccagtttatcgggtgagaagtccatggtggtgccatcaccaggaacttgtggaaaggtctgggaatggaaactcacaggtgaatttcacagattttcacaatacagggtggctaagtaaagacacttacaagtcctgcaatagggaaacaggaagtccagaatcctgctcaccatcccagccaacttagtgagccctaggatgctctgcaagatactggtgttcacgtcgctagctctggaaagtggggtgaggctggggcacacgggtgatcagttatgatcagatgggcttagggtgaggttcaaagttaaccagcacgtggctgagatctcaaccatgaagttcccaattctaaagtcaggctctggggtggagtgagtatgtgcttggtgtgtggctgagcctgtgatggtcagctcgtgtgaggggaggactcctgtggactgagacaaatgagcaaagacaccatcccaggcacagaacgggcatcccatggttgtcggggagagtctgtgtcagagtctcattctggactagagtcaaggctgggtcacgcaaggtcagcacagggtgaacatgacctaggggctatctataggcaaagtcaggctttcacgggatctcaactgccccaaacacccccatcccaccaggccccactccctctgtcactcacgttgttccgtcccctcaccccctgcaccatggtgcaccggcagcctcactcagagacaccctcatcccggggtccctgacagtgggcaatttggtcccttgaaggccttgacaggctcggttaatccatagtgcccgggctgggacccccactgtttctggttcatcagggacatggcagcagctgctgggtggccagccaggacaggaacagagctgcaaggcctgggggctttttccacaatgatacacaaagagaggggcccctttggagctcagtcccagccacccctgccccaaatcacagccgtgagctgaattgaatttcaggtgcccagagtccctcagcctctgtttgacccatttcacagctatgaaaattcaagcccatgggagacactgtcccaagcttcaccctctctataagttgtacatttttatgatgaagatctctgaacacaaaaatagggagacagaagaatagtaatgactccaaggttcccatcagccagtccgcagcatcatccattttcagataatgcggacccacccacagcagaataactaaactactccttcaagcaagggtgtgaagcaaatgctagtcatcacacacacaactggagagaatatcaaggatttcttgacatcaaaaatagttaatgagagtcttatcaaatgtcttgtgaatatcattgtgtctatttttgtcgactttgtggtgctgttgcatatttgtgatttaatttcatttctatgtggattaaatacttgacgttatcattggtgaatgtgtttttagacccattccatctgcaggtgtctcccaaattgctctagctttccctggcaaggcaggagctgcaggagcagagagctggtcccgggacctcccacagtcgggatgcaggcgccacctccctgagcaggaacccagtgcttccctcaacctctcttttcctgaaaaatggttctagcatcaagaggctcaagggggttcaggctggacattggcaaactcgcttcccaggacacgtggctacttccagcaaagccacccatgttgtgttgtcattctttcagtgacattagctgcatttgatgatcaataacttcgcgcctcagatgagaaggaaggcagatggtcaagacttcggtccacctccttctcatgagggcttccagaagggagggcacagcagctgcaccgtgcgctcaggagtgtgcttcatgctttgggaagaagaaaaaatgtacattcttcccttttgttcaccactttgataactgatgatctggtgcccagccatcctccagggcgcacagcacaatgtagtaccggagtgagctctagcgtgtgaggacatctgacatgtgggctccactgcagatatactgaattgcaatgacaatgcggctacaaaacataaacatttacccactgggcgcctcctcaggtggcatctgattttctcccattgccccaggagcttccatggctcctgatttctcggaggatgagaggttctgtctcatcatgtccctttcctgccccaggcctgggatcccgcactgacctcacctcccttagcagaaggtgatatttggagaccacactcgggagctcctttatgtccctcacatttgaataaggcagtggcagccactaccccacctcacccaccaaaatgagaccaggttgaggggtgcaggagatccttccattttaccctggaggatagggctggcatttccagtggggaccagccaggcctcactggccaggcccatcccaactaggacaagcccagggaaggctgggctgaggctcctggagtcacagataggttcatgggaagcttcccaagacaccgcactctagggtaaccagcttcttcctggagggagagggcactctctgcatcaccccagggcgtcaccaagcagtcagtgtcgagtcagctccaccagggagaccatttatccctgaccatgggagttcactcctagtgacacagtgccctccaataaactcatccccatggctgcatgatggttggtgggaaaaccaaatccactgtcctccaggaaccaggatttctagggatcctgctggtcacaggatgtcacctgtccccttctctctgtgggggtgagtgtggcagccgtgtgaactccctcatgagcagatgccaccaggggctgtggcctcagcttcctccatcacagctgcagcgggggttgggggtagaggcgtccagagagggtttttgtatgagcctgtgtcacagcactgggtgtttggtgaggggacggagctgaccgtcctagatgagtcttttccccctccttccctggtctccccaaggtactgggaaattttctgctgcttttgttcttttctgtatcttgtgttgacctgtggtgatgctttctctctggagcctaggccctggtcaaggacctctcccctccctgtttagacccttacctcagtgggtcaccaagaccccttcacctctgacctcagatgtagggcactagactggatgacctactgagactcatctgtctgtctgtctgccagagccaggctgcttccctaaaacttgctcagttctgtcctcccccacctgggcttctgtctaacgaactttgtgcaagggaaactgaggccccatctcatgagggagagggaacaaggggctcgaaggagtgaccacctggtggactttagaaggacctgaaaccctcagagccaagataggggaatgaaaactcagagtctcagggcccagtcccctggactgtgggactctggatccaggctgggaacaaggtaggaggtgcaggggcctctccaggtttctgtgggctcccagggagagagccctgagctggtctgggacccatgaagccctgtcaggagggacgggaaggctctggacatgaaggagccaggtgaagtgtcacgaaaggccatggcattcagggaggtggctgatgggtctctgtgggaggcacccctagaagcaggaacccctgagttcaccgacaggcatatcccaaggcagaaaaactgtagattggccctaaacacagagagactctaacacagactccacagacaaagagcccaggacagacagacagtgggacttgggtgagcaaaggccctgactccactgcagaagatccaggagagacggatgtgggtacaaacagagttcttacgtgagagacccactctcccccaacccagagcagctgtgtcaggtgagaaaagtttccagagtgaatctaacaagaggctcacagagctcagagaacacagccagagccggatcacgtcaggatgacagggtgaggcagcgccaggcaattgaaggtccactgtctatacaaaagcccaagtccttggaagatttccaaacaggcgatgggcaggggccaagctcagaggttttctgactgacagagttcttttaggaacatgatgtcacacccttctgagacagtgtggaccacatctgagaggtcctgcactggtactggggggcctgaacactcctcatgcactgaggtcaggggctccccaggtggacaccaggactctgacctcctgcccctcatccattctgcaggtccgctcaaggccacccccttggtcactctgttcccgccctcctctgaggagctccaagccaacaaggccatgctggtgtgtctcataaatgacttctacccaggagccatagaaggaaaatggcaccctagtcaccaagggcatagagacaaccacaccctccacacagagcaacaacaactatgcggccagcagctacctgagcctgacgcccgagcagtggaagtcccacagaagctacagctgccaggtcacgcacaaagaaagtaccatggagaagacaatggcccatgcagaatgttcttaggcccccgaccctcaccccacccacaggggcctggagctgcaggatcccagggcagaggtgttccctcccaccccaagtcatccagtccttctgccgacacccaataaaccctcaataaatgtcctccttgtcaatcagaaaacatgctgtctgctcatttttgtttatccactttccatcctaaatttttttatctccaaagatcaacagaatcctttggacttgtgacaatgcagcctgggaccatcttcgtgtttctctgagccgtactttttccatcaccttatccccatagaatgttccagaacaaggaaatagtcttcagaaggaaccagacatcttcattcttacccacgtctctgttgtgcttcctgctgccctgtgagcacgtccacctctggctgcccggggacacaccctccttacatccctatggccccgggagaacatctcagctcccttctttgttgtcctcggccctcactgtccagatgccatccctctctcaaggtgtttgtccatccccctccaaggccatgtggtcaccccacctgtatttcccctcatcaaagcctagagcatctccccttctccatgggcacactctgttcccgtcatcccagggaccctgccctcagcccccacaggccctccctataataatcactgatgggatgcttaccccctggaccctggtcactcaccccacatccccctctgggtgcctctcatcccacatgtgtcaccggatgccccagctgtattcaacattcctaggggacaagggtcggctctgctcctcactgacaccattatgaatgcctaatgtcctgctgtgcacaagttgtcaattgactggtgagttcaaagtcagattctggggttatgccaggagcttgggtgacgctgattcttcttctgaagaactcagcatgggatctgagctataatacacacacacgtgtacacacacacaatgcacataaacacacatgtccatgctgggcatccttctgggaggatcaggaaggtagaaggggctgcagtcaggcccaggtcaggacatgagcaaagcaaagctgagacctgctgtctccaggctttgggactagggggtcgcccctggatatgggagggtggggcagggttttctgtccaggccaagagggagacaggagaagatgtggacgggattctgatcagggagcagcaggccacatctcagcagtcaggggaggcgcttgctgtggggaatactgttggggactgcatggtgccaggagtgtgtcccaggtgtgagctcttcaggtgatgggcccagaccaggatgcaggtccaggctgtgtgtgtccaggccccacactgcacatgcccatccactgtgggtgccccccgtgccggtgacactccagagcacaggctgtgtgggtcacccgtgcatgtaggggactgcagagcacacacatgtgggtgtgtgtgtaagccgggggagctgaagtggacagcagagatcccccacacgtagagctcctggaggaaaccacactgccagtgaggcctatgacctcccttgagaagctctcctctgggccattgcagctctaatccagcacacatggcctataggtaggaagctgtccccatgggttcaggaggcggacttgggcagtgatctgtgagctgctccttcaggacagctgggccaaggatgctggagctcagaccttgcagtggggtctgtgtccctgtggtcaacgtcattcttcccacaacccccaattcccattccaagcccatcccatcataacctccagtgctgaggatgtggggggcatcaaggaccctccccaccattcccaacttctcaaagaggtcccagctgcaccatgtcagtggcgtcacccagccgctcacctccccttcctccctggcattcctgacaccagctgatccaggccacccaactcctcagaaatgcaattacctgggagacaattccacacacagacctgtcaacccttcccatgactgaggtggatgaacccctaagcccccaaggaagtgatattcaggtcagtagaaggtgacccccttcaccccacctatggctcacccacccatgagaaaagggggctggaccctgggccttgtgagcagctgcagggggttggggggcggggtggcctgggtcgggtgtatcaggagggtttgtgtgcagggttatatcacagtgtaatgtgttcggcagtggcaccaaggtgaccgtcctcggtgagtccccttttctattcttttgggtctagggtgagatctggggagacttttctgtcctttctgttctctctagggtagaggtctcaatctctctggggtctgccaccattgccttttttcctggccccaatttcctccagcctgtcccttcttaggcacctggtggggcatgatgggaagatcccagtgacctcttaatgctccctgctcaggcctgaacctgccgctgtcactcagggggcattctcccctgggctctgggatgttctgctccctcgcacagagtctccagtccccaaagaccagcagagcaggggctcaggctggggcaccagggccatgggacaggggaaggatgctggaaaaagttcagcttcccagggttctgggtcccaactatggggctgctttaaacaccaagaagggaggcctttgactggggacttggggaaatgaagggggacaaggatggaggaagaatgtcctgtgaggtggcgccagggtgctgggtccctcctcctcccccgggacaggcaggctgccatagacagggtggttctcaggacactcagtccaaggttagagcctccccatcccacccaaaaagagagacccccaaagcagatgctgagggaggcactcctggtgggcgcaggtgacagggacctgtcaggacagacatttgtcctaggacagccagatctcccaacgacagggagaccccatagagcagacacagcgccaggctcagaacagaaaatatacctcacatgcaagccctccatctcctggactcccaggacccggctcccaggactgacatcccctccccaccaaggggcctctgtgggaaagtggggcagagactgcaatgatggtgctgggggatatgtgaggaagaaattcacttgtcaaaagggaggagaacctaaaaacaggacacagatgccctcgtgaacagacccagaggagggacctggcaggggatgttcagacagagacgtcccccaaggaaagacgagggcccagggctgaacccagccagcgtcggggagcataggtgaggtgagagctggctgataaggaggggagaatctggagaggaggctggagcagaagaggcctgattctcctcagtcctcagatgctgaggagtttcccatcaggaggtaagcgtccccgccaccgccaagttgacctcagtacagcaagggcccagcctgaggtccctatcctgggccttagtccttcacccacctgaaaactgaggccaggggctccccaggtggacaccaggactctgaccccctgcccctcatccaccccgcaggtcagcccaaggctgccccctcggtcactctgttcccgccctcctctgaggagcttcaagccaacaaggccacactggtgtgcctgatcagtgacttctacccgggagctgtgaaagtggcctggaaggcagatggcagccccgtcaacgcgggagtggagaccaccacaccctccaaacagagcaacaacaagtacgcggccagcagctagctacctgagcctgacgcctgagcagtggaagtcccacagaagctacagttgccaggtcacgcatgaagggagcaccgtggagaagacagtggcccctgcagaatgctcttaggcccccgaccctcaccccacccacaggggcctggagctgcaggttcccaggggagggggtctctctccccatcccaagtcatccagcccttcttcctacactcaataaaccctcaataaatatcctcagtccaccagaaaccctgggttttgtgttttgcttctgtttatacattttctaccctaaattggtccaacctgcaagatgaacaaaattcttttagccttgtgggaatgaagtctggattgtttttgaggggtagttccaccatcacctagaaaggcccagagaatattccagaacagagccttgggcagcaggccccaggactgcccctttcccatacgtgctgtgtttgtgtggacatgtccacctccagcggcctggggcgaccgctccttggttccccatggcccagaagaacgagtaccctccacggatcatcaggcctcacccctggacagcctccctctctcaaggggtccctccttctgaggcggaaggagcctctccagtccatgggcccttggtctcccctactccttaggggcccaccctgttcctgactcccaggaccctgccctctacccccacatctatctctgaagcaggcacagactggaccctgaccctctggacccaggtcactcaccccacaggccagctgggtacccctggtcccacatgtgtcaccagtgtcccagttatactcaagtcccctgggggataagggtcaactctactctctctcacccctaagtaaccagcccaaaactgaccacacctcaagtacctaatgtccagttatccacggatggtcagtggggctggggaggtcaaagtcaatcatgagattccagagtggtgccatagacgtgcctgtaaaccaattggtctttttaagagctgtatgtgggatctaagaaccgggttgatgattgtcccaggaggtagcacaggatggggggcctgggctatgagacaaacacacatacatacatgttcacaaacataaacacacatgaacacctcataggcacacaggtattcacaaacaaacatgcctgcatgcaaatacatacacacacactctcctgtgctatttagaatcattaccacatgggcatcccactaggggctgtgctgggcatccaggaccctcccagggaactcggatctccataggggaccagctccaccttccctgtggcataaacaggcttctcacttcttccatggtgacagtctccaaaggagctgagccgggacacatggcttcctccaggacagagagtagcaggggacccagatgtgatgtgcagacatgcctcctccctctcccctctccctctgggggtgaagggatccctgacttccagtaaagtgtgcatccatgcatggaggggccatccccctcaccctcctatcggccagacctgcttcatgacagggccactggacctgggcgcccaagctgctgcagcggggaacgggtcgggtgtgtcaggaggggtttgtgtgtggggctgtgtcactgtgtgctgtgttcggaggaggcacccagctgaccgccctcggtaagtctccccgcttctctcctctttgagatcccaagttaaacacggggagtttttccctttcctgtctgtcgaaggctaaggtctaagcctgtctggatgtctggaatctttgcccctccttgcctgggctcctgccctcttctgtgattctgtcctctgtgggtcccagttacggggctgcattaaacacagtgacaggaggcctttgactgaggacttggagagatgggggaggaaatggcaggaggacaaagatagaggaagaatattccgtgagaaggtggccccacagcgctgggtcacacgccatcccccaagacaggcaggacaccacagacagggtggtgggtctcagaaaactcaggccctaaacgtggatgcttaccaattcctccactggaggaagacctcagagcagatgcccaggacagggacttctggtagggacggtgactgggacgggtgcctgtttgtcagggaaaacccactggagagtcagatcccccagataacttctcacgacatggagactctttcgaacagacaaagctccacgttcagctcagggagtaaaaaaaaaatgcctcaaatggaggcctttgatctactggaatccagcccccaggactgacaccctgtctcaccaggcagcccagaggggtctctgcagggaggtggggtgggggctgcaatgatggcaccagggagatgtgtgggtaagaaacccactccctgtgagagagaagagcctgaacccaggaccaacagctgccctgcatgaagagatgagaacaaggggaactggtaggaggtgttcagacagacacccccaagatagacaaatacccagggtgagatgtggtcctggactccatcccatccagtgtggagccagcaccggtgggggtctataggtgatggaaaatatgaaaaagagacagatccaagagggggtctgtgacccccaagagtgggggcaactcccatctgacagcgagtgtctccactcaccgctgacctgacctcagtccagcaagggtccggcctgaggtccctgccctgggccttagtcccatacccacttcaagactgaggtcaggggctccccaggtggacaccaggactctgaccccctgcccctcatccaccccgcaggtcagcccaaggctgccccctcggtcactctgttcccaccctcctctgaggagcttcaagccaacaaggccacactggtgtgtctcgtaagtgacttctacccgggagccgtgacagtggcctggaaggcagatggcagccccgtcaaggtgggagtggagaccaccaaaccctccaaacaaagcaacaacaagtatgcggccagcagctacctgagcctgacgcccgagcagtggaagtcccacagaagctacagctgccgggtcacgcatgaagggagcaccgtggagaagacagtggcccctgcagaatgctcttaggcccccgaccctcaccccacccacaggggcctggagctgcaggttcccaggggaggggtctctgcccccatcccaagtcatccagcccttctcaataaatatcctcatcgtcaacgagaaatcctgctccctctcttcttttcttatctcacacataatttgaggcctcccctgggttctcagtgttgggtgggggaatcctggcacccagtgagaaagtggccctgagggagaggctcatagcctcccggggtgtctcctggtgaaagaggcccggataggagaagtctgatcactgaacaccagtccctctgccctttcattcctcccccttctcctcaaagcatagccccccacctccctgcctcctgcctggatggagttgtctctggctgggactccagttacaccctctatctctgccctaacagagacacccttcacccaccatctcttttcccagcctgaaaaccctgctccaagcctggagcctctttgcccctggcccttgcccccggaatgccctcctccctctgtgcccagctcagctcccacccaccctcaccccctccctgtcatccctgagagccagactgtccaggacactccagcaccactgacttctcaagctgttcaatgagggacccacctcgattcctcacctgacagcaggttcagacacttaagaggaatgggaggaagccaggaaggagactcacacgaaaggcctacaggaggctcgggacacttggaaaagataggctctgagctccctaggaaccagtgcaaggagggtaataagcacttcaccacttctgtaaatttaaacaaaccctttgctgaagggaaggtggtgttctcaatgctggggccagtcatctcgtcacaactaaaagtgggaacatgttctatccaaggcctcagtagtaatgggatgtgaaccttgacacacgcacaggtaactatctggcagcccttagacatggtgattctctcaagtgcgtgaacagaaagtcactggccgtctttgggaacatcatttttgggaacacttctccattggatcccgggccttcactggaaaaccaggtccctcatcaggactttctctgtgaggttccctgagtctggggctccaactgctctctgagaggaaggggtgggggaagagaacacgacccagccccacccagcccctcctgcatggcccctcctctgtagagtgggggcacctgcaggggtcaggcctgggttactgtgggtggggcctgggaggggcccttgtggcatcctggggagtctctcccacggctccttgtttgactttcctgtggctgctggctgttatcacaaatgacccctaatttagtgccttaaaacatcacacactgattctctcccaggtctggaggtcagaagtccaaaatgagtccttgggggctaaaatcagggtcccagcagggccggctccttctggggactctggggagaattcgtttccaggacttttccagcttctagaggacaacctcagctcctggccccttcctccaacttcagagcctgagctcagcatcttcaaatctctctcttgctcttctctccctccctaccttcttctctccctctcttccttctctctctctccgtctccctccatccccacatcttgtcctctcactctgaccctcctgcctccctctttcttctataaagaccccagcttggacccacctggataacccaggagcatttcccacctcaggctcctaattgacatgacatctgcaaagtccctgtggccacacatgacacatagacaggtccaggattgggacacgactgtccccgcggggcctaatttagccgaccacagcccctttcccgagttcctctccctttctccatgccctgcccagtccaggctgagccactcctggggggccgtcccagcccagcccaagccctccctatccctggtctcttgtggccccttctcctcctggggttccaggaaggcactgggagtttagccacagctctagggcactgtcttccagcaggccccctgagactaaatgccctccaggccaaatcacccttggaggaagatcctattgtgatcctcactctaggatggtgacatcacagcccagagagcctgagtgacctgccacaggtcacagtagggactcaaacctggtccacccaactgcagatctcagctctggaccccaggtgcctggctgccctcagcccacctggccacgcccacccacttcatccagcttcctccctggagagctcaaagcccactggacccaggcccccatcccgggacccgggattcaagtgacagaattattggaccaacaagggatggaaggggacggggcctcaggttggagtagccagattcctcatgccccttctccttcctccgggtcaaatatcagggtcagggcactcggagggagggaccatgagagtccccttttcctagagaccccatctcagtcctggttctggatccagggcttacggtgtcccccacctccaggagagtcagtccctggcaggtggctccccaagcccaatcccctccattcctggtcccagttgctccctcaacatccaaaaattcctgacatcttcagtcagggactgctctcccaagggaagagcacatggggctctgggtctggggctgtgggaaagaggaaccccggtcctctcggggcccagcaccgagcgcagtaggtgttcgaggggggctgagtggtgacatgtgagactctttgtagaaccccagattcaggttcgtgtacctgatatgcagcggaggtcaaaaactgacacaagtgcttggagatagaaaaagatttatttcatttggctaaagtaagaagacaagaaagcaaattcctccactccatgttaacaaaaggatgaagcagggagtttttatgtggctaaggagtgagggaggtggcatttcaggggaaaagtctgtgtttattcagtctcaggtaacatcttaagcaactagacttgcgggcgacagcggctggtctctacgtccctaaaggcattcactcctgcaaaatacttttgtgactctgaagttatctcctccttcttgacaaagaaacaggacatctgcagcttatgatcacattgtgtgaacaagggatgctgggcaaaaagcaagcagttaacttgtacaagcaggcaagggccaaatcagaattttctttacttcagtcacaaaaatgctgggtactgaaatctcaactcacctggtgtcactcccagggcacaggctaggacaacacgcacccgtccctggagaactctgggctggttcccccttctccccctgctgaccccctcttagtctacctccgctcctcccttcccccaccggagaacctcccagggtttccatttcctcccggataacataacacgtgctgccctgtgaggaggtgctaaagtcaagagcaaggtggcagggggctttcgagcaagaggcgacctgacttcagagaccctcagtccccaagacagacgcatgccctttgagagagcggccgccccaggcacacgcaggctctgggctgtcaggatgggagcacgtggtcctcttccacccacctcccgaatctcccctgctccccgcacccatttccctgtggcccccatttccctgtggtcactgtaatcggaccccactccagtccccttccccactgactctgggagctggggttgatgctggggctggagcagtgaccagcccatggtgaccccggccccatccaggtactaggccactggccaccaatcaactatggtttcccaagcacccatatgtgcccagcctgggcttgggacccaggcctagtcctgcctggcccactgcagcagtaatggtgggctcttcctggagagaacctggaccacagtctctctgcctcaacatctcagtatgaagggccagagaccctcctgatggtcaccttaggagcacaaatgtggtcctgccaggaagaagtaataaaatgtgaatgctgccttcctctggctgcccctccctctctcctgccttttacaagtggtaatcaagggctcctggcctccacggtcccctcccttcctgcctcaagcccagcagtctcaccaccaccccatcacagccccagtggcctgcacgtggctcaatccaatggtcccctcactgtcctccttctgttgacctcaggatgggcttggcaactcacatcattctcgtcatcttgaagcccctcacccacccacccccacccccccgcccccccgccaaggtcctctcttctatggtcccctcccactttgttctgctgctgccccatcagggccaccggcagctagcacccttggtgactctttctttcactgtgtgattcatgaactaccggaatgtaaaagggttccttgctccttccccggccccagccctcagcccagtggtgcctcaggcttgatggctgcccagggctgctgaccacgctctcctggtgccgccctgcccagcaccgatctgggacaccacgggagcctggaagcaggggctgcacccctcacgtcctccgatgttcagccaggtgctgggctgggtatcactgagcccctcgatggccactgctcgacagtggaactgctcccggctctgctgaagatgctacctcacctgccacctggcccagggccacttccagggaaaccctgcactggcgtctgtcctctctatgtcatgggatcccaaaccaccccaggaggcacgtgtccatgtcccgcacaccttacagatgaggagacggagattcggagaccagcagcctgcccgagtcccacagctgcccagggctgcacagatggtgggcactgggactctgatccaaggtcaacccagagccagccccttccctaaggcgtgcagaggaggctgagcctgcccaggtcctgcaggtgttcagggcagcacagtggttgcccaggcccctgacctaggccacccttccatcctgaggccgtgcctgggcaaggccaagagatggtgctgagtgcatgaacccccttgtggctctgtgggatgggcagacctgggctcctcattctctgttgactcagtgggtgaaagaggcaggcaggagggcagccatgggggtgccctctgagtctacaaagcagagccaggacaggtgttcatgtgcccatttcacagatgagaggactgaggctccgatgggaggggtgatgacccacctagggtcacacagtaggttaccggctgacccatgcccgcctcttttcatgactcctcggccctaagggcttttcattcattcattcatccattcatttgttcagactcactcattcattcattcaacaaactctcagctgtgggccaggggctggtgtatgcagcccaggaccacctgccctagaggagctcacaagcttggagaacgacatggagacaccactgcccccaccctgtcaagtctccaaggttggcactctgcccagggagtgtctggggcagcaggagcatctccccacactcaggaaaagatttaactgaaagaaccatctgagagagccccagctgtgatccttgggccacagtgggaacatcacagtccctcactgaccctcacagtgaccctgaggcctaaagctgccattgcccacctcacagaggggacgtgaaccatgatggatgcaccagcgctgcccaggctccacccagttcaggagtagccgagttgggccttagcccacgcctgtcttcacatgccactgtgtctagctcagaccggggccagcccctcacgagtgatggcctcatgacaccgaaggagggttggtctgtgctgggggaacccctcaaggtatagggaagagtgtcacagtgggggatggggtgagaggaactcgtcctggccctggccctgcttagctgcagcctgggctgagggaggtgttctgagtcagatcagggaggggccctgtggcttcctctacagcaaagccagagcccagaatagcctgggagggggtgcaggggccctgctggaggagaggggggtggctgctcagggccctgcgggaggaaaagactgggagctactatgaactgagtgggtgactctcccatcaggcccagcctcctgtggggcctgcaaagccaccaagagagtgtccccagccaggcctggacaaaggcaccattacccttcaacccccatattcactgaatccaggggcaagaagggggacatcgacactcacctgggaacaagcaaaccagctcagatgccccataacgaggccaccagatcccaggcaagcccccattcctcaacacaaaggtccaaaatcaagtttccagccaactagaacatgcgaattttggggacatagaggaaataatcaccatccactcgcaatgcccactgctaatgacacagcacaatgctgaggatgttgctcctccctcccgacatgtcatcctcttctccagagtctctgtcacaccagggccaggttctggattccccacccaccccgcctgcaggacacgagtccttgatgttgaccccacaccctgggctccatccctgacctaaggaccagcttctacggccctgaaagagtcgtgtgtcatgacttgacactggtcctcttccctgtgctgaatgagacgtgaaggaaaaatgaacccaaatctgcccaggatcccctgcgccacacgtgagatgctccagttccctcggggattcagaagcatccctagctggcatcaacggaggccgggaagactaggtcttttcccaaaatgcttagttatgcaaacacctcaaaaggcacccgtacctcttgtaacaacccaagcgtgaggactccctctttctggggtgatctggggaaactgctctcctacatggtcatcttgaggattgcagatgggccacggaaatgtcaacacagtgacatcagcaggggcagtagggtcaggatcagggtcagtctttgtcacttggtcacttgggaccacatcaaacctgaccctgtttggccagtaatttcacaagggtggtctccccaggaaacacgtgggctgggcaaggtctgaggggagggggatgacctgcatcctgcattttccaggacattcccagtttgtgccactgactctggaagctgaggtggatgctagagcagtgtccagcccctggtgaccctagccccatccaggtccccagaccactggccaccaatcagctgcagtttcccaggtgcctatgtgtacccagcctcagctcgggacccaggcctggccgtgcctggcccattgtagcagtaatggtgggctctgcccagagacccaggcctgggctgcctccaggacccccacccacatctatcagagagactcgtgaagttattaatagtgccccttccactcccaggaacatcccagtttaaacaacaaactttggttgcccaagctcagagtaaccgtttgctaaatgactgaatgacgttcttcataatggctaataatgagggggaggaagccaagcccagccacctagcactatggtaagcagtgctggacattacaatgggggccaggggccaggagagcctcactaggggccacatccaggcagtcaccatgacattcctggtcccctgcctggagcccctagaaatgagctcactcaggcccagctcacaacacaaccaggggtggccctaataccatctcccactcagcaacagcacaccacgtccagagaccggcaagggacagctcctctgggcagccctagttcctggggagaccacaggcagcagggagaatgcctcctggctttgggacaggagccagggaggggctgggtgacttctgtggctggcaacacagagcccccgtgtcagctccaggaaagagtagcccacagccaggacgacccaccagggcacccgcagtgtgcctctttccatacaggccatccttcatggtgactctctcttcctatagcaacaccaacacccttgatctggccacgggtccctcctgcttctcacatcaggtctgatgtccactgagcatccaatgtgccagttgccgtgccaggcaccaaagcctggacccctcacaggtgtcactaggatgggccctccctgcccacccagttcccagcctgtgcagggacatgttgggactttctgactatggaaatgatagaggagaaaggggcctcatcttcacagtttcaggccaaaggggagcctcccactcagacccctagacacatcctctcctgacctgtctggggaggaggatgggaagtggtggtcagacttggcctgggctcccacaggggacagaaagtttgcaaaggtctgggcagcagagagcagctcccagaaggaaggggtgctggtccccaggggctgctgggcagagtagctgaagaaggtgagaccccagaccggccaggtaagtaagcccccttctcaggggctgcccagagcgaagtcacatgttcagctctcttctgaggacctgctgctcctggaaacccagcagggttaaggcaggcacagccaggttcagacagctcatgtttgcgggagagggaaatcaagtcaacagacaaggaacaatgtcatgtaggaggcgggatttgtgctggggagaaatagggcagaggatggggggtagggagcacctggctggggtctcacggggggcgacgtcccaggggctggaggcagccagcgactgaggagccctgactagcgccaggcccctgtggctggagttagtggctcgagctcagcctcagtttcccctctgtgcagctgggttgataataatggaaactgactctctgggtggggggagggacaatcagatggaaaatagatgttttgtttgtctctgccgttggttgttttcatccttgggctgttccagccccagacagcctcaggccagccccctgcccatgctgggctccccaccggccctggaaccctcaccccagtgcagctggcctggtgaaaccaagagtgcctgaggcccgaaatagctgggaaaccccaccaagcctcagccctggcagcaggtgcctccttctccccagggtgggaggcaggggggcgattcagtttccaaagcttccaccagcccagctggagaatggtcctgtgtccccgcaccaagacacccaagccccgtgcccaggcttgagttagacagggtctggagatcatggtcaatcaatgatcagaagtagcaccttctgctccagaagcttctattcatgcaggccctaccccctcctcacagctccccaggaaccgttctaaatgccaggttcagagctgtgcccaattggggggcacagccagacacttggagctcagaggggcctggggtgggcagggctggccagagctggacatgggaccctgctgatcacactccacctgccgcccccaggtcttggacccttcaagggagctgggccaagtaaggggatgggaagggaaacaagaacccttccaagagcttccctgggagcccagagcctgaggcagtaacgaagctcctggaagcacagctgccaagaggacttccggggtccctacccagtgggcaggacctcagactggtcagtcacttatttgtgtgtctgtccatccatatatctgaacatgcacacacacacacacgcacacacacacacacactcatccttccacaagccccgaggcctggcctgtgcagggctcttgacacatggtgtcccaggcaaggcaggactgccccagcccacccccaggtgagacctggagtgtgccttctcatgggaggagggggctgtggccttggggtgccccattccctgtccagtcttccccatgctgggtctagatgctgaggtcaaagagaggttgacaggtgtgaggaacaggccactgtggtgaggcttaatgccccctgtccgatgaccagatcctacccactgcccccgttacagacctccctgtctttctccatgtggaggaaacgttcccaggatattccagggctccaggttctgatgagagtatgggaggagaccaagtacccagcctcagggcctgggttcacccctgcagacggcaaatcccatccacctgtgggacttcaccagctcattcttagaggacaccagcctggagctcccttggcccaggaaagccaggagccaggcccgccacacgtagccattgcacatgtcacctgacacataagatgcgaactgtagggtgggcaggccagggatgagtgcccccacctctgccttcctccccacaggcccacccacgaggctgaacagggtggccctagacccagcaccatcttcaatcagctcatccactggcatcccccaccaccgtcccctcaacatgcacaggatgccagccacccaggccagttcctgaagtaaagcaagcaagggggggtacttgtccccgcccagcccagagctcagattgcagatgagacccccttgcttgaagaagacaaggggcaggagatactggggattccatgtggtcatcaaaggtagcctggtggcagcagcaacctcaaacaggcctaggagctggatcaaggactgaagggcagagagaggacgggtgtgttagggggtgagtgtgagcaaaggtataggagtgaccacagcatcccttcttcccacagggccacagtagtgcacaagggccctcatggaagcaccctgaaagctcacctcaaaggccccatactctgtcccccacgtcacctggcctgccaccctacttaatacccaggaagtccttggagtctgtgccacatggatgggctccaagatggaccaggcttccaggggggcagggaacaagggagaaaagaggtctgggccctgcataggacacaggtagtgaccacccggtggaggagagggaatgagcagaggatgctgggagccaggcccaaggcagggccctgcagggtgcacagttctctgggttggacggtggaccaaggccatgaacattcatgctggtccaggccagtggaccagagtgccccaagccccagagctctgcagaggggcaggggcagggcccagagagagcaaggccgagagtagaggccctaaacctcaggtctgaccagatctgcaactctacaggtagctgcatcctgtgttgagacgctattgagtggccttattgtcccgtaccatttataaaacacgtggacacatgttatccacctgagccactcagggattctgtgaggccacagccagaatcatggtcccatttcacaggtaggaaaactgaggcccagagcagttagatcccaaaaagccagagccagctctgtggtgtcctgacttccagcccagggcctcccatctgacaaatggagaaacagaccaggagagaaagggatctgcccgagctcacataggcgcccctgtgtggaggggcccatgtagaggggcccatgtggaggggacctgtatggagggtggcatgtggaggggcccacgtgtggaggggcccatgtgtggaggggcccgtgtggagggatcgtgtgtggaggggcccgtgtggagggatcatgtgtggaggggcccatgtggaggggcctgtgtggagaaatcatgtgtggaggggcccatgtggaggggcctgcgtggaggggcccgcgtggaggggcccgcgtggaggggcccgcgtggagggatcatgtgtgaaggggcccgcatggaggggcctgtcggtagggtgccaggtagaggggcccatgtggaggggatctgttggagggtgtctgtgtggagggggcctgtgtggaggggcccgtgaggagggcgctgtgtggtgggacccgtgtggaggagcctgcatggagaagacctgtatggagggtggctgtgtggaccactgccctctgccagagaccagattgttcacttcctccaccattccacagctccagccccatttcaggggtgcagaaaagaggcctgaaagcagcatggatgagagttagggctacaggccctgatggccattccttccctgtgccttgggagatgcaaggaaggagggtggctgcaaaggcctgtgggagcccagagcactgttcttcccaaaggggcatctgccctgggagcccagacctcagtgtcagacagagaaggggtccccccaccatgctcagccctcatcaacccttgaccttgagcaatctgcttctcttctgtagccctcagtttcctcatctgcccaagggggtgataagagtccctccccacaaggtaggtttgcggattgagatgatgcctaagctgtgcctggcctatggggaccctcacctaccctcagtcattgctcttgcctgggcctgcgggtgacactgtgtgaacctgggcaaatgcctttgccttcctgggcccagccttccctctggtcaaggaggaactgggtcagggaccccgagtgccagccattcaggaaaccagcagattcctgggtgaaggggttggccagggaggcctgagatgggagtagggtgggggccaggccaagggatggggttgggggatgcgctttcccagctctggtggccctgcctgcagctggccacccctggaaatccccaggctaaatttaaccccaagttggctgaaaccagaactcagagtgacaaaaggagaaaaataagaggaagagaaactgagctcatggccacccgggcatgggatgagtgacaaacaggcccaggtgtggcccaggaggagcatggggcagtttcagggctgctgctggatgtttgtgcagctcacaggtgggggcagtagagcctgcgccccaccccaccccctcctagtccagcccctgggcctgatgctgccccctggctgcctccccacaccctgagctccatcctgggtcccagggtccaccagaaggcatctcagaaccagccagcagtggccctgattgtcagcaggaccccagggaggggggtggccaggacagggctctgaagcccccaccccaggaccttccctgggcagaacgagttggtgagggagtgatgagcaaccacaggcctcctaacttcccaagctggcgattctgagaggcctcaaggctgagacacggttcagccttttaggccctcctgaacgtgtcccctgtctccacagcctgggaatgcactctcttttgacccagaaatcctgctcataagaatttatcatggagatgccagagggccagtgcatgtggatgttagccagggagctaagagcaaaacgtgacagaaaagagcccgagagcagatgccagcctcacatccacatccccagatggccttggagaagggtcatagacagatgttcacaacagggcaagaagaagtgaggaaagaagttcccatctttgtgataaccccatgatttcatgcagaaaaagatctggaaggcgccataccaacgcgctaacagggcctcttgggcagtgcaggatcagagacttgctttgtattcttatttaatttttcctgttttcagattttataatcggagaacaaaacattaaaccaatttaagatgtaagatcctataaaaatgctgtattcgatgatgcgaatggcatctgaaaagccttgaacatattatcccaaagaggccaccagataagacgtgacctgtgtgtgcatgaatccctgcatttttatccatacctagatgcacatccgtatccacatctattccccggggctaccggttgcgggggtaaactgtaggtaatattggttttcattttgtacatctaacttttttcattttttgacaatcattatacatttattattatgaaaaatagaaggttttgtcacttaaatcaacatgtttattccaattcacttaacattcagcaaatatttcttgtgtgtctgctacacccacaacagtcagggtgcagggtttgagattacactgatgagaagacagagtgttctctcttgaggagtagtacaatgggggattatatggaagaggtcactacgatcctaacatggattcgcatcctgtatgtcttaggtgctgcccaaagcccgaaattgtctcacagctccagccagctcagaggcaggaagcccagggaaagttgccgagtcataaaaatggaaagagagggcattccaggggggatgagtacctagcagccgacatttagcaaagaggattggaaaatgaacccccccttaaaatacagttaaacacagaggagggagcaactgcaaacaaaaagtttaagcgatttctgcaaagagcaataaaagccatagagcagcttgggacaaggtcaggtcaggatgagcagaagttgggaaggaaagaaggaagccaggatggacttggagagtttttaccagttcctcaggcaggaagaattgtatggtaggtcagagcatatttctaggaagacctcggttgacaaatttctctgccactgagagatgacaatttaccttggtaactaatctctctcctcatgttcccatctatttgatattgatttaatatgagtagctacctcccatgtgtataataggaaatgtatgggagaatgcatattaattcctgaatagaatatctggttccatgaatgatggaagttggttagaatttattattggaaactcaccctgcactacctatagttggtttattttaattatacttatattcattatatagtaactcatatatatttgtcatttcttttcttatattcaaaaagtctctacataaataaactctgcacctatggtcattgctgggtatctgttctatacacagcaaggagccagacgccctatcttacttgttcactttccagcttctccttagaaaaaaaaatacaagtttttaacccaattctatgagtctagtactgtgacccaaaacccaaagggcaggaactcaacagccacctctccatcctgcctgcctcccaacccacattccccttccagaaccctcactgatgagggaaaagatgatgtctccaagaggagcagcccgttcacacatcttcaagcttcatctccccagcagccatccaagtgcctgaccttcaaggctctcaataaacagtctgaatgaggaaagaaagggagggagggaaagaaggagggagggagaaaggggtaggtggatggatgtatagatgggtgagtgattgatgggtggattggtaggtgaatggatgagtggatagttgggtgggtgagtggatggctggatagatgaatgcgtggactggtgggtacatgtgtgggtgggtagttggatgggtgaatagttggataagtaggtaaattctaaccatgagaagcacagattggtatctggcaactctgtgtagagattagattccaattcctgctctgatcctgactcgggtgtgatcttgggccctttccttaatgtcttgaagccttttcccttcatctgccctgcccatctcacaaactgctgggaagaaccctggaaggacatatgtgcacgaagatgctttagaaaccctagcaagcttctcaggtgtgaccttagcattggagggaacttgaaggtcattgggctgactctcccgatggttggatcacagttcatggtaagagcctaagcttagagtccagacagacctgggtttgtgtcctggctccaccacttgtccgagtgtgactgtcctgcctgtgtactcctctgtgatgtggaggtgatgatggtggcagcttcccctcagggctatgtgaggattcagtgggatcatcgtggaaagccctgggcacatcacccagcaggggtgccacgacgaaacccaaggtctgccctccggggtcccaaaaaagaggcccagtcttgcctttccagagcagggtaccctagaggccatgggattgaaggagagctctaggatgtccagctcacgggttcacaaaaccctgaaaagtgtctgtataaatgctcattgcagggaaagatctgtggctttatacagaaagaggccatgacacataaagggttaaccacagtccatctaatccaggactctcacttaggaaactgagacctatgtcctgtccaagggcactctgtgggtcaggggacagcaaagcacagacattcaacccagcatggaggcccctccccacccaggagcaggagcctgccttggaatgccagacctgagataggattactgccacctgggaacagcatacactggtgagaggcaggggcagggagaacaccaccacaggggcagggagaacaccaggatggggaaagggaaccacagggcctactcttttaattaagcagtagaattgtaagaaaattgcaactttcttttaaaacctgtctttcaaggttgttaaaatggggttttaataacaaaactgtgggagaaagaggtggctgatgtcaaaaacatctcaacccactcccctgggggacctgcagttctctagttcgtgagtttctgctaacaaaaagcacactaaaagaggggccaaaacaaatggaaatcaagcttatcaaacacagatgacatggagttgaccaaagcatctagagctgagattccaggaagcagatctctctcctttctctgggaccatcctaggagaggttccagggccccctggcacagaggtgccaccagcgacctcaaacttcaggcgcaggtgggggcaacaggcgtagttgaggctacagggacacaggtgtcagcacagcatacgagagggccaccttgtttgttttctgacttcctcttaaaatacagtttatcgcccttgatctttagtttcaaatagtaactattcacagtaaacaatgtgacacagtaaacaacgtgtacagaaaaacaaacaggagaaaacaatttgccccttgtacttcacccagaagagccactgctaatattttgatgtatttccttctattttagttgcaaactgtaacaaccattaaataaataaatacgatgaatttgtaaagtttacagagtaataataggagtgatgattgcacaacatcgtgaatgtactaaatgccactcaattgtacactttaaaatggtgaattccacatgatgtgagtttcacatctattagcctcctgggctaggaatactgcctagacctcaggaaccacggaattcatcatctctttccttttccttaaagtttgacctcctgtgtgtgcccttcaacaaacggtttttcagcttgtcctgcttttgaacttcatacggattgaagaagaccatgtgtatttttcatggtttgcttctttctcaacactgtctctttgatattgatgttgatgaattactcatttcactgctgactagaagcccactgtgtggaggtcccatcactcagctgtccactctgctgccactgacacatgggcagttttgcccaggagcagggcatcagaaacacccaattggagtccagtgtgacagtttgtccagggcctgtcattgtacaacacatcatttcactttgtttttcaaacatagtgaattctttcctaattaaagaagaaaagagtataaagagaaagtttccagtgcagcctggagatctgtactggttgtatctggaattccagactcagccttgcatttcacatagcagatagatgatgatgatggagaaggagaagaagaaggaggaggaggaggaaagaaggaagaagaagaagaagaggaggaggaagaagaagacgaagggaagaagaagaaggatgaggaggaggaggaatagacagactgacaaagattctctactgttgtcacttaacaacatatccatgcaggtgtggataaacctgggtgcgcatcacactgggaacaagcagctccaacaacactgaggcagcctcttcccaagtcagctggacaattaggctgctttgctcaggtcgttcactgttctgagcaggacacagccaaagcccctcgcccccacctctgtgcaaggatccagtgactgacttggggttgaccctctctgcaaagatcaaaggtcatgcctgtctaaggccttggacgcatgtcccagactgacttccagaaaagagagcctgaactgccctgctgagtgcccaaagaggcccccctgcatccacgaaaggtacccatgagggtgtggaaggagaggcatccacaggaactgggctcccacctgccccacctgaccccagctctacactgagaataggggagatagaggggcccccagggcctcctccaaactccccagagcatccactgtgaggtgacctgaaccaggccccaagctccctcctcagggaggcctcagactcctccacctccgcagcctccaccgtggctgctctgtgtctctctctggcagcaccaaccacccccactgctactgacaccaccattggagaaggctcagggctatgagttcagcctctggctgctctggagatctagggaggcaggagggctgcaagtgggggctgggagagctattccaggtcaggggtctgtgggctggagtctgtgaggtgtgcacatgtggggctgagggatggctggagaggccctgttggtggccactgtctccaccttcagagcccaggaaggagatttggcccctcctgcatcagataatccctagctccttagttcccaagtcttcagtccccagcctggctctcctggggtggctgcccttgctgtgggaggctggggggatcttcagcccagcacctccagcagcagggcctggtgcccccagctctgcactggcccaggtctcagatcctgggctgtcagcccctcatgggtcccaggtgcccagcccagctgccccaggaggcaggggggtctgggggacaccaaaagagtcttagagaatggacctcaccactcagccacacagaaaaactgaggcccagaggggacaaaggacttgtcatgggtccagctgtgagcctggctgccagtcttaaggcccagtgctcccccacaggatgctgtcacacacacttggccctgatgaggtcccctcttagctgggatccagccccatgaccagcaccccgaggctgcaaagggtgctgggctccagcaccccaagactccacattgaccccaagactccacattgaccactctgagcagaggagcccttgggtctttggggaggttagagagctggcacccccaccccagtctacccggccccggggttcctctctggatagggggccccagtgcagttcacacaggccctgcacgtgttccttcctcagggcatgcgtggctgaagcttgctcaacactaaacatcccagcccagtttattgaatgtgagggatacgcagggtctgagcagagcagccatcccctcctgcctcccctccttccagcgctagagccagagtgactccactgtcctgtgcccacccccagaccaaggagcctcaggaccactcttggggcagggagctcgaggctataggaagattgccccagagcaggatggctgagtgttcaggagtccagccatgtggtaaccgtgcactgcagtgtcacctgaacagggatgtcaccacgtgaaggcatcccagctgcatccttggctgacatatcctaactgtgcctgtacaaggggctccacacacacacacatccacacacacacacacacacacagtcacacttacatacccattcatgctcacacatttatccacacacattcatactcattcacacacacacacgcattcacacactcacacccactcacatgcactggccagagccagagtcgatagcgccctctagtggccactgttgtcccttctctagaaggtctctgtcttatcagtcacaacccccaggagtcttcatccggaaatcccaggatgcacaagtctggcaagatcattatctcctttcacagagagggatgtgacctggccaaggtccctcatcaggaaagtggtacagccctcccctccacccaccaccaatggtccgggtactcagattccgaataactccagctcctgaggccctgtcagagcccagaggctgggccctctcccaagggaggggctggagcagaggatctgggggcccttgtacacccacctgtcacatacacagggtgcacggtcccccgggagggaagaagacaccttgggggagaggaatttccaggccagagagtcccagaaacggctctcctctgtgccaggtgggacggggtataggaggggagggcctgcctgggctttaggaaaacacagaaatgccaagaacattgacacacagcagtaacaaatgctagcctgctgtcaactatcacaggcttttactgagaggaaaatacaactgatcaggttagattcccctccgtttccctcccccttttccctgagagaaacccagtgctgctcactccacatgcagccattcaacagctctggatgtggctttatgcccaggggacccagtggtggcctcgggggccaagccctggaaccaagtgccattgggtgacataggcctggaacaaacaccacgtgatgctgtcatttgtgatgtgatgagttctttacgaaaaagacagggtcaaacgggagactgtgacaactgctggtttagctggatggtcaggaagggacacccctgagtcaatgaggggaccggccagttgtggaggtgcctggggaggagcgctcctggcggcagaaacagcaagtgcgaaggccttggggtgagactctgctgacgaattgcagaaacagcaaggaggccatgtggccagatccaagaagagaggaggggtgagggagggaaggggtagagggagctgggttgcaggcgggggtgggggttccttggggccttacagaccatgctgagcagtttgcatttgttctcagttttcaaatgcacctgaacaacatcatgtggaacctgtcacgctccttctaacttgctacatgtatatctctagtactaggagatgcaactagataaataagacagagctccatggttcaacatacaaatagacgctggtcccggcccatccccagtggatggacatctgggctgtctgggttattcattcacaaacacaggccagtgagcccctgcatgtccccgtgcatacatcatgcctcccaaggacacacactcaccctgtaactagagggacacacgtctatatttgggtttactatgaactgagttctccccagagcagccagactaatgcacagcccagcagggccaccatctcatgccccacaaccacaccctgccttggaactgtggacgattgggatgttcctatccccagagagcacagacatctggcaccaaatgagaaccaggtaaagcccaagggcgaggcccagcccgccgggcgtcactcgaaggtcaccagaccctgccaccctgatgcccattctgctcctgcctcgttgaccttggcctccctgagcctcagtttccccatggttttattcagaggttgcagtcctggtccctactcttttgagtctgcacagactggggcccttcccagcactgctagcatgggggcagagacccttggtggccgaggagggtgaagtgggccaccggagccgggatgggattgcaggacaagagggggccaccgggttgggtagtgcgacccccggaaagcacagggagctgtgcccctccacaggattcccgccctcagagcccctcccctctgtgccccagagcagaagctgagcctgggctgtgtccatggtagaggaaatgctccctccattgggaacagcgtggccggcttctgggcttggggaaggagagggagaattctgggcgggcgatagaggggcccaggttccctctggtcatgaccttgaagttgcccaggtgaccaggaaggaggagggtgctcctctctgtcaagaagatctgagcttctcttccctagaatcagctactcttctatccccctaaaaatgtacaggaattttgcacgttgaatgaatggatagtttactaaccagtttgggaagaattgacacctttcaatccatgaatatcctctgtctttcccattagtatactttaataattctcaagaaagttgtacaattttccccataaacagcttggacatctctgtagatgaacccctagtttactgatatacatttgttgtgagtttttgcagggagcgggtcgggggaggtgtttgtttcggttttgtttagagacagggtctggctctgtcacccaggctggagtgcagcggcacagttttggctcactgctgcctcaaattcctgagatcaagtgatcctcccacctcagcctcctgagtagctgggactacaggcatgcaccaccatgcctggctaatttttaatttgaaattgttttggtagagacagaatcttgctatgttttccaggctggtctcaaactcctgggctcaaacaatccacccgcctcagcctgccaaagtgctgggattacaggtgtgagccactgtgcccagtccaactgatatttttaatgtgattgtaaattgtatccctctttaatattattttccattcatctgctgatgtacaaaaatatattaaataataggcttatatatttgaaatcagatctggtaaatttgctacactttctcatagttctaaaagtgtatctgtgcagtctgtaggatttgctgcacatttaaacatgtcatctgtgaatggtgacaattttgttgccatcttctcaattcctacacctttcatttttttctttcaccttactctccctgctggtattcagtacaatgcggcatccttgtcttgtcacaaaggatgtttatatacagttcactattaaacacgatgcctgctgtaggttccttgcaggagtctctcaccagattaaggaagttattttacatttctcgtatggtaagtagtttctgaaaatcattcttcagattttattcaatgttttttctgcatcttttattgtgatttttttctcctttaatattgcaatttgtcattcttctaatgtcaaaccgattttgcatccttggaatgcatggaccagacttgtccattatgtactagccagcactatatgtggcactactgtgattaaggcatcgtttattcttcagaattgttttattctctggaggatcttgtgtaaggttggaatttcctaccagtgaatctctctgagccagttttggggttgtttttgtttgttttgagacagagtctcgctctttggcccaggctggagtgcagtagcgccatctcagctcactgcaacctccacctcctgggctcaagtgattctcctgcctcagcctctggagtagctgggattacaggctcgtgcaaccacactcagccaatttttgtatttttagtagagaagaggtttcattgtattggccaggctggtcacaaacccctgacctcaagtaatccacccacctcagcctcccaaagtgctggaattacaggcatgagccaccgcaccctgcctaacccagttttgtttgtgggaatatttgtcactatgtattcaatacccttagaagaactgagattttctacttcttcttgagtcaaatatatgtgtttgattagatttttctaagaatactctcatttcatctcaaagtactggcataatgttgttaaaattgactctattacccattttaggtattccacatctataaaacaaccccccgcccccagccctgtttacactcgatatgggtgatttgtgccttctttcttctgtttttattttgttttgttttgttttgatatagagtctcgctctgtcacgtaggctgaagtgcagtggtgcagtggtgcaatcttggctcactgcaacctctgcctccctggttcaagtgattctcctgcctcagcctcccgagtagctgggattacaggcgagtgccaccacacctggcttattttttgtatttttagtagagacagggtttcgccatgttggtcacgctggtcttgaactcctgacctcaagtgatccgcccacctcagcctcccaaagtgctggaattacagacatgagccgccgcacccacccagtcctttcttctgttcttgataaattcaccgaatcagtttcaatttctgtaatattgtaaaggaactaactgccactttcttgctgcatcatcccactgaatatatgatctacttctttaatacttgttcttccctttcttatttccttcaacttttcaagattattttactgcatttttctgagatctatgcatagctcattctttttcagcttattttctataaaatttctatacatattttaaggtaatcaatttccctctatgtactacattagctgtatctcacaaggttttcatgtaatgatttcattattgcttagttcaaaatgtgacctaatttccaatttgagaatctctctaaatcactgggaacatatttcctcatttccaagcatatgaggatgttctagttatatttttgtgactgatttctagtattttgcttacagaacatatgtggaatgttttggtcctttgaaatttgtttaggcttgttttacaggcccacgtatggtccatgtcttagtccatttgggctgttataacaaaatcccataaaatgggtggctcataaacaacagaaatttatttttcatagttctggaggctgagaagtctcagatcaaggcaccagcaggttcagtgtctggtgaggacctgtttcttagttcacagagggtgccttcttgctgtgtccttataagatggaagggaccaggcagctctctgaggcttcttttataagggcactaatcccattcataaggcccctggcctcatgacctagttgcctcccaatggccccacttccctaacaccatcacattaggtttcaacatatgaattctgggaacacaagaattcagaccacagtagtcaatttctgcccgtggtccttttctttttttttcttttcttgtttttttgagacggagtctcactctgttgcccaggctagaatgcagtggcactatctcagctcactgcaagctccgcctcccaggttcaagcgattctcctgcctcagcctcctgagtagctaagattacaggcatgtgccaccatgcctggctgattttttttgtatttttagtagagatagggtttctccatgttggtcaggctggtctcgaactcccaacctcaggtgatccatctgcctcggcctccaaaagtgctgagattgcaggcatgagtcaccgcgcctggccagtccttttctgcttgaagagaatatacatcccataactctggatgcgatgttccatagataagtccattagctcaagtcgattaagtcttctaatcttctgatatcttcttcaagttatttcaggtaatgcttcttggccataaagttttaaaatttgatgtcaacataactataccaatcttccttggagtggaaatttcatggtatctttttagccattctctatcttagcccaccattctggaaataggagctcttctctaaaaggctttcttcatgcatcatttctgaaacgtgcccttatattatgcaagagttgtgtctgttctccttgcatttccaacagtttagtcacatctctgtgatgggatttcttggccttttctgcacagtatctgaggcaggggcagcacagccgggcgcccctcccccatgcttccagagcacacatgtaacatctgttatagaccatgtcagagagccatcctgcaggtcccagaaacatgactcaaatggcctcagacaaagagggagttattgccttgcataactggaaatccagacgtggggcactcagagccgcctgaacccggatgcccagccctgtttctctgggattctctccaccctgtcttcatctccgcattggctggcttccctcatggaggcaaacagctccggcagagcagggcctcaccccatacatgaagccatccaaaggaggaggaggtcgagaccagaatcccaggagatgcagagaggcctattcctgatgaccaagaccagggctgaggcctactggccttcctcagggcaaccaggggcagggtggtgcaggcctcgggcctaggacaggcagatgatcacccccacccccatcctgccaggccagggacaatggagattcctgagcaagcacagctcaagaaccaaccaaaaattccagcaagaagaacacacttggcagaactctggggagatgcagcaggaaccaggtccaaggcctctggtgtaagggtctccccacctgagcatggggtgaggagtccatgctggggacagcacagcatcaggaagttggggctgtgggcagacctgtcctggctctgtctgtttcttggttcacagagggtgccttcttgctgtgtccttataagatggaagggaccaggcagctctctgaggcttcttttataagggcactaatcccattcataaggcccctggcctgacagccaggtccctgctctgtctcctgcctggagtcctgaggacttcccttgtgtccactctcagcctgattttcccacctccttgccaagcatgggcatcccctctgcccctgccctggccctgctgcagctgttacagagggaggagaccatgggatttgggtcataccttggtccaatttcaggtccaatcatttccaccagggatatttggaaagatatgtaacacctttcggggtaatggctacttcaagttcatatgtaccatgttttgttgatttgaggattaaatgaacatgtaggtgaatggcctgtcatgttactgggtacaggatatgggctcagcactggtcaccccttcccttccttttggttcagagacagagcctgtcccctagtccttaagcactgggggctgacctcacatacactgcagatcacccagagatacacaggccagcatccacattaggctgagcccagagggatggagtcacaatcacacaggggaaaaggctgaagaaaagggagggttgggccagatgtgggtggggtggctcacacctgtaatcccaccactttgggaggatgaggagcgagaattacttgaggccaggagtttcagaccagccctggcaacaaagtgagacccacttctctattaaaacaatttttttttaaaaaaatcagccatgcacttgtagtctcagctgcttgggaggctaaggcaggaggatcagctgaacccaagagttcaaagctgcagtgagctatgatcacacccaatgcactccagcctgggcaagagaaaagagagaaaaaagaaaacaagaaagagagcgagagaggaaaggagggagggagggaggaaggtaaagatagagagaaagatagagagagagaaagagagagagagagccagatagattgagagagagagagagttggctttggggcctgaagaaggcaggatacccattacaggacccaatcagagttcctccaccaaagtcacatgattgagcctttttaacaaccagaactcacgggacaatcactatggccacagatgtgcagcctgtgaaagatgagtggctgcaagtcacaccaccagccatgaacacaaagcctggtgggcctttatggctggaggcaagatgtgcctcagtggagtgggccacgtggacgcatctcccaagtcacacacaaggtggccagtgctgaatgggaacagacaatgagaagtctctgcagcaagcctaagctccagtgcaggtgtctcttccacttggaccttataatctggcacattcagtgaaatccagtatctgtggagagactgggggtgccacacggagcatctggcaagcagcagaagaatcaccgtgcagacctctaggacgtgggagcaagtctgcaccctcttctgcaggtgactctgcttcctctgagaaacagcttccgctcaccactgggccttggtggaaactaaatgcctacccataggacaccaggcaagcacccagcctgagcttcccaccatgacctgggtgccctgacccatgcagccaaagcagcaatcaatcaccagaggaaactgcctataagagcccaggctcagtcaggcccagaagggacaagcaagtgtcatgagcaggtggctcagatccctcaacacctgctcctcagactccatccagcctaaggcttcctgggctgttcctcaggaccaactgactgaggaagaaaacacatgagcttgattacagctgggtatgcacaatgtgctgctgatccctgaaggtgaccagctgcagcactactgcaccactcgagctgccctgaatgacacagggaaggttggcttgcccaggggctggagactgatgggggtatttcgctggcaacttggtctggattgagagatggcaaataacacagatgatggtgactcatgaggagttgctagaggtttggctggttggtcagggactcagaaggatcaatgatcagatttgaaaattaatgacaaggaagggtgggaagaggcatagggatgggcccctcattatggacactatgagcagacaccagcattgcatatgaatgctgaccacatggcacatgaacactctctgcagaagaggcctcgataatcaggtggacaaaatgacacattccatagatgtcagtcaacctcattccccagccatcccagtatttgcccagtgggcttgtggacagaggggacagtcatggtggcacacgtagaggctgtgcattacctcatgagcatggctgctatggcttggatgtggtttttcccctccaaaatgcatgttgaaatttagtccccgttgtggcaacgttgggaggtgggacttcatgggagatatttgggtcatgggagcagatccattgtgaatagattaatgcctttcctgggagtgagttattggtctcacaggaatggcttacttccctcgagagcaagttgttaaataagagagtctggcttccttagtttctctctcttgcttcctctccctccatatggtcactttgcctgctccccttccatcttctgccatcagctgaaaaagcctgaggtcctgaccagatgtagctgcccaaccttggaccttccagccaccagaatcataagccaaataaatggcttttatttataaattacccagccttggttattttgttataataacactaaatggcctaaggcagaaaatctccctcttcctaaggttgacctggctaccactgacaaaagtggccaatctgtcaagggcagagaccaacaccaagacccttatatatcattaatgtcgggggccagccagcctcctgctggcagattaattccattgatctcttctaccatggaaggggcacaaattctggatatggatttgccatccctgcttgtaatgcttcttccagcatcaccaaccctggactcctgagatccctggccaccatcgtgtcattccccacagtgctgtgtctaatcagggaactgattccactgcaaaggaaatgcagcatggaattaactgctcttactacatacccatgcccaggcacggccagactaaaagtggagtgacttactgaagactcagttgtggcacgacttgagagatggcaccctgaaatatggaggtcctatcttaagggtacagtctatgctttgactcaagaccatcaagtgacagtgttttaacggtgcctgggatatttttaaatcaggtatggtaagacatgcagacaaggaaatgactggtataaagaaaagatttgttatactcacagatctcaagaaaagggaacaaaccacgccacacagggccacacagagaagcagcagcattggtcaggaggcagaggggagggggagaaaacaggcaagaacctctgttgtggtttccactgggaaggaacaggggaggcaaggtaagcaggtttaggattggctagtttgaataattttggtgggctctggagcacaggaacaactagatacctacttgtctggtacctggtcttggagtgatgagggcaggtggatagcagcccagcctgtgagagcccaggaaagaaagtgcttcagggccgggcgcggtggctcacacctgtaatcccagcactttgggaggccaaggcgggtggatcacaaggtcaggagatcgagaccaccctgactaacatggtgaaaccctgtctctactaaaaatacaaaaaattagctgggcatgatggcgggtgcctgtagtcccagctactcaggaggctgagacaggagaatggcatgaacccaggaggcagagcttgcagtgagccaaggtcgtgccactgcactctagcctgggtgacagagcgagactctgtctcaaaaaaaaaaaaaaaaaagtgcttcagggtatgggttctggattggttggtttgcacaagaaaggctcactgtttgccatctctaagaattagctaaccctgcaaggggcagtgccccagggtcagcaaggccccagatgtcagatcatcagaaaacagaaaataaaagagcatggttaatacacacagtctccccaggagccacagtacatgggtctgagaatagatggatagaagtgagagtggcttcttccacaaataatcctcctaatacgctcaaataaggtttgcttgctatccgaacatttgagctctgctgctttgaagatcttagttcccaagaatataatgcctctcccaggggacaccacaatggctccattgagttggaactaacagtcagaaacgggggcaactttactggaaggactgattggtgctaacgaggggaaattgggctgctgtgtcacatagtgggggcaagaaggacttcacctagaaccccgagtactcatcatcttagtacttctgcctactcagacccttcaagaatgaaggtttagatcttcccaccagataaagatctgtaaccagctgaggttctagctgtggaacagggaaatatcaaatgggtagtggacaaaagaagtcacagatagcatctgtggctcataactagggtttaccaggtttagtaaacgaaaatacagacgtccagtgagatagtaacttcagataaacaacaaatagtattactaaaagtactatttgtatgtcctatgcaatattggggacatatttatgcttaaaaatgcattcactgtttggacatcctatattttatctggtaattctattcatgaccaagtaaaaaagcacatttttttactttgcttgtcatgtgtggtatatgtatgtatttggagttattaaccatttatcttttcttattatgagttgttagcagagtattcagtgaaattgtgactaaagatgaagataaactaatatagttagctgtggatgcagtggctcttgggagcctgcatctcgcttggaggagagggtgagaatttcgttcatataaaggataactgcttcttattagacggaaacagagttgttttttggttcctcagaagttcaaatgtgtgtagaaagataaatacggaagctaagtaggaaagcgggtgaactctgccagttatcagcggaatgttctagctgcaaattgcccctttctcgcaagctctaggaagccggctggtaaacagcgccctcctttgcccgccgctgcaatgttaggctttgccaaaagagagcacctgggggaagctgcgaggccaccgcggcgagaaggtgctttcctgtttccctgctgtcctttctttttattccgcacagaagccatatatatatatatatatatatatatatatatatatatatagtgtacatttatatattaggcttttaggccatatatatatgtgtgtgtatatatgtatatgtatcgctacatatatatactatatatacatatatactatatatactttctacacactataaatagatagtgtggcacatctatatattacacatttaggctctttatagatatgtaccaccacatatatagtgatacatttatatatatatatatatatcgactaaacagcatttaggctgtttccagctttttgctaccacaagtaatgcaggaattagcaaataagatcttccagataatacccagaggcaggactgctggatcaggaggaatgcacattttcagttttactgccctctaatgtggctgatgaatttacaccctactagcaatgtgtgggttctgtttctctaactctttaccacacttgatatcagcagacttttccatttgcaccacgcagctcttactacaaccctcctttacagctctcaactaacccaggcaggcagcatgcgtgggccagacaccagggcagtcctccactgcagttagatattgagtctccctcctgtgactgggcagacgaaaaggacttgttcactcttgttttctctaacacagcgcttcacacacagagttcttttccagttatgtgactaattcaataaactgcctgagccttagtttcccaatccttgtcattaaatggtcactgtgcccactggtgtgctgggaaaagtttaacaactaacagagtagcaagggcggtgggagtcctaatttgtagcatttgcccatttccatggtataaataatcccaccatggctgatttcaagctaccaaggtgccccactgaacacagagttgggaagagatgctcttaaatcatcagctctcctgagctggtgcaagccagttgcgggacaccactgggctttttgcaaccctgtttcttaattctcagttctgggcaggctgtagtcgcctccccgtgcttctgtacaagtagacagcgacatctggtggcaaagtcaagcaaatcccagaccatgtagagaagggcctagagtatgggaaaacaagaaacacccctcttctcccaccagcacccccacgaaaggttcctgtcctcttcctcaaccaaccctgggacccatcaactccagcaaaaactcaatgcctggggagttcctacatgggcagcctgcaggtctcccttcctgtggcagctggggtagagtggcatggctcctggtgttggaataagcagtgacctcgtacagcagtcattcccactgcctgcctgcagaccccttgccttacccctggttgagaattatcagaagcgtccctcaacccaaagcagtcaccacagcactcctagaacaagagttactcagctagtgtgaccagagcactggttcaccatgagcgcttcctcctggaatttggacaaccatctcagggcctttctttggtcaatttccttctgattctgtgtgtaagacttgtgtgcagaatctcagtggcctaaatatctcagcctatggtaggataggcggggaagtgagggtggcccctgcaatagcaaagccattacacttagcctttggccactaaaaccccctatggcagcaacaggctgctgaccaccgaacgttcacctccttttccatagtgtattccttttcttgagacagggtctccctgtatcacccaggctagagagcagcagtgcatccatagctccctgcaatctcagactcctgggctcaagtgatccggatcctaagcttgggtctccctatagtgagtcgtattaatttcgataagccacctcgaggcgaattagcccgcctaatgagcgggctttttttggccgtttcggccgaattctctagagatcttccatacctaccagttctccgcctgcagggggggggggggggggggggggggggggacatgaggttgccccgtattcagtgtcgctgatttgtattgtctgaagttgtttttacgttaagttgatgcagatcaattaatacgatacctgcgtcataattgattatttgacgtggtttgatggcctccacgcacgttgtgatatgtagatgataatcattatcactttacgggtcctttccggtgatccgacaggttacggggcggcgacctcgcgggttttcgctatttatgaaaattttccggtttaaggcgtttccgttcttcttcgtcataacttaatgtttttatttaaaataccctctgaaaagaaaggaaacgacaggtgctgaaagcgaggctttttggcctctgtcgtttcctttctctgtttttgtccgtggaatgaacaatggaagtcctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcaggacatgaggttgccccgtattcagtgtcgctgatttgtattgtctgaagttgtttttacgttaagttgatgcagatcaattaatacgatacctgcgtcataattgattatttgacgtggtttgatggcctccacgcacgttgtgatatgtagatgataatcattatcactttacgggtcctttccggtgatccgacaggttaccgggcggcgacctcgcgggttttcgctatttatgaaaattttccggtttaaggcgtttccgttcttcttcgtcataacttaatgtttttatttaaaataccctctgaaaagaaaggaaacgacaggtgctgaaagcgaggctttttggcctctgtcgtttcctttctctgtttttgtccgtggaatgaacaatggaagtcccccccccccccccccccccccccccctgcagcaatggcaacaacgttgcccggatcgatcggtcgcgcgaattgatccgaccaaagcggccatcgtgcctccccactcctgcagttcgggggcatggatgcgcggatagccgctgctggtttcctggatgccgacggatttgcactgccggtagaactccgcgaggtcgtccagcctcaggcagcagctgaaccaactcgcgaggggatcgagcccggggtgggcgaagaactccagcatgagatccccgcgctggaggatcatccagccggcgtcccggaaaacgattccgaagcccaacctttcatagaaggcggcggtggaatcgaaatctcgtgatggcaggttgggcgtcgcttggtcggtcatttcgaaccccagagtcccgctcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgcgcgtatcgatacgtaagtaatcttgagatcgggcgttcgatcgccccgggagatttttttgttttttatgtcttccattcacttcccagacttgcaagttgaaatatttctttcaagggaattgatcctctacgccggacgcatcgtggccggcatcaccggcgccacaggtgcggttgctggcgcctatatcgccgacatcaccgatggggaagatcgggctcgccacttcgggctcatgagcgcttgtttcggcgtgggtatggtggcaggccccgtggccgggggactgttgggcgccatctccttgcatgcaccattccttgcggcggcggtgctcaacggcctcaacctactactgggctgcttcctaatgcaggagtcgcataagggagagcgtcgatcgaccgatgcccttgagagccttcaacccagtcagctccttccggtgggcgcggggcatgactatcgtcgccgcacttatgactgtcttctttatcatgcaactcgtaggacaggtgccggcagcgctctgggtcattttcggcgaggaccgctttcgctggagcgcgacgatgatcggcctgtcgcttgcggtattcggaatcttgcacgccctcgctcaagccttcgtcactggtcccgccaccaaacgtttcggcgagaagcaggccattatcgccggcatggcggccgacgcgctgggctacgtcttgctggcgttcgcgacgcgaggctggatggccttccccattatgattcttctcgcttccggcggcatcgggatgcccgcgttgcaggccatgctgtccaggcaggtagatgacgaccatcagggacagcttcaaggatcgctcgcggctcttaccagcctaacttcgatcactggaccgctgatcgtcacggcgatttatgccgcctcggcgagcacatggaacgggttggcatggattgtaggcgccgccctataccttgtctgcctccccgcgttgcgtcgcggtgcatggagccgggccacctcgacctgaatggaagccggcggcacctcgctaacggattcaccactccaagaattggagccaatcaattcttgcggagaactgtgaatgcgcaaaccaacccttggcagaacatatccatcgcgtccgccatctccagcagccgcacgcggcgcatccccccccccctttcaattcaattcatcattttttttttattcttttttttgatttcggtttctttgaaatttttttgattcggtaatctccgaacagaaggaagaacgaaggaaggagcacagacttagattggtatatatacgcatatgtagtgttgaagaaacatgaaattgcccagtattcttaacccaactgcacagaacaaaaacctgcaggaaacgaagataaatccgcgtatcgatacgtaagtaatcttgagatcgggcgttcgatcgccccgggagatttttttgttttttatgtcttccattcacttcccagacttgcaagttgaaatatttctttcaagggaattgatcctctacgccggacgcatcgtggccggcatcaccggcgccacaggtgcggttgctggcgcctatatcgccgacatcaccgatggggaagatcgggctcgccacttcgggctcatgagcgcttgtttcggcgtgggtatggtggcaggccccgtggccgggggactgttgggcgccatctccttgcatgcaccattccttgcggcggcggtgctcaacggcctcaacctactactgggctgcttcctaatgcaggagtcgcataagggagagcgtcgatcgaccgatgcccttgagagccttcaacccagtcagctccttccggtgggcgcggggcatgactatcgtcgccgcacttatgactgtcttctttatcatgcaactcgtaggacaggtgccggcagcgctctgggtcattttcggcgaggaccgctttcgctggagcgcgacgatgatcggcctgtcgcttgcggtattcggaatcttgcacgccctcgctcaagccttcgtcactggtcccgccaccaaacgtttcggcgagaagcaggccattatcgccggcatggcggccgacgcgctgggctacgtcttgctggcgttcgcgacgcgaggctggatggccttccccattatgattcttctcgcttccggcggcatcgggatgcccgcgttgcaggccatgctgtccaggcaggtagatgacgaccatcagggacagcttcaaggatcgctcgcggctcttaccagcctaacttcgatcactggaccgctgatcgtcacggcgatttatgccgcctcggcgagcacatggaacgggttggcatggattgtaggcgccgccctataccttgtctgcctccccgcgttgcgtcgcggtgcatggagccgggccacctcgacctgaatggaagccggcggcacctcgctaacggattcaccactccaagaattggagccaatcaattcttgcggagaactgtgaatgcgcaaaccaacccttggcagaacatatccatcgcgtccgccatctccagcagccgcacgcggcgcatccccccccccctttcaattcaattcatcattttttttttattcttttttttgatttcggtttctttgaaatttttttgattcggtaatctccgaacagaaggaagaacgaaggaaggagcacagacttagattggtatatatacgcatatgtagtgttgaagaaacatgaaattgcccagtattcttaacccaactgcacagaacaaaaacctgcaggaaacgaagataaatccgcgtatcgatacgtaagtaatcttgagatcgggcgttcgatcgccccgggagatttttttgttttttatgtcttccattcacttcccagacttgcaagttgaaatatttctttcaagggaattgatcctctacgccggacgcatcgtggccggcatcaccggcgccacaggtgcggttgctggcgcctatatcgccgacatcaccgatggggaagatcgggctcgccacttcgggctcatgagcgcttgtttcggcgtgggtatggtggcaggccccgtggccgggggactgttgggcgccatctccttgcatgcaccattccttgcggcggcggtgctcaacggcctcaacctactactgggctgcttcctaatgcaggagtcgcataagggagagcgtcgatcgaccgatgcccttgagagccttcaacccagtcagctccttccggtgggcgcggggcatgactatcgtcgccgcacttatgactgtcttctttatcatgcaactcgtaggacaggtgccggcagcgctctgggtcattttcggcgaggaccgctttcgctggagcgcgacgatgatcggcctgtcgcttgcggtattcggaatcttgcacgccctcgctcaagccttcgtcactggtcccgccaccaaacgtttcggcgagaagcaggccattatcgccggcatggcggccgacgcgctgggctacgtcttgctggcgttcgcgacgcgaggctggatggccttccccattatgattcttctcgcttccggcggcatcgggatgcccgcgttgcaggccatgctgtccaggcaggtagatgacgaccatcagggacagcttcaaggatcgctcgcggctcttaccagcctaacttcgatcactggaccgctgatcgtcacggcgatttatgccgcctcggcgagcacatggaacgggttggcatggattgtaggcgccgccctataccttgtctgcctccccgcgttgcgtcgcggtgcatggagccgggccacctcgacctgaatggaagccggcggcacctcgctaacggattcaccactccaagaattggagccaatcaattcttgcggagaactgtgaatgcgcaaaccaacccttggcagaacatatccatcgcgtccgccatctccagcagccgcacgcggcgcatccccccccccctttcaattcaattcatcattttttttttattcttttttttgatttcggtttctttgaaatttttttgattcggtaatctccgaacagaaggaagaacgaaggaaggagcacagacttagattggtatatatacgcatatgtagtgttgaagaaacatgaaattgcccagtattcttaacccaactgcacagaacaaaaacctgcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgttgaagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagcttcacgctgccgcaagcactcagggcgcaagggctgctaaaggaagcggaacacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttcttgccgccaaggatctgatggcgcaggggatcaagatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccgggctcgatcccctcgcgagttggttcagctgctgcctgaggctggacgacctcgcggagttctaccggcagtgcaaatccgtcggcatccaggaaaccagcagcggctatccgcgcatccatgcccccgaactgcaggagtggggaggcacgatggccgctttggtcccggatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactcctccaaaaaagaagagaaaggtagaagaccccaaggactttccttcagaattgctaagttttttgagtcatgctgtgtttagtaatagaactcttgcttgctttgctatttacaccacaaaggaaaaagctgcactgctatacaagaaaattatggaaaaatattctgtaacctttataagtaggcataacagttataatcataacatactgttttttcttactccacacaggcatagagtgtctgctattaataactatgctcaaaaattgtgtacctttagctttttaatttgtaaaggggttaataaggaatatttgatgtatagtgccttgactagagatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggaagatcttatgtatgaaattcttaaaaaaggacacctgtaagcgttgatttctatgtatgaagtccacatttgatgtaatcataacaaagcctaaaaaataggtatatcattttataattatttgctgtacaagtatatcaataaacttatatattacttgttttctagataagcttcgtaaccgacagtttctaacttttgtgctttgacaagaacttcttcttcttgctttaataaaaactgttccattttcgttgtataacttgaatcataagcgccaagcagtctgacagccaacagcgcagcgttcgtactattattaatagcgacggtagctactggaacacctctaggcatttgcacaattgaatgtaaagaatctactccatctagacaagaaccttttacgggcacaccgatgacaggaagtggtgtcattgcagccaccatacctggcaagtgagcagccccaccagctccagcgataattgttttaattccacgcttgcttgcggaaatagcatatgctgacatcctatgtggagttctatgagcagagactattgtcacttcaaatggaacgccaaaatcttttaaaaccgcacatgcggcagacattaccggcaagtcagagtctgatcccatgatgattccaaccaatggtttgaccattgcttccaagtccaacttttgagcgacagagattttgattggaatatcagttctacctgtaatgtagttcagcctttgttcacattccgccatactggaggcaataatatttatgtgacctacttttctgttaggtctagactcttttccatataagtacactgaggaacctggagtcgccaatgctctttcgcaagtttctagctctttatcttttgtatgtttgtctccaagaacatttagcataatggcgttcgttgtaatggtggagaaagatgtgaaattctttggcattggcaaatccaatattgatctcaaatgagcttcaaattgagaagtgacgcaagcatcaatggtataatgtccagagttgtgaggccttggggactgtgtgccgaacatgctccttcactattttaacatgtggaattaattctaaatcctctttatatgatctgccgatagatagttctaagtcattgaggttcatcaacaattggattttctgtttactcgacttcaggtaaatgaaatgagatgatacttgcttatctcatagttaactctaagaggtgatacttatttactgtaaaactgtgacgataaaaccggaaggaagaataagaaaactcgaactgatctataatgcctattttctgtaaagagtttaagctatgaaagcctcggcattttggccgctcctaggtagtgctttttttccaaggacaaaacagtttctttttcttgagcaggttttatgtttcggtaatcataaacaataaataaattatttcatttatgtttaaaaataaaaaataaaaaagtattttaaatttttaaaaaagttgattataagcatgtgaccttttgcaagcaattaaattttgcaatttgtgattttaggcaaaagttacaatttctggctcgtgtaatatatgtatgctaaagtgaacttttacaaagtcgatatggacttagtcaaaagaaattttcttaaaaatatatagcactagccaatttagcacttctttatgagatatattatagactttattaagccagatttgtgtattatatgtatttacccggcgaatcatggacatacattctgaaataggtaatattctctatggtgagacagcatagataacctaggatacaagttaaaagctagtactgttttgcagtaatttttttcttttttataagaatgttaccacctaaataagttataaagtcaatagttaagtttgatatttgattgtaaaataccgtaatatatttgcatgatcaaaaggctcaatgttgactagccagcatgtcaaccactatattgatcaccgatatatggacttccacaccaactagtaatatgacaataaattcaagatattcttcatgagaatggcccagattctcatgtttgacagcttatcatcgcgataagctttaatgcggtagtttatcacagttaaattgctaacgcagtcaggcaccgtgtatgaaatctaacaatgcgctcatcgtcatcctcggcaccgtcaccctggatgctgtaggcataggcttggttatgccggtactgccgggcctcttgcgggatatcgtccattccgacagcatcgccagtcactatggcgtgctgctagcgctatatgcgttgatgcaatttctatgcgcacccgttctcggagcactgtccgaccgctttggccgccgcccagtcctgctcgcttcgctacttggagccactatcgactacgcgatcatggcgaccacacccgtcctgtggatcaattccctttagtataaatttcactctgaaccatcttggaaggaccggtaattatttcaaatctctttttcaattgtatatgtgttatgttatgtagtatactctttcttcaacaattaaatactctcggtagccaagttggtttaaggcgcaagactttaatttatcactacctacgcggccgcggactatggcgcgccatcgttgcgatcgctatacacgcgtatcgataagcttgaagttcctattctctagaaagtataggaacttcagcttgatatcgaattcctgcagcccctttacctctatatcgtgttcgtgcgtatttcttcctctataatatgaaaagaaaggcagtagtcttgattttctattcttccaaatattacaagaatacccagaaccacaagaagcagaagaaactaactgctttatatacttaatttcccgccacaagctcatcgcccagaagtttttttcagtttttcacctgacaatctggcagctcgctgaaaaattttcacctggggttgcctgctacgtaaagtgatcacgtttatgaatggcacattatatagtggcccagacggtctgatggtagttcatgtagttaagaataaatactctgtttgtgtgatttctatgtgtacgttatatatataaatattgttgatggtggtagctgtgggttgtgttcgggggatctttattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatggcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttacccatagatccactagatgttttatatttgttgtaaaaagtagataattacttccttgatgatctgtaaaaaagagaaaaagaaagcatctaagaacttgaaaaactacgaattagaaaagaccaaatatgtatttcttgcattgaccaatttatgcaagtttatatatatgtaaatgtaagtttcacgaggttctactaaactaaaccacccccttggttagaagaaaagagtgtgtgagaacaggctgttgttgtcacacgattcggacaattctgtttgaaagagagagagtaacagtacgatcgaacgaactttgctctggagatcacagtgggcatcatagcatgtggtactaaaccctttcccgccattccagaaccttcgattgcttgttacaaaacctgtgagccgtcgctaggaccttgttgtgtgacgaaattggaagctgcaatcaataggaagacaggaagtcgagcgtgtctgggttttttcagttttgttctttttgcaaacaaatcacgagcgacggtaatttctttctcgataagaggccacgtgctt

SEQ ID NO: 8 - DNA, 172334 bp, Artificial Sequence
  BAC6
atcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaataaagatcccccgaacacaacccacagctaccaccatcaacaatatttatatatataacgtacacatagaaatcacacaaacagagtatttattcttaactacatgaactaccatcagaccgtctgggccactatataatgtgccattcataaacgtgatcactttacgtagcaggcaaccccaggtgaaaatttttcagcgagctgccagattgtcaggtgaaaaactgaaaaaaacttctgggcgatgagcttgtggcgggaaattaagtatataaagcagttagtttcttctgcttcttgtggttctgggtattcttgtaatatttggaagaatagaaaatcaagactactgcctttcttttcatattatagaggaagaaatacgcacgaacacgatatagaggtaaagggggagtctggcaacccttcttgccactcatgtcccagctctcaccatgtgacatagcctgttccccctttgccttccatcatgattgtaaagtagatcctggtgccatgcttctcacacagccttcagaactgtaagccaaatgtgcctcttttctttgtaaatcacttggcctcaggtattaatttataggaatgcaaaagagactaacacaccgtccaaagcattacacagattcaactctatttttatcaaatgaccaatataattgattacatatttagaaaaaaaatactaaaattcctatagaatcaaaaaagagtctgaatagcaaaagcaatcctaagcaaaaagaccgaagctggaagcaccacattctctgacctcaaattatactacatgaatataataagaaagacagcatgctactagtagaaaaaaatagcccagaaagaaagccaaatatctaaaaccaactgttgtttgacaaaactgacaaaaatatacactggagaaacaaccctctattcaataagtggtgccgggaaaattaggtggcttatgtggaagaatagaactagacttccatatcaccgtagacacaaattaactgaatatggattcagtgtttaaatttataaactaaaactataaaaatacttgaataaaatctaaaaagagtcctctggacattggtctaagcaaacaatatatgactaagacttcaaaagcaaatgcaataaaaacagaagtagacaaacaggatttagttgaactaaaggtcttctgcacagcaaaagaaataaccaacatggtgaccagacaatctgcaaatggaaaaaatatctggaatctattcatcttgcaaagggctaatatatagaatctacaagtaactcaaataagtcaactaaaaattacaaataacttcattaaagaatagacataaacagacatttatcaaaagaatacacagaagtggccaacacaaataagaaaatatactcagcatcaccaatcatctgataaatgtaaattagaaacaacatgatacggcatcttccaccagtcagaatggctgttattacaaataaaaacagcaggtgtttgcagacaaacataggaaaaataatgatttatatatgcttggtgagaatgtaaattagtacaacctccatgaaaaacaacatagaaatttctcaaagaactaaaattagaattaccatttcttccagtaagctgtcccagtaggcatgttcctcccaaacttttatatcagagaatgttgcctgcactcatatgtttatttcaacaccattttcaatagaaaagtcaaataatctaagtgtcaatcagtggatgattagataaaatatgatatatgtaaatcatggaatactatgcagccagtatggtatgaattcagtgtgaccagcccctggacaagggcttgagtggatgggatggatcatcacctacactgggaacccaacatataccaacggcttcacaggacggtttctattctccatggacacctctgtcagcatggcgtatctgcagatcagcagcctaaaggctgaggacacggccgtgtatgactgtatgagagacacagtgtggaaacccacatcccgagggagtcagaaaccccgagggaggaggcagctgtgctgagctgaggcagtggtgcagcagtttctttaacttccatatgatctcattttgcatcatcttctacttttatattagctaagaacttggggtagacaggtgctcctaagagatccttaacttgcccattttgatgggttttccagaagacgtgagaagccactttgttagcaaagcatcccaaatccatgccctgttctagatacatgtgagcccatttcctggtctttgcttaactgacaagctctcatcagtgcacctgggctaatttcacatcaggtagaggaacgcgttataaaggaaagctaatgttgtaatagcaattcctgcttaaaaaccttcagcttcattgtttttgtgtaatccatcagcaaattatgttagttcaaggttctcaatgggagtttctaataaatagaaaggatgtataaagcttcccctaattaaaatgaaacaattgtgaacacaacctcggtattcagccatgtctccacccttcacacccttcgccacaaaggaattttcacctctcctggaagctgggttcattttcaaattagttatttttttcaatgtaatatctcaagattatcgtatatgactattttagcagaaagtgaattatgggaacttgaactaaacaactgaaaacaaattcacaactaattaaacaagatgccagaatgtgattggctccaggctttgtaattcagcagttcatgtacccagactggaaatttacatgtcttcttgttaccttcacagcacagtcaactcccattatgtaagaaatggtgactgcattcccaagggttatgcatagatatgaaaatagactgggtaaggtgaggagttgattgtttaaattcccctctgaagaagcagcatcaactcaacaaaccacctctcttcactctgtgactagagctatgtcacaggccacatggacctaaatccttgatggatataacatgactacataaattgggctgatcatttttatgctataaaattaatagatgacactgcactccagcctgcacaaccaagcaagtcttcatctgtaaaatctaaaaaagaaaaattaataggtactgacttcgaaatttttgataataatattttcaccacccaaatttaatcacacccacatgttacctgcatcttcactgaaaagttcccagtcacgatgagttccttcaatgctccatgtgttcaaatctggacatcaagagagtccagagaataaaacacaatgacggcagtgaaactgatatatattcagcacctcttaactcaggaggactccatacaccctggcacacagctgcttttctaaatggctcacaatgactccagctcactcacagagctcagacagaaacctcccttcagggtgggagctgggtggcagggggcactcagtacccgcagaggtgaaaatgagctttcagatggaacttccctgtcacctcaacatggaatttattgtttcatttcattacctctctttccataatggttcatttcttttggcctgttcattactgatatttttcagagcaatctcacttgaatctttactcttttgcattttgtctccttgacaatgttgggaagttttacctccagcatcataacatgatctagtgatctgacacattgtgcaaacaatacctacaaattcagaacctctttgtttttctttccacaaaatataattctttctgttctgtgtatgagcatgtcttagcaaccctgtacacacccacatagatgtctacaagcctatgaattgttctctgtaaataaaaatttatctcaaattccttcaatgttcataattctgagagtgaggaaggtccttctcaatctgttcaaacaaaatgcccagagaccatccagtaggtaaggagttcacctggctctggtgtggggtctgtctctttccctctgttgtcccacaggtcagcccagttgttcacgtcctaacaagaaagcccaggtttgtcctgattttaaaacacatcaaacttctgatgactctcctgttacccacatccatggagatagattatttattatataattcagcaaactaatgtcaaatgcccaagttgcaataccgcacatcctagggtatgttcatgcaattcaatggaggagaaaatctttcagagacagatggatctgaaatgataaatatgtgggtaaggactctgggcttgagtatcattgtccagccatgtttcacaagtgtgtcctgtcagggaaggatcagagttccttgtgctctcagagggaaggggtcacagagttcctctctggttcccaggaaaggtaatcgcactaatcttcatgatcttcatgagactatcctccagtgctgacctgttacggagtttttgtctgaagttctcactgcaatccccaatctacatattttcaatcagaagtgtttagaggccaggacacatcttcaaggtcacacattgagaagtatggagatatgtcccactaccttctcctacgatctcagacagaatcccaaatttcaaaaggacacagaaggacagctctcaggtgcttttaaaaaatgacccacttccagggacagtgagcttccctgtaaccatggtggatgttctgaactacaataaacattggatggatccagtattgtttgaagtcactgtcattattacattcagctgttgtttcaatgtgtctgaaagggtaaatgactatttagatggcctgggtgtgtggttggttttatatgaatctttaagggttgaacagtactgaccctattccaaaatctgtccttgatccaggatcacactcatctctcagaccagctccttcagcacatctctttacctggaagaagaggactctgggcttggagaggggaggccccaagaagagaactgagttctcaaagggcacagccagcattctcctcccagggtgagctcaaaagactggcgcctctctcatcccttttcactgctccgtacaaacgcaccacccccatgcaaatcctcacttaggcgcccacaggaagccaccacacatttccttaaattcaggtccaactcataagggaaatgctttctgagagtcatggatctcatgtgcaagaaaatgaagcacctgtggttcttcctcctgctggtggcggctcccagatgtgagtgtttctaggatgcagacatggagatatgggaggctgcctctgatcccagggctcactgtgggtttttctgttcacaggggtcctgtcccagctgcagctgcaggagtcgggcccaggactggtgaagccttcggagaccctgtccctcacctgcactgtctctggtggctccatcagcagtagtagttactactggggctggatccgccagcccccagggaaggggctggagtggattgggagtatctattatagtgggagcacctactacaacccgtccctcaagagtcgagtcaccatatccgtagacacgtccaagaaccagttctccctgaagctgagctctgtgaccgccgcagacacggctgtgtattactgtgcgagacacacagtgaggggaggtgagtgtgagcccagacaaaaacctccctgcagggaggctgagggggcgggcgcaggtgcagctcagggccagcagggggcgtgcggagctcacggaatacaaggccgggtcaggagcaggtgcagggtgagcggggcttgctcatcttctcagtcgtctccctcctcgccagcacctcagctttccgtagaggtcctctttctttattgtgtgtggttctacttcctcacatccttgtgccaggaaagaaaggagtaaggcaaattttcctgttacaattgaagtttcaccaattactaagaactttcctgcaagtacctgcacagcccattataccttatttatatatgtatatattctaatgcttctcaccatctcttgatttgtgtcatcaatttaattgtgccctttttgaaattcatatgctgaaactttaaatccaatggatctatatcggaattttaatggtataattaatgttaaatgtggtcataaatgagaccctaatgcaatagagctgttgtctttataagaagaggaagagacaccagatacctctcacttctcacatgcactcagagaagaggccacgtggagacatagtgcactagaaggtgggcctctgcaagccaggaagaagccgcaccaagaaccaaccctgccagcaccttgatcttctacattcagactgcagaattgtaagaaaatcaatatttgttgtttaagccacccactccttttgtcttcttacgaagacccagacaggctaataccacacaactctgttagctccgtctcctggagggagaagcagccccctgaagctgggcacatcgctcagattttcacatgaattaggcaaaaacagtagctctcatataaaaactgtcacgtccctgttgggacaaggtcttttaaacaagccctggggctttgtcacaaatgttgcattttatcctttattaggacttaactaattgacaatgagtaccagctggatggaaactgaccactgaccatcttctgctgtctccttattatatcacagaaaaccacagcaacattactctatgtcttcaactttctaaatttgtactgaatctattgctaaatgaggagctacatggggtctgagttttgttaccttcttcccagtcttccccaattaccaagcatagaagatactttcagtgaaatttagctgtcaatgcccccgacaccacatcatgttttaaggtccaaggactttctttggggggctattgaaaaacacttttgaatggaaaatcctaaagcatacaacagctgaaagaatggcccctgtgcacatgaaggctgaagggatggatgatagggtacgttcctccaaggtgttcctgggcatgtgatggttggatacctcatgcatacgaaaacaaggactgaactgagatagaaacaagggccatatcctataggaaaacaagaaaaaaacgggcatccctgaagagagttaattagacttggtgggtttaagatgaatttttttccaaagttttttaatgttctaagctaaatatgaatattttcaataaactgcaaattaaaaggagaatgaatttagaagtttagacagaaaaaagccatgagggtgtagaaagcaaatccacacaaaactgtcacatggcagaggccagaatggagctgatgcagctacatcattattctgcagacctagttgagaccctttggtgtttaaggcaggtccagcagtgaagaactcctttattttttgtctggcaaagttctaatctaatcttcatttctgaaaaggatttacatggtaaagattcgtcttggcaggttttatttatttttagtcccccccaacccacgtcaatttgagtaaagtcatgtgttacgtaacaatgctgcagtcaacagtagaccacatatatgtttgtggccacataatgttgtaataccatattttcactaaactttttccatgttttgatgtgtttagatagagagatacttaccatggtgtttccatttcctgcagtgttcagtgcagtaacacgctgtacaggttagttgtctgggaaccctgcgctaatccacataccctgtgtgtagtagggtattccttgtaggtttgtgaaaattcacccttgatgcttgcacaatgatgaaattgcccagggacacatttctcaaaaagaacctctgtcaataaaccacacaccattgaatacaatccctgtgccttctgaactgaaaaccttctgctgagaaatctgttccttttctttctgttttctaaagcctcttttatttccagcaatgtggttttaaactgtgtcacattttttgtcattgggtttatcttacgtaaaatttatagagcttcttcattgtggatgaatatttgcttcccttctccaaatttggaaatattttttgctattattttgaataatttatctcttctctctctctctctctctctctctctctctctctccctctctctctctctctctctctctctctctctctctctctctctctctccccctctctcccttcactaccccttttgtcttgtctttgtataactcctcaaatgcgtagttgagtgtttagtgtctttcctggcccataagtcttgaactcttttttatttctttcacttaaatttttcttctctgtctctactatttcaaatgatctttctttgagtttactgtttcttctattacttgatctagtttggtctaaaatcttgttaaaatttttggctgtattcttcaggatcaatatttttgtttagtcatcttttaaatgttttatctttattaaaattctcacattgttcttgcatgctgccactagctcattgaacatgtttctaacatttactttaaagtttctgtcaggtaatccatgttcttccttttcattgatgtcagtttatggaccttttggttgttcttctgtttggaccatgttcccctgcttcttcattttccttgactgtctttgttgttatctgttctttataacaaaagccatcatatacttcttcaaagactaggctcatagagatcaccctcaccaatcagcccagacagtaattgtgggtctctcaaaacttgataggattcaaacttctgtctgttcttagtggcccctaggttttagaggatgatagattgtgccaggactcacaggtaagggaggtagaaactatgtactcatgaccatggggtctgtgctgatctgagcttctcttgtcatcactctcaatattcaacttccccgtggatcaggctcagctgtggctgctccacgtggggctgttctcagtctgttgcctctgtgtgtgcagaagtcctctgtgaagttaactagtggagtcagacaggaaaatactacagaccaagaattctcagactgttctgcaaagcccctggattcactgaaaaaagaacaagtttggtccagcaggattcatggcaagtgttggtgagggagataacagtaattcaagtggaagttctcaatgggactcgccttcagtacaaagaagattaacagtcctcagagacactgttcagaagattctcttttaagataataaaactgagagcccaagacaagtctgtgtattactgtgagggacacagtgtggggacatctatgtgagcacagacacaaaagtccctgcagggagacaggaggggactgcatgttagttgctgctcagaaccaccagggggcattcaggacaccagtaggcactcagaaccaccaaggagagctcagaatcaccagggggcactcaggaaactggcaggtgctcagaaccaccaaggggcgctcaagatcccagcgggagctcataaccaccagggggcgctcaggacactagggggctcagaaccactagggggcgcccaggaccaccaggtctctcaagacaggagggcgcactcaggacactagggggcgctcagaaccatcagggggcaatcaggacaccagagggacttcagaaccaccagggggcgctgagaaccaccagggggtgctcaggacatgaccggccctcaggaccaccaggggatgttcagaacaccaggaagcactcaggacaccagagagcgatcagaacaccagggggcactcagatcctccagggggcactcaggacaacagggagctctcaggacaccagggtgagctcagtaaaccagtgttcgctcagaaccaccagggagcactgaggacaccaccgctcccttaggaggcagctccacatcaggtccctggatccgggcagggagggcggttccttttggatcttgccactaaccttttgggagttttcctgcttcctttgtggtttcaagaatcatttgcagattcttctcatgtacaaagctctgctttcttggattatgtaatgtttttggctttggatgctaccagaattacgttgtactgtgagaggattcattcgtggtgtgtgcaatagtgaatgaaagctccaatgttaggggtggctttgaaagctacgttaggggtggctgagggcagttagcagaaaatgatcatcactatagaaggctactcatttctttgcacatttgcataaacaattgtagtttatgccctaaaaactgcatgttttcttggccctttttcttaaatggctccactctaagtccagtaatctaattaagctgtgtttcaaagaccaccaatcaagttaattctgtttaatgcaacactttgtaaagaaaatgtacatctgttttttagagtcagctttaaattttacattactttacaaatattgatttgtcaaatttagtctcataactatcttcagtaatttaaaatcttagtcatgtcatgttaaattaagtaatcctaggtttctcacttgaattagggttactaagaattagaatagtaaaagagtataattagcttttggtgaggtttataaagaaagatgaggatttttttttttttttgcttaaaaatattctgttttccagtttacagggcttttcaactggttttaagataaccactgtttacatctaaacttttttttgtaaatgactgctgagtttctatacatattccatagctagagtttcaaagtaaaagctctagtatctttgtattagtgtgtgtatgcgtagatgtgttaatatgtgcatgtatatatatgtgtgtgtgtgtgtgtgtgtgtgtgtgtgtgtgtgtgttgtggctactaggtacaaaattggctttgaaataaatattttcaaattaagtaaatgagcccaatgcatttgaagtacatgtgacttaaataaatatttaataaataagttggctttaaaattattggtaaaaacaaattagagatattttaacaattatcagcataccttatagtttatattaattcatcaagtgattttatatttaaaatcacagctagatattatatggtgtcaaaattttttatgatgattataaaattattaacctcgttggccatatgcggtggctcacacctgtaatcccagctctttggaaggctgaggtgggtggatcacgaggtgaggagattgagaccatcctggctaacatggtgaaaccccatctctactaaaaatacaaaaagaaaaaaaaaattagctgggcatgctggcaggcgcctgtaatcccagctactctggaggctgaggcaggagaatgcttgaaccccagaggtggagcttgcagtgagctgagatcgcaccactgtactgcagcctggatgacagagcgagactccgtctcaaaaaaaaaaattataaacctcattaaaaccagaatgatctttgtaattttttgacaaatatgatgtttaatattgttgttttaataaaaaacaggtaaatagttattagaaaaacaattatttgcttaattataaggtttttactcaggcaagcacctgaaattcatgggttataacatggttaacagagaaaaaactttaaaggatgaattacaattttcataagtaatctagataagctacttaaataaaatagggaaatgtaatcaaataaaccttttaaataaacttgttctacaatttaaaaatctaaagtttaattaaataatagatattgactaaatgtttaggtcattactaattgttttaaaaaatatataagaaaatatttttcttaaaaaattattcttagaaaaataatgtaattcaaagttatttatataacatcataaaaagtaagagagttttaaagaaatttattgacatagagaagtacttttggtaagaaaggttaaaataaaaaaattttatatgagaaataatcttgcatggtaattttttatcctaaaataaaatgactaagaaagaatgacgtttagaataaaacaagatgttcaactatgccataaatggtttgtgtaagtgaaaataagatttataaaaagttaatttattaaaaaaccttcatattatcaagttgactataattgaaagggaagtatttataatagtctttatagagatctggcttttatataaaatatagtaatacactgaagactggttagaatgacaaaattgtcttaaagtgttgatttactaaataaaattataagatattttaattttttaacccccaaatttaacttttattgcatcttgccattttgattttttccctttgagaagacttgagaggctctccattttttcatcacgtcctttaacattttttttcttacagcgattagcttcttactgacttaacttctaactgttgttagcttttaactgctattattgtctgatgctaaaaacattttatctttaagttctaaataaaatgttttctttcaatataacattctacactcttggcttatctttaaatgtctacatttttctatgaaaccaaagtcttcacgtgtaatctgagtcacattcttggtatgtctaattaattcaaatgcttttttcattagagttgacctgcaggttatctacatgcattttccaatagggaaaagcaatcacactgtaaaaggttttgctttgctatttggtaactggcataaaacaaattttatattttattgaaataattcctatgttactgttattaaggtttccaacttactgagattttaagaaaatataaattaatgttattacattcatgtagctatctacattacttttaaaggccttgtgctgccacattactgacctttgactcctaggtctaaaaaggacacacagcattttgggagactaaggcaggcagatcacctgaggtcaggagtttgagaccagcctggccaacatggcgaaaccctgtctttataagaaatacaaaaattacccaggcatggtggtggatgcctgtaatcccagctacttggaagcctgaggcagggagaattgcttgaacctgggagacagagattgcagtgagccaagattgtgccactgaactccagcctgggtgatagagcaatattccatctcagaaaaaatatataaataagagaaaaaggacactaagtcctgctaaatcttaaacactgacagtaattaaagccccatctacagacctggaagaaaatgacaataaaaattcatcatactcttaagacataaggccagaaattgaaactactcaacaactccaggcccagggactattacagaagtggatttgtaagattgtaaaagctaattttgagatataatattacttgagagtttctttataagttaagcattaatattaaatgcacactaatggaagtctagcatctgggcccctgtgacagattgacaagggtttcttgaagaagtaatccactctttagcttaaaaaattattaaaatttataaaagacctatgaaaattatattttatggtaaaagtagttataatttaatagacttatttctcagaattgagagatagttttaatttttctcatgatgttcttataaggggttattgtttagaaaattaattctttcaaaaataaaagtttttgcttttttaagaaatcactgagttttcacttggctaaataaataacttactttacaataatctgtaattccattttgtaatatcaagtgttctaaataaacctttgatatttgacctccttcacaaaataaaagtctaaattcagtcatttgacctcattattcttttttgatatttgatctcctgaagccaaaaagaaacatatttagcttctttggtacaattaaattatactggaagcaatgtcaaatttgaaatggtgtttaactttggactatatttatataaatgtggactatataattggagtatattcatataaattaaagagtacatgttctaaaatggtatgaggttcaattgactttgatatgtcagtatattttgtcagtagtacttatgattattatataaaatttttgttcatcacagaaataaccaaactttctcctcaattctgtctttaaccgtggctattctaaaacttcagccatccacaattgttttcctttgattctttatcaggtggcttataataatctatagaattttgaggggtactcttaaatacacaattgtgacaattttataaattgtgccatttatatacagagaaaaacttccaagactctcatggagacctgatgcatttatgatggttgttaatataatgtcaaacaggacaggacttaattgcatgaactgaactaacaggagcctgaaataaattttatggcttattctttaaagcatttgctaattacttacattttgtttttcagaatcaaaaaaaaaattctcttaagctattcattgtttttaacaattgagtatagtatattctagtgagaaaattcaaaaacacaatttcttcttctctacataatttctccaaaatttggaaactgtgagtattgttatatcaaaatattaattcacataggttcaatataaatctgctttcttccgtaacagggcacaattggagacaatgatcattttaccaagactttaacttgaatgacatattttcatatttactttataaaatgaatttaagctggatagctgataaaagccccttgggaaaactggcatgtaacctgttttgttcagggccctgagctgtagtaagtcaataattttactttctgacagacccaggaatcccaagttgtcttggaaaattgaaaaaagaagaagtaacccaattcatatagctgtctgaaggcacagatgaaacaatgtctgggcttgatgcttttaaagattctacccttagatttcttataaaaaatttccagcaaggtcaatttatgaattaaatagcctatgtacaaaaaatagaaaaaaagagagctaatatgttaaattactatttttgcctcatcttatacaaaaaaattaagcctaaaacttatattacaaataaatttgccctactatgattgtgtctctaataactttggggaattatagagagaaatactgtttcaaaataaacaacagtgcatctgttattagattctaaccttgtccacttgtttttcaatttatattattttctacaatttatattagtttctacaatttatattagtttctataaaaatttatatttgcagaagcctccaaaatatttttcctgatttaaaattaccagaagttaaactgtgctttcttatagctagacatcttatactctaaagaaaataaaatcaatgacatgatttggctctgtgtccccaccccaatctcatcttggattgtaataattcccacatgtcaagtggaaaaaggtgggaataattgaatcatggaggctgttttctccatgctgttctcctgttattctcacaagatctgatggttgtataaggggcctccctcttcccttggcacttctctcttgcagccatgtgaagaagcacgtgtttgctaccccttccatcatgattgtaaatttcttgtggctttctcagccacgcagaactgtaagacaattaaaccttttttctttataatttacccagcctcaggtatgtccttatagcagcatgaaaacggacaaatgtaagcaacttaattatatacaaaaactcttttatacctgcctactgtgaaaggaaaataagtcttgagaccgcaaaatcaccaagctaaatggaagagtcaaactggtgttacaggagatagaaagaaattattttggtagatagttaggatgacagaatttctgccgaaaacatttcttctaacaaaaatcagcttggcaattacttattttctattcacacagagttcaaagaaatcacttctaacaaaaagcagcctgaaagatcaggctgtaaaacatataagcaactctgccacagagagggtgtttctgggtgtaatcaccaaacttcacatacatacactgggccctagtaaaaacagtgggccttaatgagcacattcctttccttttctgggggcactataacatcagaaagctggaaacttgcacaagtttaggatgcctgcacttgcaaggaggtacctgggacctagcatggaaaatcctcttcccctttttagcactctgggagtggagccccagccttgggattcccaggtgtttcccttcagtgatcaggactgaacacacacaactcatcatgcagtttgtgctgagctgggttttccttgttggtattttaaaaggtgattcatggagaactacagatgttgagtgtgagtggacatgagtgagcaaaacagtgggtttgtgtggcagtttctgaccttggtgtctctgtgtttgcaggtgtccagtgtgaggtgcagctggtggagtctgggggaggcttggtacagcctagggggtccctgagactctcctgtgcagcctctggattcaccgtcagtagcaatgagatgagctggatccgccaggctccagggaaggggctggagtgggtctcatccattagtggtggtagcacatactacgcagactccaggaagggcagattcaccatctccagagacaattccaagaacacgctgtatcttcaaatgaacaacctgagagctgagggcacggccgtgtattactgtgccagatatacacagaggggaagtcattgtgcgcccagacacaaacctccctgcaggaacgctggggggaaatcagcggcagggggcgctcaggagccactgatcagagtcagtcccggaggcaggtgcagatggaggctgatttcctgtcaggatgtgggacttcatcttcttccaacagtttctctaatgaacctccctaattttagaattctgtggttcctaatgtcatctctacatattttcaaaagatcattttaatatgaggacataacctctcatgtaccaaatgcacattgatgcttacaaagatgaaaagttctcaaccattgtcaccaggatcgcagtcctgaggaagctcacgggtgtctgatgagtctcctccattcaggcccaggacagaaacctcagggagactcctggactagaacggcagggattctgatcacagccaatagagagcctgggccagggtcagtgtcctgtagaagctcacagggttcacatctgacccttctcctgaccctaaagccaatccgcatcagcactgatctggtgctccttttgctcccaatacatgttctttctttggagtgtttgttctcccttttttatttgcttttctttcttcctgaaaaagaaacacatggtctctatgctctacactccagggctcaaggcattttcttagaactcaggcaaggctcaggcttggctactccagcccacgtgggagaggctgatgggatttccttctctccccatattctcagggccctcctctgtgttgtgtgtagactcatctgggaatgcaattggccgttaatagtgaaggggataaactcatttgatcaaaatgggatgtggatgtggaattaaccctgttctatgcacactgtcagagtcatcttcttcagaagtagtgttagaaagagcttgtgaactttatcagaatcaaaatggatccacttgtgttaaaaccctaatgaatgaagctggggaaggccatgaaggagggttctaacacacatattcctgataagaagaactatcataaatagaccctgcacagccacaaccttttacacagaggccaccacagccttaaaagctttatttctccaagtaaatctgccccgcaactgcctattcaaccttacaccgctatctcaaaatagctgctgtcaccctcctcatttttccttaattctcttttttattattttttaaattatactttaagttctagggtacatgtgcacaaagtgcaggtttgttacatatgtatacatgtgccatgttggtttgctgcccccattaactcatcatttacattaggtatttctcctaatgctgtccatcccccttcccccaaccccactacaggccccggtgtgtgatgtttcccaccctgtgtccacatgttctccttaattctttatcttccttttcctacctgaatgtacccatacatattttaattgaaacgcacatcctagaaaaaatattattatactttagagtctctgtctgttattcaggttgacatgacaagctacagacggacatgccacttttctgtgagacatagaggatgacagtttttggagatgtctaggaatatccaatgtccataagatcagccatcaataagtgcagactggaggtcccagagagaggcgaagctgctgaatcatcgtggaatttcattttctccagttctgctctgatggaatcaggcccacccattttatcaatgacaatctacctaacctagagtcagctgatgacagtattaatatcatctattaagtaaagtcataactatatatatagtgagagagggagagagagagagacggagtctcgctctgtcacccagggtggagtgcaatgtcgtgatcttggctcactgcaacctctgtctccggagttcgagcagttctcctgtctcagcctcctcccagtatctgggaatacaggcacacaccaccatgtccggccaatttttgtatttttagtagagatggtgtttcaccacattggtcaggctggtctcaaactactgacctcaggtgacccacctgccttagcctcccaaagtgctgggattacaggggcaggccaccaagtccagctaatttttgtatttttagtagagaccaggtttcacgatattggtcaggctggtctcaaactcctgatctcagcctcccaaagtgctgggattaaagatgtgagctactgtgcccggccaacaccacctatattaatgttggattgaataactacaaagtctaccctaaccaagtgtaccatcaaacttaccattacccagaggaaagaatctttaacatgagatctatattcttaaatgttttaaggtgtaaaactgaccacagtacaatcacccaattatgattttgctaatgagttgtagaaactgcatgtatattttggatattaacactttttcagatgcacaccttataattatattctctcattctgtaggttgcaattttttccacactttgcggcatctttttgttgtgatgtagttctgcttgttcaattctgcttttattatctgtgactttaatttgaaatatagaaaatcatccttttttatatactttaaattttagagtacatgtgcacaacatgcaggtttgttacatatgtatacatgtgccatgttggtgtgctgcacccagtaacttgtcatttaacactaggtatatctcctaatgctatccctctcccctccccccaacccacaacaggccccggtgtgtgatgttccacttactgtgtccatgtgttctcattgttcaattcccacctatgagtgagaacatgcggtgtttggttttttgtccttgtgatagacttctgagaatgatgatttccagcttcatccatgtccctacaaagggcatgatctcatcattttttatggctgcatagtattccatggtgtatatgtgccacattttcctaatccagtctatcattgttggacatttgggttggttccaagtctttgctattgtgaatagtgccgcaataaacatacgtgtgcatgtgtctttacagcagcatgatttataatcctttgggtatatacccagtaatgggatggctgggtcaaatggtatttctagttctagatccctgaggaatcgccacactgccttccacaatagttgaactagtttacagtcccaccaacagtgtaaaactgttcctatttctccacatcctctccagcacctgttgtttcctgactttttaatgattgccattctaactggtgtgagatggtatctcattgttgttttgatttgcatttctctgatgaccagtgatgatgagcattttttcacgtgtcttttggctgcataaatgtcttcttttgagaagtgcctgttcatatccttcgcccactttttgatggggttgtttgcttttttcttgtaaatttgtttgagttcattgtagattctggacattagccctttgtcagatgagtagattgcaaaaattttgtcctattctgtaggttgcctgttcactctgatggtagtttcttttgctgtgcagaagctctttggttcaacatactcaaatcaataaacaaaatccagcatataaacagaaccaatgacaaaaatcatatgattatctcaatagatgcagaaaaggcctttgacaaaattcaacaaccttcatgctaaaaactctcaaaaaattaggtattgatgggacgtatcttaaaataataagagctatctatgacaaacccacagccaatatcatactgaatggacaaaaactggaagcattccctttgaaaactggcacaagaaagggttgccctctctcaccactcctattcaacatagtgttggaagttctggccagggcaatgagacagtagaaggaaataaagggtattcaattaggaaaagaagaagtcatattgtccctgtttgcagatgacatgattttatatctagaaaaccccattgtctcagcccaaaatctccttaagctgataggcaacttcagcatagtctcaggatacaaaatcaatgtgcaaaaatcacaagcattcttacacaccaatcacagacaaacagccaaatcatgagtgaactcccattcacaagtgcttcaaagagaataaaatacctaggaatccaacttacaagggatgtgaaggacctcttcaaggagaactacaaaccactgctcaatgaaataaaagaggataaaaacaaatggaagaatattccatgctcatgggtaggaagaatcaatatcgtgaaaatggccatactgcccaaggtaatttatagattcaatgccatccccatcaagctaccaatgactttcttcacagaattggaaaaacctactttaaagttcatatggaatcaaaaagagcccgtattgccaagtcaatcctaagccaaaagaacaaagctggaggcatcacgctacctgatttcaaactataccacaacgctacagtaaccaaaacagcatggtaccggtaccaaaacagagatatagaccaatgaaacagaacagagccctcagaaataatgccgcctatctacaaccatatgatctttgacaaacctgacaaaaacaataaatggggaaaggattccctatttaataaatggtgctgggaaaactggctagccatatgtagaaagctgaaactggatcccttccttacaccttatacaaaaattaattcaagatggattaaagacttacgtgttagacctaaaaccataaaaaccctagaagaaaacctaggcaataccattcaggacataggcatgggcaaggacttcatgtctaaaacacgaaaatcaagggcaacaaaagcccaaattgacaaatgcgatctaatatgaaattcttaatgagttctatagttataagtacattatttctccttattaaaactaatcttttttgctgaatgggtggaagatggtggcttccctccaaaagaaaacatagttggttctgtaaagagttcacccatttcttccactataggcctgccctggcataatacaagctcccaacttaagaacttatgattttccatccatgggagaagccatcttttccatctattataaaaacagaagacacttcattaatatcactcccaaaataggctatgtcatatccagtgaggtaggatggctgacagtggtgagaatccaagtaattggtcaagcactgctatgtgtgaagaaacaccacagcatactctacactgtcactcatgatatggaattgttgcctcctcagcaatgtaactgagcccttaatatgtggctgggatgacaaagcaatgccagcctgcagagtggaacctgttcttccttctgggattagccaaaggccggtggcactcatggctgaccctactttccttacaactggacgaagcgaagcaactggatatgaacttctatcccaggatgtaactgtccaaagtgccttctctttatgtcaactggaaaagtgtgaaagacagacactattctcataaacggatatcctagttattccacccactagccagctcttccccccaggtggcagtcatagatttagaattgcaagtagaggccctggctaagcataccaccagtccctttaacaacacctaccataccatcatcattcttactgaagaaacctcacagatttgacaagtgacactatgaagctatatgaccctaggtattgcaactacagccaaaggtaacacttgtgtattaatgaaccctgaatgttgcatatatatacaagattagtcccacaatataactcaagctatgcaagcattagatacccatatttctgctagagatggatgccctctctcaggaccctgcgacagcatggtttagttgacttcctaacacatggaagactttcatatatagtagagctggtatactcttcattgctatcttcagttgctgtggattttattggtaccttgcactttaagtgagaatgtaatactgaccttctcaaaaactcctaggtccttgcaccataatgctccaacaaacacctactgtaattccggagactccagaatatttccaactccagtttaatggattcccttccaatatatacaagctatgccctttctaagaagtagccagattgactatgacacacgttttccatagaaacaaaatggaatttgacagtggggaatgatatacaggcagcttaatttcaaaatgcattttaaacttattttttgaggttttaatattattttcatactccttgaaacctgaaatttcacacttacattctaattgagacttaataacaaataaccagaacacatgaattgcctgtaatctctataccttgtattgtaagccacatttcaagtgtaaccttacttgtcagcacagtatgtttaccataggcataattgcttgtcctgactgtccagaaggcagggtggtattaagtatgcggcctctggagctgggaagtctggctttgtatactgtctctgccactgctaactgaaggacaatgggccagttacttcctgtaccccagttttgtcatatgtaaagtagggttgttgtaagaatgaaattagttaatatttagtacctaacaactagtaggcattacgtggtagctattcgtattgctatcgtcagagaacacacaggagtccattgttatttttaccctccccctccaaacaaaatgtgtaagacactagacatggtagctctgtaacggggttcgtcatgtattaaactgtgtacccaaatgatatgtcaaagtcctgacaaccagcacttcagaacacgtccttatttggaaatatggtagctggagatgttattagtgaagatgaggtcttacttgagcagggcaggccctcaatgtgggaagatgggtgtctttctaagtacaaggaaatttggacacagagacagagacatacagtgtgccatatgacagcagaggcaaagatcagagtggtgcagcagtaaaccaatgcatgtccaggattaccagtcacctccacaagtgaggaaagggcaaggaagaagtctcctgagtctcagagggagtgcagcccagctcacacttgattttggacttctagtctctagaactgtgagacaatacagtcctgtcatttttaagccacccagtttgtagtatttcattttggcagccctacgatattcatacagagttcttcacccaaaaggaagcactctttctcacaaacagtcaaagtcctggatgacggacaacctggagattgcaaacctccaaggaatcaaaggaggttctataaagtctaggagccccatctttcaaaggctgctcctcaagtccacacacacactttggaaggagaatcctgctcttggacatgggatccttagtgagccaactgccaataatccaacatcatcatgaattaaagatctctgacatttcctcgtcaccaacgggaattctgtcaagtagtaagtaaaacccttcttcaggaatctccacaccaaacagttctgcatggcttgggacgcctcaggaaacttataatcatggcagaagaaaaaggggaagcaaggcagtcatacatggtggcagaagagagaggttaaacttttcagtctctcttgggtgtaaagatacaatcttgaggcaaacagcagaatcaattttcttatgccttgaaattctccctttcaccataaatattcccttcacattaatctaactttatgtttgcatcgaactatgtgcctttttggaagttccggaagctaatttgagacagatagacaaagtcgggagaccctgatgcagaattccagaggtgacttcaatgttgctagttaacaacccaggcattgcccagatgatgccagcccaagatccaggtggactgggatgccagagagctgccagaacaagacgcacagacctggttctcagcccaaatcttgcatgcctttcttaccaactttcccttttttaaacccctgcctttccttcaaaattgaagtggttgcttgggatgggaatgcgttcacttcccctttaccattatggttaatacaataatttttgtaccagatctctctcttgttaattggatcctgcaggtggcagattccggaccagagtgacgttagaaactgaatgcacatactgggtggttcacagacacagtgttctgtgaagtttatgggtggattcctggggaagcctgcaagcctgttagtgattagcagaaccgcatccagctactgggatctgcacgccaggtgccgtgagcccctcaccatgttccctggtcccagctgcccgcggatggttcagccttgacaacgggctcggtgttctgggtggtgggagagcaagggggccccttgggcagcgtgctacagggctgtgaatccaggggcccacccggtgttccctgtggagtcactgagggaatgaggggcttctcagggcacagagctgtaacgcctttgtgcagtggtggctgaatacagtgacactgggcgcgtggtgagaagcggggcaaggtcagttcactggaccctccgccctgagcctcagatgagtcgggggtccccagacaggcccggcctctgccctgcggcggacactggagcctttgctgtggccgccaccgaggagccttgacctcaaaggagggggaacctctctacccacctcggaaacctgaagggagcggcggtctctcccagacaggatctcgccggcctccgcgtctccaggcccaaccctgtaccacataaaggaagtccgcgctgagctaccgggacacagcgccgttgggtgggcgggcgcggcgcggcgggaagcaccggggcagctgccacagagatgcgcggggactgtcgggaagtgggcggtccgggaggcgcggggctgatgggacgtgggcggtccggggacgcgcgggggatggcgggacgtcggcgatcccgagatgccagggggcagctgggacgtgggcggtctggagaggcgcgggggcagctgagatgcaggtggtccgggacgcgcgggggctggcgggttgtgggaggtccagggatgcgagggggcagctgggacgtgggagttccggggacgcgtggggtcgccaggaagcggggtctaggacttagatccgccttctcttcaggccatgcagccccgaagctccgaatcctgggatgactcctgtccatgttggaagggaccctgccagtcctggcaaggttcaacggccttagggcaagaaatgttagtagagtcctggaagacgatgtggggaacgggtagcggccaccggatggtgatcgttcttctacaagaccttgacatggatggggagaaacagagaagaaccttccaagtttgtcccactggacatgcccaccacactttaccagccctttctagaaggcctgtgcgtaacacatgaaaaagctgctctcgacctttccctgaccttttaaaagaaaacatttgctgcatctaatccgcctagatgtaaggaggttcccaaatgtatgacagagtcagacaattacatgtcttgtaagttaccatgtgcttgtcttttgttttccgttttttttcgtttttttgttttttgtttttgagacggagtctcactctgtcgcccaggctggagtgcagtggcaggatcttggctcactgcaacctctgcttcctgagtttcaacaattgtgctgcctcagcctcccgagtagcttggattacaagtgtgcaccaccacgcctggctaatttttgtagtttttagtagagatggggttttgccacgttggccaggctggtcttgaactcctgacctcaggtgagccacccaccttggcctctcaaagtgctgggattacaggtgtgagccaccgtgcctggccgtaagttaccgtgtgctttttaaacaaatcatagcaaaggggtgtcttctggaaatgacattttgaaatggagttactagaccacccctggaagggacacagtaaccacacgtccacgttcgttcagtgggtgagaggacatggaggggagacctgggcaggaagggaagagggttccatgccaggctgctcatatttaaaagacattttcattgtagggacatggatgaaattggaaaccatcattctcagtaaactatcgcaagaacaaaaaaccaaacaccgcatattctcactcataggtgggaattgaacaatgagatgacatggacacaggaaggggaatatcacactctggggactgtggtggggtggggggaggggggagggatagcattgggagatatacctaatgctagacgatgcgttagtgggtgcagcacaccagcatggcacatgtatacatatgtaactaacctgcacaatgtgcacatgtaccctaaaacttaaagtataattaaaaaaaaaaaagaaaaataaaagacattttcatatcgttgtcattgttttcttgtgtgcattttattcctcgctattgtatacatcattggaaattctaagtattcttttgaaatatctagtctttctagatgttctgaagtgcctgatgtatgttaaaattacaggtggtaaaataataaattttgtaaatgtctttttgttaaaattcatatgcagtgttttattttattttgatgttggtggggggtggggaggatggccaaatccctgcttgatcaacacacattgcgtttgtgctctggttcaggggaggagagaggaggagaaagtgcagacttccaggcctctgtgcgcaccgggaggagagattaatgatcatctcttctgtctgtgtgtttgttttatttatctatggatatcctgtgtataaaggatgaacaagtcctatttataacatctaatcttttcaggtgttaagttgccagcgtatgacggaagtagcattattaaacgaatgcagcttgtacatattgtgttaaaattcataaaaagccagtcttctgaaaagaacccttgggccctccctccgcagcctccggcgccagctgcaggaagacctggccaggggaaggcgggcggcagaagctgctgctggctgtggggaaggcggtggagcccaggcctccacaggctccccacaggctccccacaggctcgcgcggctctggttgctgggctccgcacgggccgcgtgggggcgcctgctgggagcgaggaggcgccatcctggctcgcctgctccaggaggacgctctgggcctgcgcagatgcagttctccaggatgggcgcgggcgctgggggcggcgctccttgggctgctgcgcctccactgagccgcctgggtgtgaggacctcgcgccggcgcctccgggaaggacgcggagccgccgcggccgatcccagggctgcagctgctgcccgacgcccgcgggaaggcccttccgccaccgcccgggggttcgaacttggagcagctgctgccagctgaggcgccagcggcgtcgggagctcctcagagtcagtgttttgtgctggattcggcatgtcctctgaaaactcgggaatttgtcactgaaatggtgacaggaggtgagaagtttttttagacgttgccttcgctggcctggcgcggggctcaggcctggaatcccagcactttgggaggctgaggcgggcggatcgcttgagctccggaggtggagaagctgccttcgtggtaactgtggtcttaagttcagctgagaacgataaatggcttttccttgaattggctgcttttgtgatttctctcaggctcatcttttgtcagttaaaaatccagtggtaggtgtagcttagagacgggaaatttttggttttgttttggctacacgtaagtgttggaaattattttcttttacgttccagtgtgagcaaatccagaaggatgtcagattaaacaccgaatttaacaaattcagccgggcacggtggctcacgcctgtaatcccagcactttgagaggccgaggcgggtggatgatgaggtcaggagtttgagaacagcctgaccaacatagtgaaactccgtctctactaaaaatacaaaaattagccgggcgtggttgtgcgcgcctgtaatcccagctactcaggaggctgaggcaggagaatcgccgagattgcgccactgcactcagcctgggcgacagagcgagacttcgtctcaaaaaaacaaaaaaaaatcaatcattggaatactgttgttcattacaattaatgaacgtttgatagacgcataaacgaactaaattcacaagtacatataagtaaaataagccaaaaaaaaaaaactacatcccgtatgatgacacttttatacattctacagaatagaaactaaagtgatatgaaggttgggagttgaatggagaaaaggtgagcgaaaagagggaggacggaggagttgcaagagaacaagagaaaatgttgagggtaattgatctgttttctatcttaataatggttatggttacatcaataatttctaaattgtacattttgtgtgttaattataattttatattattcaagctattacaaataaatacctgtataaatttcttagggacggtttaagggagatggataaatcacataaaaagtcagatatttctgaatgtacaatgaataacccttagctctatctttattttttggtaattctaaaatgcagcagatttttttaatgtttttattacaagaagggtttcttcaaaccacaccaggtgtgtgtaactctgggctaaagttggttaagggagcagtgggatccggtggagaggagcacaggcctcgatcctggagcccattcttgtcacatgtgagctcctggacacatctcatagctccctcatgcttctgcgtttacattctcatctgtaaatggaggaccaatgggcatctgcctctaacaatgtattttcatgtgttaagatgatgtatgttaagtgtttactatagcacaatcttttaataagaaattacatttttttccaaatactatcattgtcttcaagccccaccacccaccagaaaacttaatatgctctgtgccctgccctgtcctcagacatccagcccaagagacttttatatagtaggagatatgcaaatagttccctccctctgctgatgatgaaaaccagcccagccgtgaccgtgcagctctgggagacgagctcaagtgccaggattcccaagtgttttcacttggtgatcagaacttaacacagaggaatcaccatgttgtttgggctgagctgggctttcctttttactattttaagaggtgatacatgaagaactacagatattgttcgtgagtggatattagagaaacagtggatatgtgtggcagtttctgaccaggatgtctctgtgtttgcaggtgtgcagtatgaggtgcagctggtagagtctgggggagacttggtacagctgtggtggggttgggggtgtcctgagactctcatgtgcagcctgcggattcatcttgagaagcaatgacatgaactgggcccaccgggcttcaagaaaggggctggaatgggtctcatacattagtgctagtggtggtagcctatactatgcagacactgaagggtagattcaccatctctagagacaatggcaagaacatgctgtacttgcaaatgaacagtctgagagatgaggactcggctgtgtgagagacatggtgaggggaaatcagtatgagcccagccagaaacctccctgcaggaaccctggggtggggggaaatcagctgcagggggcactcaggacccactgatcagaatcaaccccagaaggaggtgcacatggagattaggggctggattccttccaggatgtgggacttcaacttcttctgacagtttccccagggaaccgctctaagtttagaattctgtgtcatctctatgtatttaaaaaagatcattttaatgtgaggaactaactattctcacatgcacaaaatgcagattcacactcacagagatgaaaagtcctcaactgtggtcactaggatcagagtcctgaggaatctcaggcgttcctggtgagtcttctccaatcagacccaggacagacacctcagtgagattccatgactagaacaggctttatggattttaaaaaaaatagactgagccagggtcagtgtcatgtagaacctcacaggtttcacatctgacccttctcctgacactaaagtgtgcaaatcagcatcaatactgatctggtgctgcttttgctcccaatctgtgttctttcttgagttgtccctttttcatttgcttttcctgctccctgaaaaaagaaagatgttgtctctgtggtctaaattccagggctcaagcccttttcttggagctcaggtgggtctcaggttgtggctcctgcagccacgctggggaggctgatgggactttcttctctcccattgctcagggccctccactatattgtgtggagactcatctcagaatagatgtggccagtgggagctgaaggggacaagcttgtttggtcaaaatgagatacaaatatggaattcaccctgtgctgtacaaactgtcacagagtcactttctgaaacaatagtgttagaaagaacttgagaaagttgtcagaatcaaaattgggtcacttgtgttaaaactctgctgaatgaagctgggaaaggccgtgacggaatgttctcatgctcatatccctgataccaagaactatcgtaaatagactcttaaaaccacaatcttgcacaaaggtgcccacaaccttaaaagaattacttctctgagtaatcttcccagcagctctctgtgtaagattggactgatgccacccttgttattgattcttctatcccggagaagttgtctcaaaacagcttatgtaaccctcctcatttttctttaaacctttatctttctttacctgcctgagtgaacccatgcatgttcccattgcaatgtccatcttcaaataattatcattttactttagagtctctttttgtctgttattcagatttgacaagctgcagatggacacatcacgtttctgtaagacttaggggatgacagttttgaggcatggctggggaagtacaatgtccataagattgaccctcaataagtgcaggctgtaagtctcagagctgaagctgctgaatcaccatagaatttcatctttagttctgctctgatggaatcaggcccacctgtgtaatgaatgacactctacctaacctagagtcaactgatgacaggttaaatatctagacagcaaatttgcaacaccacttagattagtgtttgaataactacaaagtatagccgagccaagtatatcgtaaagcagactattatacatggagaatctttaacatgacatctacaattcttaattttttttacgtataaaactgatggttttacaatcaggctgtcatgattttgctaatgagttgtagaagttacatgtatgttttaaatattaacagttttttcagatgcctggtttgcaactatattctcccattctgtagatttggaattttttccatgctttgcaaaatctttatattttgatgtagttccagtccttcaattctgcttttgttgtctgtgcttttaatcttaaatttaggaaatcattgctaaccttttggtgggagagaattttacaattgcaggctatacatttaactgtttaacccatctagagttgattttttgtgtttattctaacctaatattcttaactatttgcaagtgaaaacccagtttgtttaacaccctctttaggggagagtatgatttagccgttgtgtagaaaatgttataaatcactttgccttcatattggttctcaacttgaaaatgagtttgccatcaatacgtgggtttatttctgagctctctatatgtatttatgccagtaccatcctgttttgattatgtttgtaattaattttgaagtctgagagtaaaatgcctccaagtttattcttgcccttttgcagatattagacaaaatattttaacatttcaccatgaagtatgataacagctatggcttttcataatgaattttattgtgtttaggttattttcttgtatttctattttgggtagagtttttatggtgaaaccttgaatttttttaatgttattttctgtctgagaagttaatgggaccttcttcgtatttaatttggcataccaaatgtattgatttgaggattttgaatcatctgtgcatctcaaaaataaatttgagttggtcatggtgtatgatccttctaaagtcctgtggaacttagttgactattatttggtgtgtggagggggctcatttatgtctactaggaatattggtctgtagtttacttttttgtgaccttgtctattactgaaaatacggtaatttgggccttatagaaagactggaaggttggcatctcaccaatttttgaaaaagttagagaatggttggcattacttctttaaatgttgagagtcctttttttacttaacatgtgacctatcatggagaatatttagtctttgcttcggaagcatacatattacactgctcttggttggaaggttctgtagatgtctattaggtcaatttgttcaatagtgttgttcaagtccactgtcttcttaagaattctcttaatgatgttctatccatcattgaaagtgaggtgctaaagtcttctcctaatttttattattttctatttatctctccatatctcttaaggtttgcttaatgcagttatatttatttttgtacaaatatgtaaaaaataaatgaaataataattgctaagtaattttaatggcaaaatcacataataagaaattatattttcccaaatgctgtcattgacactaagctcctccaggaatctcacatctgctctggacacggctctcctggtgtcctaccccagagcttgctatagaggaggagacatgcaaatagggccctcactgtcctgatgaaaaccagccttgcctgcgtctacgggagaagagccccagtccagaagtaccaggggtttccatttggtggtcaggtctctgaacacagaggactcactatggagtttgggctgagctgggttttccttgttgctaatgtaaaaggtgactcatggagaactagagatattgagtgtgagtggacacaagtgagagaaacagtggatatgtgtggcaggttctgaccagggtgtctgtgtgtgtttgcaggtgtccagtgtgaggtgcagctggtggagtctttgggaggcttgttatagcctgggggtccctgagactttcttttgcagcctctggattcacctttagtacctttattaggtactggatgagctgggtccatcaggctcctgggaaagggctggagtaggtctcatttatgagttgttgtgtaggtagcacaagctatgcagactctgtgaagggtcgattcaccctctccagagatgatgccaagaaatcactgtatctgcaaatgaacagcgtcagagccgaggataggtctgtgtattactgtggtggcattgtgtgcatcccttgtttaggtacatgcagagatgctgctttggtgtgttcaggggctcctgttttggggacaccaattttggagtttgcagtatccttgagtccagtacgttcatggtggcattgggtctggggtgtgcagtggcaatgagtccaggatacatgcagctgatgccgtatcttgtgaggacaagaacaactacaaaacgatcctattaataaataggcaaatgacttgaatacacatttttcaaaaaatacatacaaatgacatatagatatataaaatgttaaatatgagtaataatttttaaaattcaaatgtaatctacaataaattatcaccccatacctgttagaatagctatttttaaagaagatgaaagataaccagtattggggcagaagtggagtaaagggagcctatatatattgttactgaaaatgtcaattagtacagacattatggagaatactatggaggttcctcaaaaaataaaaatagaactaccatagtttccaacaagcccactactggctatgtatccacaggaagtgcaatcagtatgtcaaagagacatctgtgcccccacgttcattgcaggaatatttatgatagtaatgatgtgggaacatcctaaattaccataaatggatgaattactaaagaaaatgtagtatgtacccaatggagtaatgttcatcctaaaataagaagggaatcctgcatttgcaacagcaggcatgactctagaggaccatatgtgaagttccacaggcaggcgcagaagacgagtaattcgcgatttcactgtagtttgtttaaatggtagactcacagaagtagagtggagtgttggttaccaggggctggaggggtggactggaaaaggcgagattttggtcaaagggtgaaatgttccagttagacagaaggagaaagttacagtgttctaatgcacaagatggaaaatatggctaataatgcattatatatttcaaaatggctaaaaatgcaaatgttaaaaattttctcactaagaaatgatacagcctgggcgcggtggctcacacctgtaatcccggcactttgggaggctgaggcgggcgaatcacaaggtttggagttcaagaccagcctggccagatggcaaaaccccgtctccactaaaaacacaaaaaatagccaggtgtggtggcacgcggttgtaatgccagctactcgggaggctgatgcaggagaattgcttgaacccgggagacagaggttgcagtgagctgagatcatgccactgcactccagcctgggtgacagtgagactccaactcaaaaaaaaaaaaaaagaatgaaatgatagctgtgtgaggtgatggatatgtcaaatagcttgattaacaattccataatatatacatgtatcatagcatgtgtgaggtgacctgtatgaaggtgaagtgacctgggggctgtgtaagattacctgggggtatgtgtgaggtgaacacggcacatatgaggtgaccagagacacatgtgaggggacatgggagatatgtcgggtaagccagggggatttgtgaggtgacacagagcaagtgtgaggtgacgtggatgcatgtaaggtgatttggggcacatgtgaggtgacgtgggggatatgtgtgagctgacctcgggtgagtgtgaggtgatccaggatggatgtgaggtgacctgggggtgtgtgtgaggtgacttgggcacatgtcaggtgacatcggggattggtggtgatgtgggtgtgtgtgaggtgacctaaggaggtatgaggtcacctggggcatctgtggggacctggaaatgtgtgaggtgggtacaggtgaagtcacctagggcacatgtgaggtgacctgtggaatgtgtatggtgacctgggaccgtttgaggtgacatggggaatgcgtgaggtgacctggggcatgtgtgaggtgacaaagggcatgtgtgcagtgacctgggtgcatgtgaggtgacctggtgcatgtgttaggttacctgggggatgtgtgaggtgaacaggggcaggtgtgaagtgcctgaggaatgtgtgaggtgaactggtgcatgtatgtggtgacctgggggatttacgaggtgacctgcgggatgtgtgaggtgaccttgggtgagcgtgaggtgacctgacgtatgtatgaggtgaccagggtgtgtctgaggtgatgtggggtatatgtgcggtgacctggtggatgtgtgaggtgacctgcaggatgtgtaaggtgacactggggatgtgtgaggtgactcagggcacatgtgaggtgaaattggggatgcgtgaggtgattcagggcatatgtgaggtgaccttggggatgtgtgaggtcaccttgggtgagtgtgtggtcatctgggatatttcccaacttcgtaaggaaagcctgcaacaacacatggcattagaagcttcacactctagcaccattaatgcgtacatcctcaaggaactctaaatgttttgaggttagcttaaatgccatggagcggcaccttccccaggcacactcatatatgcatcctgggtctccctgccaagctatatctcctcaaatttacagtttatgtttgctctgtgacatcaactctgatatgttcaagtgtgtttttttttctttatttgtagttgttcaggcttgttgtttcactctcattactctgggctcagtcctctcctcaggtgtcccacttcagagctcgctgtgaaataggagacatgcaaatagggccccccctttcctgataaaaagcagcccagtcctgaccctgcagccctgggagagaagcaccagccctgggattctcaggtgtttccactttgtcatcagcaacaaacaaattaccatggaatttgggctgagctgggtttttcttgctgctattttaaaaggtgattcatgaagaactaaggatattgagtgagtggacatgagtgagagaaacagtggatttgtgtggcagtttctgaccagggtgtctctgtgtttgcaggtgtccagtgtgaggtgcagctggtggagtctgggggaggcttggtacagcctgggggatccctgagactctcctgtgcagcctctggattcaccttcagtaacagtgacatgaactgggtccatcaggctccaggaaaggggctggagtgggtatcgggtgttagttggaatggcagtaggacgcactatgcagactctgtgaagggccgattcatcatctccagagacaattccaggaacaccctgtatctgcaaacgaatagcctgagggccgaggacacggctgtgtattactgtgtgagaaacactgtgagaggtcggaagtgtgagcccagacacaaacctcctgcaggaacgttgggggaaatcagctgcagggggcgctcaggacccactcatcagagtcaaccccagagcaggtgcacatggaggctggggtttgtttcctgtcaggatttgggacttcctctgcttctgacagtttctctagggaaactctttaattttagatttctgtgcccaccaatgtcatctctacatttttttaatcattgtatatgaggactcgttctcacatgcacaatatgtatattgccacctatgggaatgaaaggtcctcaaccatggtcaccagcatcagagtcgtgaggaagctcaggggtgcctggtgagtcttctccagtcagactcaggacagtaacctcaaggggattcccttgtgagaactcacacattttcatgagaacagcaccaggagtcagttctaaaccattcatgaaagacccactccatgacccagtcacctcccaccaggtcaccccttcacaactggggattataatacaacatgagatttggggcaggacacaaatccaaaccatatcagatacacattgtgaaatacgcatggtggtcaggtaatttgtatttctatcacctcacagcgctaccattttattattttttttaatttactgcatgagtgagtgtctgatgagaacacctaagatctaccctttcagcaacaatcatttttacaatacagtattaactataggaccattgctgtacgttagatctccagaactcatccaacctgcacaactgaaactctgtacaatttaacacacatcacccaatttccctcacctcccaggtcctgggacccactattctactctctgctttcaagagcttgaatattttagatcccacatgtaaatgagatcatgcagcatttgtctttctgcatctggcttattcaactcagcatcatgtcctccaggcccatccgtgttgttgcaaatgtcagaatttccctcttttcaaagccaaacaaaatacagatgtatgtatacacattttctttatacattcatccatttacagtcattaaattattttacaaatctacactattattaataatcttgcaatgaacatgtctttggcaaagtaattttatttcctttgcatatataacaagaagtgggatcaccagattatatgatagctttatttttaacttatcaagtaaccaatcctaccacaggatatttccctttcccccacattcttgccaacatttgtcatctgttacatttctgataatagccatattaactagtgtgagttgatattgcattgtgcttctcatttgaattcctctgataattaggaatgttgagaactttttcgttttctgtttgccatgcatgtatcttctgaaaaaaattatccaggtttttgcccttttttatcagttcatttgttatttgctgttgaggtgtatgggttatttatacatttggacagaacttcttgtcagatccataattgcacatagtttttcctgtgctttgttattaaattcaaagaaatcagttccgaattaatggcaggaattttttttgctccatgtcatttatgagtttatggcttcaggtattatgtccatttttagttgattttttttttttttgggagacggagtcttgctctgtagcccaggctggagtgcagtggcgcgatctcggctcactgcaagctccgcctcccgagttcacgccattctcctgcctcagcctccgagtagctgggactacaggcgctggccaccgcgcctagctaatttttttttgtatttttagtagagacggggtttcactgtggtctccatctcctgacctcgtgatccgcccgcctcggcctcccaaagtgctgggattacaggcgtgagccaccgcgcgcggcctattagttgatttttttatatggagttagagaaggcctaattttatttcttttgcatatgaatgccagttttacaccattattgaaaagactgtcctttctctactgtgtgctcttggcacacaaaatcaggagagacataatgacaaaaaaaatatgagatcaatagtcctgatgaacatagacctgaaagtcctcaacaaaataccatcaaattgaatccagaagcactttaaaatgtgatacatcatggtcaggtgggctttacccctgggatgcaaggctcgttcaatatccacagtaactctgattcacaatgtaaacagaataaaagcaaaaagcatatgattatgtcaatagatgctgagaaagcttccgataggatctaacatctactcatgataaaaaccctcaacagactagacatcaaagaaacatacttcagaataagagccatctacaacaaacccacagttaacatcatactaaatgagccaattaaaacacttatctttataaatgacccagtctcgggtgtttctttacagtgcgagaatggactaagacagcatccaaataggaaaggaagtcaatccgtccatcttcactgatgatataattctatatctagaaaatcctaaaaactctgccaaaataattctagaataaacaactttagtaaagtgtcaggatacaaaatcaatggacaaaaattaccagcatttctataagccaaccacatccgagctgagagtataatcaagaacacaatcctattcgacttacagtatccacaaagaaaatgaaatgcccgggaatacagataacaaagtgaaagatccctacaaggagaactatgaaacacagcatacataaatcataaatgatacaaataaatgggaaaacatttcatgctcatggattggaagaatcaatattgtaaacattgtcataatgcccaaaggaattcagattcaatgctatttacataaaactatcatcatcattcttcacagaatcagaaaaaaatctattctaaaatttatatggaaccaaaaaagaccctgaatatccaaagcaatcctaaggaaaaagaataatgccagaggcatcatgatactgaccttaaactacaccataacgtcttgctaacaaaaacagcctgtactggtacgaaagcagacctgcaggaaaaaaaatagatcaaaatagaagacagaaataaagttgcacacctgcaaccctttgatctttgacaaagctgacaaaaacaagcaatggaaaaaaaaaactctgtgttcagtaaatggttctgggataactggattctggcaggtatgcaaaatgcaagagtgaaggagcctgtgcagcttctacctagatttcagatgtgtagagagccctgcatgcccaggaagaagcctgctgcaggagtggatccaccacagaaagcctctactagagcagtgccaaagatggggaaagatggagttggagcccccattcagagtccccactagggcacttcatagtaaagttgtgggaatgtggccacaaccctcaagaccccagaatggtagagctacgggcagcttgcaccctcagcctagaaaagcttccagcacttgactctcacttgtgaaggcagccccgtggtctgtgcctagcaaacctatagggattggctgcctgaggttttggggacccaatccttgttccagtgtgccctggttgaagtacataaagtcaagagagattattttgtagcgttaggatttaatatctgcagtgctgggttttatatgtgtgtggggcctgttggttgttcctttggccaatttatccctttgggattggaattatttacccaatgcctgcatcatcattgcaccttggaagtaaacaacttttattttttaaatttgcaagctcacagctggagggacattgccttaagactcagatgagactttgaaaatttgagttggacgttgatgaagttaagattttgggcactattgaaaaaaggtgattatattttgcaatgtaagaagaatatgagaactttgggtccgagagtgcaatgatataatttaggggttttcccctccaaatatcatggtgaaatgtgacccacaatgttggaggtggggccaactgggtggtttgggtcatggggaaagatttttcaggactggcttggcatccaccccatggtaattagtgaattcttgctgtattagctactgtgagatctgattgttcaaaagagtcttgcaatcctgctaccctctcatgtaacccctcctcacaatatgacacagccttctccccctttgccttccaccatgactgtaagcttcctgaggccctcacaagaagcagatgctggtgccatgcttctcacacaacctgcagatctgtaagccaaataagcctcttgtctttgtaaatcacttggcctcaggtattaatttatagcagtgtaaaatagactaatacactgcccaaagcaatatacagagtccatgcaatttctatcaagtaactaattaattatgtatttttaaaaatcctaaaatttatatagaaccgaaaaacactctgaatagcaaaagcagtcctaaccaaaacgaacaaagctggaagtaccacattccctgacttcaaattacacagcacaaagataataagaaaggcagcatggtagtggtagaaaaaaaatcaagagcccagatatatagccaaatatctacaaccaacagttctttgacaaaactgacaaaaatatacactggagaaacaaccctctattcaataagtagtgctgggagaattagatagccttatgtagaagaataaaatgagacttctgtatcatcatagacacaaattaactgtgaatatggattcaatgtttataaactcataaaaatacttgaaaaaatctaaaaataatcctctggacattggcctaagcaaataaaatatgactaagacttcaaaagcaaatgcaatgaaaacaaaattagacaaacaggattaattgaaccaaagatcatctacacatcaaaagaaagaaccaatatggtgaacagacaacctgtgaatggtaaaaaaaaaaaatgtgcagtctattcatcaaatatatagaatctacaagtaactcaaataagtcaactagaaataacaacttcataaaagagtgagcaaaaacgagatatttctcaaaagaagacatacaagtgttcaacagaaataaaacatgctcagcatcacaaatcatctgataaatgtaaattacagacaacatgatatagcatcttccaccagtcagaatggctattaaaaataaaacagatgtttgcagagaagcataggaaaaataatgctttttatatgcttgatgagaatacaaattggtacaacctctatgaaaaacaatacagaaatttctcaaagaactaaaattagaattaccatttgacccagtaacccctcctggtgggtatgtttctcccaaaaggaaacttctatataagaaaaagtcacctgcattcctatttttattgcaacactattttcaatagaaaagtcaagtaatctctctaagtgtcaatcagtggatgattaaataaaatatgatagatgtaaatcatggaatactatgcagccataaaaaatgaaattgtgtctttcacagcaacatgaatagagttgaaggacatttcctaaataaaataactcaaattctcttttataattggaaagcaaacaatgggtacacatgtacatagagaaaaacaatagacactgggtactgcaaaagaaggcaaggtgagaggaaagtgagggttaaaaaatcagctattggctccaatgttcactatggggtaacagttacatcagaagcacaaacctcacctttatgaaatatattcatgttacaactctgcacatgtgcaccctgattctatgaaaataaaaacagaaaacatgaacagaattgttagactgctagctagattgaccaacaaacaagaaaaatgcaaaagtagcaattctttgttttgtaaccctttctcattttctggtaccataagaaattgtagactatcgtcctatattcttttctgaagtgctaccattagccatttctcaaagaaattctggttccttttttcttttattttctttcattttttttagacagagtctgcaacgtccacctcccaagttcaagcgattctcctgtctcagcctcccaagtagctgggattacagacgtgcaacaccacacctggctaatttttgtatttttagtagagatgaggttttgctatattggccaggctggtcttgaactcctgacctcaaatgatctgcccacctcagtctcctaaagtgttggaattatgggtgtgagccactgcacccagccgctggttccttttacagaagaatagtattaaaaactcatatcttgattcttgatgtactttttgttaatttcttgtagaacatctcaagtaatcaatacaggaagtatttgttgtgtattaacccatatatatatatacccacatctaaacggtttttatttatgttcctatattatgctaaacttgcaaatccactgagataccctaagttaataccacatgaatgattttcaccttccttctatgcctttccctaacctagcactccaaccgtggggaaccccctcccaccacacaccatccattccctttgtagtccatttccaggattcctgtagagtggaacccgattgtgtaagttgtgctcttttgtggaacatcatcaagtggagtccagtgctgacgtgcagtttcttttttctttaatcttatggactacactatttctgaacctacttagtacctcttttgatttcatacattagtataatggcataagatattttctatatagtctgcattccatcctggaattcctaatcacctatttttttaaaatttcttgtggattaagattgtattagtcagtgtcccctagagggacagaacaagtaagatacacatacacacacacacacacacggagtttattaaggagtattaactcacactatcacaaggtccacaataagccatttgcaagctgaggagcaaacaagccagtccaagtcccaaagctgaagaacttggaatccgatgtttgagatgaggaagcatccagcaggggagaaagatgtaggctggaaggcgaagccagtctaatcttttcatgttcttctgtttactttttattctggccacacttgcagctgattagattgtgccacccagattaagggtgtatctgcctttttcagcccactggctcaaaggttaatctccttcggcgacaccgacacagacacacccgggatcaatactctgcatccttcagtgagatcaagttggcactcagtatttagcattacaagtccaccctttgtcaacttgaacccatacacatctcctgagattatacataatcttcaaataaagacaagaataaagtcataattatgcctaataatacaattattcttcttacaactggaaacacaccaatccccaatccaaatggtactacatatgctccactccctcaaggacacagccaggatcatctgatgacttggtgtctagatggcttcagcacttttaattttacctccaatgttagactccactttatcaatgcagatgtagcagaatattttaagacattgatatgctgaaaaattcaacagttcataaaagttgccttcccaccacagccagtggttactactgaataaggacctgccatcctctagggagaagctataatggatggggtgcactgttggtggttatggaaatcgatccatcgtggcaaatggcagcatctttctttgataacattatattctattgtgcatatataccacattgtctttattcatttgtctatctactgacagattttttccatatgtttgctgttattaatagtgtttcaataaacataggatgcagatatcttcacaaggtggtaatttcatctcctttggatatactcccagaaacaggattcctggtcatacaatatttctggctttaattcatttaggagcctttatactgctttccataattgtgaaaatgtagaatggtatagccattatgaaaaacagtttcagttttgaggtatgatctgtaaacaaataatgtttgttatggctctcaatgagagtttctactaaatatgatggaaggtcaggaaggtctctcaccttaaagcagggatggattatgcctcttatttcctaaaagcaaaagattggaagcatgcatgatggaggtggttggcaggtttcaggatgatctcataagaggagaatctgttggataaaactgttgggttttcagtcatagacacacctacactcaatatgaaatgatgaaatcaagtgaggatctagaatgtgttcgcttgaagcaacagcatattctcaaaggcacctattgctccatcacaagggtgatgaacttttgaaaccagtaaagtgtgagagcacagtaagtgataaagttatcacatttacatgaagtttgtttaatgtgccaagggctcgcacagattaatcataaataaacacaatgtattttagcatacatagatgtctagagaagaatcttcttagagaaacttcttcaggttacagaaatctgtgtaagttgtagatctaatggagaagtgtctatgaatactggtctgtttttgaagtatggaaagatgatctcttttggagtaggcttgcgattgtgttgatttcttaattgtttcttgagttgtaacaaaagaaccaaaaaaatgactaaccggagtttcatggctgtgttgataaaaatttttcataagctttctgtcaattatttgagaccagatttcctgatttttttctccaatagatacatgttcacaagatctcaggaaaccacctctcaggtgctttagtttaaaagactagcttcctagaaaaagaagattctgtctaaccatgacaagttggtttcatctgcaaaccatcaagtttgagacctcattgtcaagaatcataaaaattttaactccaatgtactgaaaatcataaatctcgaatttaatgttgataggcattgacaaaatggttcattcttggatgcgtcctatgttgctggctcaacatatcagttaattgagaatcctcacttagctccctctgtttgtagcactgagttgattgtcaatcttcagagtcatccgttgaaggagagtcctgaggttcatgggattcttgtagacactcaggggaacaaaagaaagaaacagaattgagggctgccagccatttccacatcactaggaataattaccatctaagtataaaggtctgcatcattcagaacaccctgcatgacaggctgatgcaaaaaatccaaccctacagaggctccacagcaacctttacagttctttccgggaagaaataatctccaagttaagtgagtcagtaaagctgctctgagctacagtaaaaattggattgggcccgatttgtctgagttcagtgtaattattatactcagctgctgccccaatatagactgaggatggataatttaaatgagcctggctatgtggtttgttatatatctgaactaaataaacataaagggcctgtctggactagcgtgagggtgagagatcctgggagccccagccccccatactcttatctcccttcctccaggaacctctaggttctcagggtgagaatccacaagatccattcatggctctattaccaggagaccaaaatctctgaccttgttcatacagacaaacaggcgaaggacatttttagatccttatctatgtggcgaaaggcaatctatccccattacaagccttaccagcaaccttcctttgtcatgaaaatgggtaaaattagccaataggattacatttaagaaaattttcctgtgatgttccagccagaaaacagcaaaaatcagcttcacacctggagacttcttgcatcggtcacagcccagagaaagaagatcaccatagcattaaaatgcaactgtaagaacatgtaatgcttccatgttccacgcattacgtctcaccagtttagtcaatatggattaaatatgagagtgtggcaattcgcaaactctatctgaggaggaaaatcggataaaaaatgttatgaaaaataaagcaatttgaagcctctgacttcagcaacttcaccactaatgaaatgatgtaaccctcattggcctcaaatttagttttcacggggcatctgcagggttccaaagtgagaccaggtgaattcaatgtgcatgcacttcccaagtgtccacttgtattctgtttctttacttctgtttacagaaagtagacacatattcagtcttagtaccagtgtagggagcgctttccatgagatggataccagaaaaaaatggcaaacatgggatccgttaatataaaaattagccacgatgtatatatatatatgtgtgtgtgtgtgtgtgtgtgtgtgtacacacgcgcgcgcatgtgtgagttgaatagcagagttggagtgggtttctatccacatgtacctgcacctgcaggtattctcaggtgccataatcaactgtaggaccctaaaggaaataagagtctcccctcaacccctgaagagtgtttgggttcaccgtgtgtccaatgattctgtgcctcttgagctccaggaaagggctccctggtgatgcatgagatcttttcttggagtctctctgcagagttcactgggtttcctaaaggcaattcactatttcaaaagatggtgtgaggagcatgtggtgtccctaaaggagaattctgagccagggcacaaccactttatactgagctggatacactggtaggaatatactctgtcagctcagatagaaacctccctgcatggttggggctgggctgcagggggcgctccggatacacccagcacaggctcccgccccagagcaggtgcacaggaggctggggagaggttcctcccagggcctgggacttcctttaaaaatatctaaaataagtatttcacaaagactgctgaagtttgtataaatatctattcaattgtgagcatttatcaaactggatgttgtaatgagaaccacttttacaatggggatttcaaactctgctggaggtcaggaagagatcctttcttataaataaatgcaatttttggataaacacagtcattccctaaataacgcattcacatattatggtctagaaatgatgcaagttgaccctgagacagtcaaatgtggtttcaaagtgaggtgctgtccttgaggagcttgttctccagtgggggaagctctgtcaacacagagttcagggatgtgtaggggacacatggcctctaacaggattacggcttgaaccctcagcttctacagttgtgtcacccatgtgtctgtttctcatactgggtcaggaattgggctattaaatagcatccttcatgaatatgcaattaactgaggtgactatagtatctccgttccctgagagcctcacccaacaaccacacccctcctctggagaagcccctagatcacagctcctcaccatggactggacctgaaggatcctcttcttgatggcagcagcaacaggtaaggggctccccagtctcagggctgaggaagaaaccaggccagtcatgtgagacttcacccactcttgtgtccactccacaggtgcccactccctgcagctggtgcagtctgggcctgaggtgaagaagcctggggcctcagtgaaggtctcctataagtcttctggttacaccttcaccatctatggtatgaattgggtatgatagacccctggacagggctttgagtggatgtgatggatcatcacctacactgggaacccaacgtatacccacggcttcacaggatggtttgtcttctccatggacacgtctgtcagcacggcgtgtcttcagatcagcagcctaaaggctgaggacacggccgagtattactgtgcgaagtacacagtgtggaaacccacatcccgagagtttcagaaagcctgaggaaggaggcagctgtgctgagctgaggcagtggtacagcagttttctgaacttccatagtatctcattttgcattgagttccgctttaatattagccaagaatatgggatagacgggtgctcctaagagatccttaacttgcccattttgatgggttttcccaaagacgtgagaagccacttttttcgcaaagcatcccaaagccatgccctgctccagaaacacgtgtatccatttcctggtctttgattaactgacaaactctcatcagcgcacctgggctaatttcacatcaggtagaaatatgtgctttaaagcaaggctaacgttgtaatagcaattcctgcttaataaccttcagcattgttgttgtgtgctccatcaactaattacgttagttcaaggttctcaatgggagtttctaataaatataagggatgtatagaagttcccctaattaaaacaattgtgaagacaacctcagtgttcaaccatatttcaacccttcaccacaaaggaactttcatctctcctggaagttgggttcattttcaaattagtttttttattttaatatctcaagattattgtatgtgactattttagcagaaagtgaattatgggaacttgaactaaccaactgaaaatacattcagaactaattaaacaagatgccagaatgtgattggctccaggcattttaaattcaacaggttatgtaaccaggctttaaatttgcacatcttcgtgttaccttcatgacacagtcaactcccattatgtaagaaatggtgagtgcattcccaagggtcttgcacagttataaaaatagacttgatgaggtgaggagttgtttaaattcccctctgaagaagcagcatcaacccaacaaaccactctcttccctctgtgactagagctctgtcacaggccacatggacctaaatccttgatggagattacaggactacgtaaattggactgatcgtttttatgctgttaaattaataggtgagtctgcactccagcctgggcaacagaataatcttgtctgtaaaatacaaaagaaagataaattaatagatactgactttgacatttcggataataatattttcataaaccgaatttaattatacccacattgttacctacaccttcactgaaaagttcctagttatgttgagttccatcaacactccacatgttcaaatctggacatccaagagagtctagagaataaaacgcaatgagggcagtgaaacttgcgtatattcagcacctcttaactcaggaggactcaatacaccctggaacactctgcttttctgaatggctcacaatgactccagctcactctccaacctcctcaaacatctggcctctgtttgccctaagttcacgctctgctcttagtctatgttctgaagtctttgtagaggtgaaaatgagctgtcagatggatcttccttctcactgcaacatggaatttgctatttcacttaatgaccactctttccacaatggttgatttcttttggcctgttcattactggtgattttcaagggaatctcagttgaatctttactgttttgcattttgtctccatgacaatgttgggaagtttttcttctagcagcataacatgatctagtgacctgacacatttgcagcaaacaatacctacaaattcagaagctctttggttttctttccacgaaatataattcttgctcttctgtgtatgagcacatcctagcatccctgtacacacccacgtagatgtctacacgccgatgaaatattccctgtaaataaaaaaagtatctcagtttctctcaatgttcataattctcctgagggtgaggaaggtacttctgggtctgctcaaacaaatggcccagagaccacctggtaggtaggtaaggagctcacctcgctctggatattgagtctgtctctttccctctgtcgtctcatagaaggccagcccacttgttcagctcctaagaagagagcccaggtttatccagattatacaacacaaccagcttctgatgactctcctgttacaacatccatggagatattttgtgtattatataattcaccaaactaatgtgaaatgcccaagttgcaatactgcacaccctagggtatgttcttgcaattcagcggaggagaaattctttcagagacagatggatctgaattggtaaatatgtgggtacgaattctgggcttgagtgtcattgtccagccatgtttcacaggtgtgacctgtcagggaagaaccagagttccttgttctctcagagggtagagctcacagaggtcctctctggttcccaggaaaggtaatttcactaatcttggtgatgagactatcctccagtgctgatgtactatagagttttcatctgaagctgtcactgctatccccaatgtacatcttttcacacagaaatgtttagaggtcaggccatattctcagggttacacattgagaaggatggagatatattctactaccttctcctgagatctcacacacaatctcaaatttcaaaaggtctcagaagggcagctctcaggtactatttaaaaataacccacttcctgggacaggtagcatccttctaaccatgatggatgttctgaactacagtacacattgcatggatccaggtttgtctcaattcactgtgattattacactcagcagctgtttcaatatgtctgaaggggtaaatgacaatttaggtgacctgggtgtatggttggtgttatatgaatctttaaatgtagaacagtattaactgtattccaaaatctgtctttgatccatgatcacacttgtctcccagaccagctccttcagcacatttcctacctggaagaagaggactctgggtttggtgaggggaggccacaggaagagaactgagttctcagagggcacagccagcatacacctcccagggtgagcccaaaagactggggcctccctcatccctttttacctatccatacaaaggcaccacccacatgcaaatcctcacttaggcacccacaggaaatgactacacatttccttaaattcagggtccagctcacatgggaagtgctttctgagagtcatggacctcctgcacaagaacatgaaacacctgtggttcttcctcctcctggtggcagctcccagatgtgagtgtctcaggaatgcggatatgaagatatgagatgctgcctctgatcccagggctcactgtgggtttctctgttcacaggggtcctgtcccaggtgcagctacagcagtggggcgcaggactgttgaagccttcggagaccctgtccctcacctgcgctgtctatggtgggtccttcagtggttactactggagctggatccgccagcccccagggaaggggctggagtggattggggaaatcaatcatagtggaagcaccaactacaacccgtccctcaagagtcgagtcaccatatcagtagacacgtccaagaaccagttctccctgaagctgagctctgtgaccgccgcggacacggctgtgtattactgtgcgagaggcacagtgaggggaggtgagtgtgagcccagacaaaaacctccctgcaggtaggcagagggggcgggcgcaggtactgctcaagaccagcaggtggcgcgcggcgcccacagatcccgaggccgggtccggagcaggtgcaaggagggcggggcttcctcaacagctcagtggtctgtctcctcgccagcacctcagatgtccccaggactctctttctttattatctgtggttctgcttcctcacatccttgtggcagggaagaaaggaggaagacaatttttctgtttactgttgaggtttcaccaattactagaaactttcctacaagttcctgcatgactcattttgccatatatggattctcaccatctcttgatttgtttcatcaatcgaattgtgccctatttgaaattaacttactgaaaccttaaatccaatggatctatactggaattttaatgatgtaattgaggttaaatgtggtcaaagtgtgagaccctaatgcaataaaccgttgtctttataagaagaggaagagacaccagagacctctcacttttcacgtgcacacagagaagaggccatgtggagacgtagtgcactagaaggtggccctgtgcaagccaggaagaagccatactaagaaccaattttgccagctccttgatcttcgacattcagactgtagaattgtaagaaaatcaatatttgttgtttaagccacccaatcctgttgtcttcttacgaagacccaaactgactaataccacctaactctgttagctctgtctcctggagggagaagcagccccctgaggctgggcactgcatctctcagatttccacgtgaagtaggcaaaaatagtagttctcatataaaaatgtgtcatggctctgttggccatttttgagcatggtctctgaaaccagccctggtgtgtgtgtgtaacaaatgtcccttatcttttatttggacataacaaatagacgataggtaccagctggatggagattggccactgatcatcttctgttctccttagtatgtcacagaaaaccacaccaacatcaccagcatcactgtttttcttctaccacctcaaacggactacagaaatgatccctgcagtatggtctatttcttcggctttcgaaatttgcactgaatctcttcctaaatggggagctacatggggtctgagttttgttcctttcttcccagtcttccccaagtaccaaggacagaatagacttaaaatttggccatcaatgcccccaaacaccacatcactttctaaaatccacatcctgcatccatccttctctggacacccctcatcaggctacccaggaatggccagaatctggtatcagcttatgggctgaggccacgagttatacacatgtgtgatttcagtcacacacactctacttcaggaccacacctgtgttctgaggagctcaggcacctgctgatctcagtaattctctaataaatcacacacctcttattaataaaggtccagatggccccatcagctgcagagcagtggagtaaagctcatgggtgggtccatcaggcagaagtcagacaatggaagggatggctggtcacttccattttcactgatgttcgcaatgaattttaatggaataaaacaatattaactacaaagagacagaaaagaagactggctcgtcaagatatttaaggacaaggaactttatttggggggaaagtgaaagacacttctaaatggaaatccctaaagcacatacagcagctgacagagtggccactgtgcacatgagggctgaggagatggatggtagagtccattcctgcaacatgtctctgggtgtgtgatggttagactcctcatgcatatgaatataagagctggactcatggagaaaaaaagggccatatcccataggaaaggaagaaaaaaaaacagatgggcacccctggagagagctcattagatttggtgtgtttaagatgaaaatttcttccaaaaattgtaatgttctaagctaaatatgaatctcttcaataaactgagaataggagaatggagctaggacttgagagaggaaacaaatcttgagagagcagaaagcaaatccacaaaaactgtcacatgacagaggtcagaatggagctgatgtagctacttcactattctgcagacttattgaccatgtggagaaggggcttgaacaaatggagacgttctccaaccttctgaatcagcctccttcttatgcatgagtagaaatcatagttctgggggtgaccttcccaattttcctgtccatacctcttcccccaggggtagagtgtcttcccaaccacaatggtttctcaccagtgttctcagcttctcctccattgtacttaccctgcagattaagaatttcttctagatggagttctttgggaattttctgttttctttagtttctgttgactccaccacacccccataggatacaggttttattggatttcccctggaaatagtgggggtggatccaggcgttcaacagtcctcgctgttcttcccttcctgtcagcaccacaggacagcagataagggagttgactgtggatttttcaaattcctgggaaaagcctgcaaggactagtagattcacactctaataccattagcacatgtatccaaaaagaaacctcactaaatatttccaggttagcctgttcctctctcagtgccatccagtggcacctgccctgggttcacgaacatgtgggccccagtcctctctgctggcatctctctcctcacatttcagtcttctcgttagctctgtgaaagcagctcagatatgttaaaaggttttcttcttcatttattcagtttttcaggtttactgttaaggaggtcagaataagatcatagtttcctcatttttcacatttgcacgctgagtagccactttctatataaaagccagaaactaagggaacaaatcaaatatccatatccactacaggtgaacgttaaaaaatttgacatatgattatggactaaagtacaatgcagaattagaatcaaggcatcctcattctcataaaagcatgtctacattctcaaataactctgctgagtgaaagtagctgaagaattaagagtgcacttcataaacttctaattgtataaactgcagaaggtacaactattctaaagtaacagagcagatttgaaatttgggagaaatgggtgttgaaagtaattgggtggtgagatgaaattacagagaagtgacagaaagatttaggggttaacttaattgtacacaacctgattaaagtttgcacacatacgttaccattttccaaatggtgcagtgtagatttgaattaattattaattgtacttaaagcagtaacaaagaaacaaatgaatatgttggttgaggaggagcaaaaaatagatgggtatgaacactcaaaacatctcagactcttgaaagtacacatgcttgaacactggttttctctgtatactttaggtaaagagcagaatacattaaaagaaaacagagatgtcctggcgggggtggaatcctgcaaacctcactaggcgtgtcccacactgccctggagttgtctcaggggagcagtctcctctagtggtcagagacacaggcatggataatggggctaatactgtccagctgtgtgaccttgaacacattgtataaacactgttccatatgtaatttatcttccttaaaatgtaacattgacacttgcattaaatgtattctacaaatatgtcaaaaagaagatgacgactgctaaatgattatcaaggcacaatcatataatataatgatattttcctgagtgataagatgactaccaatctcccccagggcactttgtttgctctgagccctgcgcctcctcaggattcccatcccagagcttgctatacagtaggagacatgcaaataggtttctccctctgctgatgaaaaccagcccagtcctgaccccacagctctgggagagaagcgccagccctgggattcccaggggtttctatttggtgatcaggactaaagacagaggacccaccatggagcttgggctgagctgggttttcactgttgctgttttaaaaggtgaactagagagattgagcgtgagtggatacccttgagagaaatggtggattatgtctgggagtttctgaccaggatgtctacgagtttgcaggtgtctagtgagaggtacagctcgtggagtccggagaggacccaagacaacctgggggatccttgagactctcctgtgcagactctggattaaccttcagtagctactgaatgagctcggtttcccaggctccagggaaggggctggagtgagtagtagatatacagtgtgatggaagtcagatatgttatgcccaatctgtgaagagcaaattcaccatctccaaagaaaatgccaagaactcactgtatttgcaaatgaacagtctgagagcagagggcacagctgtgtgttactgtatgtgaggcaccaggtaagaggacatcagtgtgaacacagacacagtttcctgcaatgacaagggaggaggctgggctaaaaggggcactcaggacccactgaaaacgggcagctctagggcaggtacagatggttatcatgggctgctttccttcagggtctgtggcctcctctgcatctaccagttcccctcggagcctctggacatttatgtttctgtggccacccctgacatctctggattagaaaagtttattataggaagaggaaacattctcatttgtcccaaagcagatgtaagtaatggaagcaaaaaatgcacaggaggccaggcggggctgtagatactgtcaccccagaatgtcaatctcaccactagtactggagagggaagggagtttgatggaccttccctaacaaccctgtggtccaagataagtccaggaagaccattggtgcctcccagagcacagttgtccatcagggatgtccaatgcgtcccagcagcagccatgcctcagtgtctccactgtgcacagccactgtctgggaggagctcccaggatgggtgtctttggcacacaccaggtggcgggtgttagagtgcagtgcagcagctggctgcctgttctattgggctccctgatgctggagagatgggaggtgcattcgcagggccagcaccctgtttgtgaatttttatataaaaaccctgattttacttcatttttgcagatgacatagataactaaaaacagaatctgcaaagaaattgtaattttcaactttaccccaaattcattgtttcttaattctgtgcaagatccagacatattattgccttcctcatgataatttattctatgtaaaaccgaaatcattttttctcctactctttgtttctgttcaagtacagagatcttgagcaaagtaagttgggttctttccacacactaaccctcaccttccccagagaatgagcagagattgtcctcagtctgagtctaagggaggagctgtttctggcacaatcagagcctgcagagacccccaggtgcagcttcagtgaagtcagacatttctccatgtgggcgacctccagtgcctgtgactgctgctcaggcctaattgttggttaagtattacgacaccctttaggtgatcacatctcaagcctattctgaaaatcaccatgaacagagatagttcaatggccattctcctgacataagtttctctttattacttggttccaagtatggagaaaaatgtgaccctatatttgtctgaatccaacatcagcatccacggcattacgctaggagactcactaattgagcacaagtgagctcgttattctcatagaaatgtaagtatttggaaatttcagcgtgttctccagaacctgtggctgccaacaactgtatttctcggtgcactcttggcctggtgaagccttcacagaacctctccctcacctgtgccatctctgcattctccatcacaaccagtgtttccttctggagctgcatccatcagcgcccccatgggaggtactggagtggatcgggtgcataggtcatggagggagcacagattactcccctcttctcaagagtccagtcaccatctccagatccatgtccaaaaagtacttcttcttacaggtgaactatgtgagcaacaaacacatagccatgtattttagagcaaaagacacagtgaggaaaccacagtgtgaactcatacccaagcctccctgtgggggtgcataggacagccagggttactcaggacaccaggctccctcaggacaccaaggggcactcaagaccattgtagaggcatgcaggtagctgggggctctcaggaaccatgggggaaaatcaggacaccaaagggtgcttggtacagcagggggctcaggattattgtggggattcagaaagagcaggttcaaggctcaacctcagggcatgtgcagctggtgtgaaaaggggctggatgaggcgttttgtgtcaccatcatgtttcaccaccagacaccctccactacctctattctaatgcatgtgtttgtatgattagaaaatgatattgatataaatatataaccatagctaggtgtgtcaagttgtcctctccatcttatatcagccttgtctgtaaggactaattccccataattacttgagaacctcataaattgtggtcaattatgtaggattcctctctttttctgccttccttcctccctccttctctctctcacacagaaacttatatacagccaccccacaacacacataaatctataacttttattacctgatgtattgataagtaatctaaagttacataaaaatcagtagttcactgtcaatattgtaggagaagggaaggtctaggaaggaggaattacagaacaagaggatattttgagggtaattgacttgttatctatgtggataatgataatgtctatgaccatatttgtaaaattgaacacttcgtgtggagactattatttttttatttaaccccatgccattattttgccgtattctagcatttctctaaaaatacagaaatgttcagcactcattcatgtgtatattcaggagtttctgacttttcatgtattttatttatctctgtctaattgctttgataccaaattttacctagtataattagtactacctttagcactgattataagtctcactcctccatcatctccttttttgccacacaagctgaatctagtttggactcataggagctgcttcattcaatgccagtgggagtttcaaaccctatcaacccccctataaactgtcattaagaaagtttatcaaactccaccagtcatgtgatattagttcgttttcacagtggtataaagaactacctgagacgaggagtttacaaagaaaagaggtttagttgactcacagttctgcatggctggggaggccacaggaaacttataatcatggtggaaggtgaaggcgaagcacggcacatcacacagggcagcaggagagagagggggaagtgacacatagttttaaactatcagctcttgtgagaactcactcactatgatgagaacaacatgggaaaactgccctcatgatccaataacctctcacctggtccctcccttgacatgtggggattagaatttgagatgatatttaggtggggacacaaaacaaatctatagcacatgtccagctgtgtcctggagttgtttcagggatccagtgtgtactgttgatagaaacagtgatcatcattctagctggtgtgagatggtatctccttgtggtttagatttgcatttctctgatggccagtgatgatgagaattttttcatgtgtcttttggctgcataaatgtcttcttttgagaagcgtctgtgaaaaaaaaaaagaaacagtgacaccaagctcacaccatccgttgtagttgacaacatgcaaagccaagagatctcaactgagatttagtgtgtgtgtcatgtctgatgaagtcataagctcagagcaagtgaatatggaaaagtgtattatctgcacagtgtaggtgtctgctgagtgcagggcaggtctcgcaggaaaatctaaaatggcttgaaagaagaggaaaggagactggctcagggtttttataatggtttagtggtggtggcacagtgaggcttcccactcacagatcggggtttataaggtttgaaactcccactgccattgaatgaagaagctcctgtgagtccaaactagattcaccttgtgtggcaaaaaaggagatgatggaggagtgagccttaagtaatcaacaggcatgcaccaaaagatagagcgacaacttattctaggtagcaagaataaaaataatgaaaaagaaataagggttcagtatgggtggacaagacccagatctacagaaatgagatgactttagaaatataaggaaataataatgagaaaaagaaggaggggatggggaattagggtcctggcctaatgtcttgggtagaagcttctcacaatcaaggactatcagcttattctgcaggtcttgggtcacacgtctgcttaaaaacatcagaaatgccaggcaatcaatgaggatgctcagtttagcatctcctatttgagtagatttacagttgtgtggaattcttaattgattctttttggtttgtttttagaggcaggctctcacactgttccacagcttaaagtacagttgtgtgatcatagctcactgtaattttgagctccggactcacgtaatcttcctgtattagcctcctgaatatctagaattagaggggaacgccacccctcacctgcttattctttaaaatattttttcatagaaatagcatctctttatgttgcccaggttggcttcgatttcctggtctcatgtgatttccctcactttgcttctgaaagtggtgtgattatagggaagatccactgcatctgtcctgaattgattcttcagttgtaaaacatgaagccaataattaactgcctgactgttttgtgcagtgagttagttaaaagtttctgataagattccttccaatatgattcaagagcagtattttctgctgatgttcctttcagtttccttgttgaagatcagaagacactgcggaaaagatgtagtaaaaaggcagttttaactcttcatgattggagtggatatcacataggaatccctttccgtattttgtaacacatgcatgcaatagaacaaagatgatcccttggtgtaaaatctataaacgtatgggccttttagctaccaagtcatagggtaataactgatggaccctgaggagtgaaccatgattccatagtgctagtgggagaacccttggccaaggaagtttacattttattaaaattgataatttttatgtagcgatgccattttttaaacattcccagaaggttgtgagtgggattgactctgtcttctgtgaacaatgacagtgccctccatggttagataatattttaaactagattgagctagagtggtttctgtattgaatcactatatttttttagcttcatgttagctttttgtgtgttagcatttgctttaaaatgatattaatcagccctctagtaggtagaaattcatctgagggtttcttcccttgttgtccatctcaataggatttccagaagacgtaagaaccctctctgtttctaaaaatattccaggctgggcgctgtggctcatgcctgtaaacctagcactttgggaggccgaggtgggtggacccctcgaggttgggagtttgagaccagcctggtcagtatggtgaaacctcatctctactaaaaatacaaaaattcgccgggcatggtggtgtacactcgtaatcccagctacttgagaggctgaggtgagaggattgcttgaaccctggaggcgggggttgcagtgagccgagattgtgccactgcacttcagcctgggcgacacagcgagactccgtctcaaacaaaacgacacaaaaaattccaaagttgtgcaccctctaaaagcatatgtacttaattctcatttttaatttattaaacatctctaataagttcaatgtttcctgccttctgagttgatttcctaacacatagaagaatatatcctaaatgaaagtttgtgttcttaatacaaattactagttaataacctttacttttattattgaggtattatacatcaatgttaatcaatcctctcaatgggactcttacctaaagaatatataaaatattttcctgatcatgacatataatagatgtgaacacattcttagcattcagccatgtctcttgtctattaatattataaaccacatgctaactttgattttattggtaattgttctaatttcttttttttcccacttctctggttgttttttttttaactttaagttttagggtacatgtgcacaatgtgcaggttagttacatatgtatacatgtgccatgttggtgtgctgcacccattaactcgtcatttaacattaggtatatctcctaaagctatccctcccccctccccccaccccacaacaggccccagtgtgtgatgttccccttcctgtgtccatgtgttctcattgttcaattcccacctaggagtgagaacatgtgttgtttggttttttgtccttgcgatagtttgctgagaatgatggtttccagcttcatccatgtccctacaaaggacatgaactcatcattttttatggctgcataggattccatgatgcatatgtgccacattttcttaatccagtgtatcattgttggacatttgggttggttccaagtctttgctattgtgaatagggaattgttctaatttcaaactagttaatttttatcttcatgcagctagattattatgtgtggctatttattccgagagggataaagacaacattaacaattttcactgcaggcatgtctaggcaactccctgtgcactatgaccctggggcgttggagattctatggggactcttccctacctgcctaggagagttctctgccttctacctctagcattttcctctttgaagaagtacatctaactgtcattagaatagagacaaagacaagtcttaactgcttccagctgaggagggatgctgtttggggaagatctctcttggaggtctaagggaccccaggaaaagggagccattatcccaggcttcagttgcatgaccatttggagtttgatggtctgaaaatgagaagaggcaaatctggttattagaagacatgtatgaaaaccaaacaaggtggcaaggacagcttgaaagaaaattccaaggctgctgacattcctagataactgcagctgtagttatgcctgctaaggtttgggcgcatggggcttggcttttgtcagctccctgggatttattttcccaaacaaagaaacctccaggttaggggcaccctattcattcccatcacctggcatgatttaaaggataattgcttagaattaaaatattgatccagattttttatattccccatcgctttttgtttcttctgggctgtagccagagatcattgattggcgctcaggaataagcagagttagtctaaaatgcaggcaaatacttaaacaactgaagagattagaatttaaagacaagtgtatgatatgttttgaaatacaatgtttctctttccagttttggtttttgtcggcagcaaataatgataagactgagttgtttgcaaaataaactttagtcttaaacttggcctgattatttgcataaagtgcagcaagaatattaataataattctgtaggaaaagcctgcaagcaccaggagcttcacagtctaacactatgagcacgtgcatcctcacgcaactcactgaatatttccaagccagcctgttccgatcttaaatgccatccagtggcatctgccccaggtacactaatacatgggtcctgcttctctctgcagcctcctctctcctcagatttcaggttttgtttattgtttgttttctctctgacatcaacacagatatgttgaaggttttcttttttttatttgtagttgttcagctttgttgttaatgaggtcagaataagctcatagtttacacatttttacattcccatgccgagtagctgcttttctctatcaaatccattaactgagagaacaatcacatttcgttacaggtgaacagttaaatagtttggcatatatttctgtgctggaatctaatgcagcttgaaatcaagtcatgcctcactcattgaaaaaaacatggctaaattctcaaagaattgtgctgagtgaaagaaactaaggaattaagagtaaattttacatgatacatttgtagaaattttagaagatgccactattataaattaacatggagaagatttaaatgtttctgagaatatgctattgggagtaatggggatgtgagttaaatttcagaggaataagagaaagatttagggattaattttttcaaaccttgattgaagtgctgagtaaatggttgcaaacataggtctacatttttcaaatcattcaccataaatttgaattatttattaattacactcgaataaagcaataaagaaactgatgagataatatttgactgaattgcatcaataaatagatcgatattaacacaaggaatataactgatttccaaaaacatacacatgaaccatggttcactctgcgtatttagataaattacagaaagttgtcataacagatggggaatcctgcagacttcactaggcatgggccatgctgccctggagttgtctcaggggagctgcctcctccagaggttagagcacaggcccaggtaataggactaaatttttagatgtgttatcttagacacactgcacaactgctgtgttctctatgtaaattatctcctgtaaaatataacattgaagcctgcattaaatatattgtgtaaatatgtaagaataaaagaaagttatgagagctaagtgttaatcaaggcacaagcatataagatataactatattttcctgaatgatggaattactaccagtctcccccaggacacttcatctgccctgagcccagcctctcctcagatgtcccacccagagcttgctatatagtgggggacatgcaaatagggccctccctctactgatgaaaaccagcccagccctgaccctgcagctctgggagaggagcccagcactagaagtcggcggtgtttccattcggtgatcagcactgaacacagaggactcaccatggagtttgggctgagctgggttttcctcgttgctcttttaagaggtgattcatggagaaatagagagactgagtgtgagtgaacatgagtgagaaaaactggatttgtgtggcattttctgataacggtgtccttctgtttgcaggtgtccagtgtcaggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatggaagtaataaatactatgcagactccgtgaagggccgattcaccatctccagagacaattccaagaacacgctgtatctgcaaatgaacagcctgagagccgaggacacggctgtgtattactgtgcgagagacacagtgaggggaggtcattgtgcgcccagacacaaacctccctgcaggaacgctggggggaaatcagctgcagggggcgctcaggagccactgatcagagtcagccctggaggcaggtgcagatggaggctgtttcctgtcaggatgtgggactttgtcttcttctgacagttccccagggaacctcttaaatttagaaaactgtgcctaacaatgtcttctctatgcatatgaggaccttttctccctggcacaaaatgcagattgacgctgacacggatgaaaattcctcaaccatggtcacaaggatcagagtcctgagtaacctcagggcttcctggtgattcttctccaatcagacccaggacagggacctccgtgagattccctgactggaacagtctttatggatcctggtcacagacaatagagaggctgaaccagggtcagcgtcatgtagaacgtcacagatttcacgtctgatccttctcctgacacgaaagtatgcaaatcagtatcagcaccgatctggtgcttcttttgttcctaatccatttactttcttttttcgtcgtttttctcctttttccatttgtttttcctgctttttgcaaaaggaagatgttttccctgtgagatgcaggggatgacaattttgggagatggctggaacatccaatatcctcagggccgaccatcagtaagtgcaggctagaagtctcagaaagagctgaagctgcttaatcaccgtggagttttaccttctccagttctgctctgatggaatcagggccaagcaggttatcaatgataatctacctaacatagagtcaactgattccagtttcaataacgtctgttaaaaattcacaccaccacctggattactgttttgtcaaatcaatacacagtattgtccagctaagtagacccaaagacggaccgttgcccatggagaaaaacattaacctgagttctaggttcttacagtgttaaaggtgtaaaactgattattaaaaatgaggctatttttctttttgctgttgagttgtagaagtttcttttccattttgacatgaaaactttttcagatatatggcatattatccaattctgtaagttgtagttattttgttgctttgcagaatctttttcataatctattcccacttgttcaattctgcttttttttgtaggtgatttgaatgtaaaatcctgaaaaagattgctaattttttgagtgttgagagttttacaattagaggtattacagttagatatttgaggcatttggagtgaatttttgtgtttattctaacctaaaattcttaattcttttcatgggaaaatccagttttcataccaccctctttggaagacactacaatttagccatgttatattgatggttctcatgctaaaaatcagcttgtcatcaatatgtgggtttatatctaagctctatataggtatttaagccaaaactttctatgtttttaataaatgttgaggcctggaagtgaaatgcctaaagctttcttcttgccttgttacagatattgtaccaaaatattctaaccttttactattgagtgtaataatagctgtggcctttcttaacggcttttattatgttcaagttgttttcttgtcttcctactttgttcatagttttaataatgaaactgatttttttcaaagtctttttctgtgtctgatgaaatgttactgagatattttttctttagttttttaatgtgtaccaaactgattgatttgagaatgttgaatcaagtatgcatctcaggaagaaatttgagttggtcatggtgtatgtcttctaaaacactttggagcttagtttactattgttggggattaattcatgtctactaatgatattggtctgtagtttcctttattgtggtgcctttgtctattactggtaatactatcatggtagtctcatagaaagagtttagaaggtgtatggcagactacctttaaaatagattttatcagtggagaaatggtgatagttttttcttcacttttctgttgggaagaattttatgttgtttaaaagatattcagaatgacttaacctggtttatgagctttcattctattcctttcttccattctttttgaagaactgcttacctttcctatttatttttaagtttgtttttagacatatgcaatacattttgaggtgaaacctggtggaattttttccaataaattagtaaaaataaatcatttaattgactattttattcaggttgatttgtttaatatttgctaaaggccagttctttaagctatgacacataataaatcccaaatggcagtacctcattgtttacttagcttttgtacttatatttttcagaggaagaaccactactgtaaattgtaaatagccaatacataattgtattgtatgcaaatctgtgactgtttacagtgtcatctctgagaaacataaagtttatttactatatatatataaagagtttggaaggtggactccaccaatttttgaaagagttacagaagggctgctattacttctttaaatgttaaggttcattttatgatgtaacagataacctatcatggagaatgttcaatgtgttcttgagaaggatgtgtattacgtgactcttggttggaaggttctgtaaatatcattcagataaatttgttcaatagtgttgttcaagttcagaggcacattgagaattttctttctggatttgctaaacattatggtcatgaggtattaaggtcttgtgttatttttgtattgttttctatttctttatatctcttacagtttgcttaatgcagttatatttgtatttgtacacatgtgtaaaaacaaaaatcataattgctaaatgagttttatggcacagtcacattataagtaatatttttccaaatgctaccattgccactaaagtcctcctggagtctgacgtctgctctgggcactgccttcttctcaggcgtcccacactggagcttgctatagaggaggaggcatgaaaacagggccctccctctcctggtgaaatcaagcccagacctgaccctgcagctctgggagaacagccacagccctgggattcccaggggtttccatttggtaatcaggactgaacacagagaactcactatggggtgtgaattaagctgaatttttcttgttggtattttaaaaggtgactcctagggaactagagtgagtgagagtgagtggatatgagtgagagaaacagtggatatgtttgccagtttctgaccaggatgtgtgtgtattttcaggtgttcagtgtgaggtggagctgatagagtccatagaggacctgagacaacctgggaagttcctgagactctcctgtgtagcctctagattcgccttcagtagcttctgaatgagccgagttcaccagtctccaggcaaggggctggagtgagtaatagatataaaagatgatggaagtcagatacaccatgcagactctgtgaagggcagattctccatctccaaagacaatgctaagaactctctgtatctgcaaatgaacactcagagagctgaggacgtggccgtgtatggctatacataaggtcccaagtgaggaaatatcggtgtgagtccagacacaacatttcctgcaaaaagaagaaaggagtctgggccgaaggggacactcagcactcacaaaacaggtgcagccccaaggcaggtgcagatggagggagggtaagggctgctttccttcagggtctgtggtttcctctgcttctaatatttcccctctgaacctctgtatatttatgttttgtgcccaccatgaggtccctggattagaaaactaatttaaaagaggaaatattctcatatgtcccaaaaacagatgtaagttttggaggcataaaaatgcataggagccgcgtgagtctgtagacactgccaccccacaatgccagacccaaaactagtgctggagaagggtgggagtttgatggagcttccctgatgaccccgtggtccaagctaagtccagcaaggccattggtgcctcgctgagcacagttgtccatcagggatctcccatgtgtcccagcagcagccatgcctcagtatctccactgtgcacagccatcgtctgggaggagctcccaggatgggtgtctttggcacacacaggtgatgggtgttagagtgcagtgcagcagctggctgcctggtctattgggctcctggatattggagggattggaggtgcattctcaaggccagcacgctgtttgttaatttttgtataaaaaccatgtgatttaattcattttctcagatgacatagataattaataacacaatctgcaaacaattgtaattttcaactttaccccaagttcattgtttcttaattctgtgcaggatccagacatggtattgcccttctcatgagaaattgttcgacctaaactgaaaccagttgtttctcatatactttggttctccccacatgcagagatcttgattagagcaagtttggtactttccacgcactcaccctcacctccccagataaagagcagaagttctccttagactgagtctgagggaggagctgttcctgtaccactcagggcctgcggagacccccaggtgcagcttcactgagtcaggtgtttcactccctgtgattgctgctcaggtctaattgtgggctcagaattaggacagtcttcaggttatcacagatcaatcatattctaaaaatcatcattatcacacaccgtggtaataattcaatgttcatttttctaaacagcagtttctcttttttatttggttgcaagtttgaggaaaggagcatgtgataatactttttaatctaacctcaaaatctactgaattgttctaggagactcacaaattggacaagagtgagctccttgtgctcataaaaaatgcatgtatttgggaatttcaccgtgttgtccagaaactgttaacatcaacaactgtgttttccagtgcacttctggcttgagacatcctcacagaccctctccctcacctgcactgtctctggattccccatcataaccagtgtgtcctgctagaattgtatctgcttgcccctagaagatggacaggagtggatcaggttcatgggttgtaaagggagcaaaaattacatcccacttctcaagagtccatatccagatccaagaaacagttcttacagctgagctctgtgcccagtgaacacacaactacacattttgaagcaaaagacgcaatgaagggccttcattgtgagcctagacacaaacctccctgcaggggtgaataggagcagcagggggcattcggggcagtatgggggcttagcatgattgttgggggtcaagatgagcaggatcaaggctcatcatcagggcaagtgcaacagggcagaaaaggggctgtagatgtgggttgttctcaccatcatatttcaccaccagacaccctccactacatctcttctaatgtgtctgagtgttgatatgattagaaaatggcatttatgtaaatactaatgtatacccaaatggaggtgcatccagttgtcctctccatcttatgtggaccttgtccatcaagggctaagttcctgtatttacttgattacctcatacattatggtcaaaacaggtagggtctcattttggcatggtctctcctcctcccttctctctgtcgcacaaaaacacatgaactgacacacacagagcttcccaacttcaattatctgatgtattgaagcaaattgattagtgtgcagcttttctgctttgcctgctattcatgttatgtaaaaataagaaccgtgtgtttctcagcttgttacttctctaagctaagtagcatctttgtttattatacccagagaccaaaagcgattcagctgttattcagcagcttaactggtaaacaaattgtggaaaattcatttactggaataatacccactgttacaatgaagtactgctggatacactcagtaccatgcttaaaataacaagtacctgaataagtaaaataagtcaaacaaataaaagtgcatacatatgattccacttctataatttctataaagtaaaaatgaacttaaagttacataaaaagatctgtagttgactggggacatggtacaagaagagaaggtatagaaaggagaaacgacaggagagcaaaaggaaatttctaggataattttttctctgttagtaaaagtgaggattatgtcactatttgtaaaattgtccactttatgtaaaggttcttatttgctaatttcacctcattaaaatattgcaaattttaaaatatctaatttggtagaaaaggtagtagagagagatgaataaaatacataaaattcagagagtcctgaatacacacatgaatggaccctgggtctcactgtacttttagggagacactagaatacaaaaacataatgacaggatttcagtacatgaaaggagcttctcagaccccaggaggcctgtccaactgcgtctgggagttaactcagggagcaggcatgtcctttggaaggagcaatgacaccaagctcccagcatccattgtagccgacaccatgccaatgccaagagatctcgactaaaattttctgtggatgttgagtgtgattatgccacacactcacaccaagtgagtatggaaaggatagttacctgcatccttaaggtgtctgctgagagcagggcaggtctctcattaaggtccaaagtggcttgatagagcagggaaggagactggctctgggttgttatcatggcttggtggggagcggggcagagcatcctacttgcaggaagggttttgtggggtttcaaggtcaaattggcatcaaatgagggagctcctgtgatttctaactagatttaccttgtatgcttaaaaaaagagatgatggaggaatgagcctgaagttatcagcagtcaggcctaaacacagagtctgatgacttactctaaatagcaagtatacaaatgatgagtaagaaaagagacaagactccaatatgggtggacaacagccaggtctgcagaaaatgagaagactgtttataagcaaagaataatgagtaggatatggaggaggattctggtccaatgtcttgtgtggaagcttctcatgatttgagatcatcagcttattctgaaggtcttaggtcacctgtcttcttcaaaatatcagaagtgcctgatgatatgtgaggatgcacagtttaacttcctctatttgagtagctttacaattgtgtagagttcttaattaattaattttttttttggagacggagtctcactctgttgtgcaggttggactgcagtggtgtgatcataacatagctcacggtgatttcaaattcctggctcatagaatcctcccacctcaacctcctgactagcaagtagctaggtttccagggcccttcatctacacttggccggttcttttcattctttttttttttttttaggtggagtttccctcttcttgcccagactggagtgcaatggtgccatctcagctcactgcaatctccccctcccaggttcaggtgattctcctacctcagcctccagagtagctgggatcacaggcatgtgacaccatgccccgctaatcttgtatttttatcagagatgacatttctccatattggtcaggctggtctcaaactccctacctcaggtgatctttccacctcagcctcccaaagtgctgggattacaggcgtgaggcaccgcaactggcctcttcatttttattcatatgttccttcagcagccactatgtcttcccactgatttcttcagtttctgccttttccttttgaataaggcattattcctaagggaagtcgggaggtgggcctggacagggacttggtgcattcctctctcccgtcccagttcttattggtttctccagtggctgtagaacagcagttttgatggctttacctctgcagataatttctcttgcaatgtagtgctgatggggaggtgtgtctggatgcacttcacctatagttgctgttttgctttcccagacagcaccatcccaaggggtagagggtggagcattttgtgatgtatccccagtactgaagaaaaaggcttcaatagcaggaggaattcctcaactgtatacactctgagaatttaaacaataacttctctatcatactcaaattgaaaccatccaatgaatatgtctactttaatcgtgtgctaacttaaatggcatttggcagcctctgtgccagaaaagattatcatctgctcctgtttatttccctgcaagtccttatctctcttcagatttcagatatattgtttgtcctataacatcaaaaatttgatgtatatgtgctaatttgcagatcagtaagtttagtagctgttgtaagaataataacatatttttatggggtgcttacatctccaagctgagaagcacctctatgtgtaatactaagaaactagaaatgatacaaatatcaagaagatacatagataaaaagtaatggcatgctaatttactgtaataacatccatcatgagaatcaatacattgttgatgctcaacatgtttgcatcataagtagttatgtgcgagaagccacacaaatagaacacatactatataattcctgtataattcttgaaactcaaaactaaagcattaaatatgaaggactgactcagaatatggtggggaagaaaatatttgggaaggaggaattgtagaggaacacaaggaaacttttaagtgtaatttgtttgttcattatttggatggcttttggggatgcaaaggtgagcacgagtggaataacattttgttttgtttgtttgtttgtttttctgaagagatgtggtccttctctgtgacccaggctggagtgtagtggtgggatcatagttcaatgtagcctctaacttctggtctccaacaatactcctgcatctgccatctaagtagctggaactaccgttgtgtgccaggaggtttggcttggcttgagtacttattaaaccacacactttttgcaatatttaatgtatagtaataatgtctcaataagactattacaaatcaatgaatgaataatttgttcagtacagattcatggaaaaatagacactaacatgatgagtgtctgacatttatgaaaatacagctgcatgaaatgtgcttctctttacattcattaggtaaacacaatagtgcatacacatcacaccgtgctttcattacaggaagaaagttctgaaaatgtcactggggtgaaccacacggtgctgggcttggttcagggagcagtcaggcccagtgttgtgaccttcaaccacagaatccttaaaaaaaaaaaaaaaaaaaaaaagaggctgcctcaaagtccgcatcagttcccggactcgctatgtttctggatcgtatcagtgcatccggatctccctggtggctttagtgattccttgcttgccatgctgaggtctcgctgtagattatgttgggttttctaagaccgttttgctattgtaagatccactccctgggacagagcgattccctctaaacctgatagaggttctgaactaaaaataacattaagtgaatcctggtgtgtctgaactcaagtgattgttacattaagctgctgttccaatctgtttcctcacctgggaaaagaggagccaggacatagtgagttgaggccccaggaagataactgaattctcagagggcacagccagcatcctcctcccagggagagtctaaaagactggggcctccctcatcccttttcacctgtccatacagaggcaccacccacatgcaaatctcacttaggcacccacagaaaaccaccacacatttccttaaattcagggtcctgctcacatgggaaatactttctgagagtcctggacctcctgtgcaagaacatgaaacacctgtggttcttcctcctgctggtggcagctcccagatgtgagtgtctcaaggctgcagacatggagatatgggaggtgcctctgatcccagggctcactgtgtgtctctctgttcacaggggtcctgtcccaggtgcagctgcaggagtcgggcccaggactggtgaagccttcacagaccctgtccctcacctgcactgtctctggtggctccatcagcagtggtggttactactggagctggatccgccagcacccagggaagggcctggagtggattgggtacatctattacagtgggagcacctactacaacccgtccctcaagagtcgagttaccatatcagtagacacgtctaagaaccagttctccctgaagctgagctctgtgactgccgcggacacggccgtgtattactgtgcgagagacacaatgaggggaggtgagtgtgagcccagacacaaacctccctgcagggaggcggagggggcgggcgcaggtgctgctcaggaccagcagggggcgcgcggggcccacagagcatgaggccgggtcaggagcaggtgcagggagggcggggcttcctcatcagctcagtgctctccctcctcgccagcacctcagctgtccccaggcctcctctttctttattatctgtggttctgcttcctcacatccttgtggtaggaaaggaaggaggaaggcaaattttcctcttacagtcaaagtgtcactaattactaggaactttcctacaagttcctgaatgtcccatttttccttcttaattaaaaaaaatatatattctaatacttctcaccatctcttgatttgtgtcatcagttgaattgtgctgtctttgaaattcaaatgctgaaaccttaaatccaattgatctatattggaattttaaggatggaattaaggttaaatgtgatcataagtctgagattctaatgcaatagatctgttgtctttataagaagtggaagagtcaccagagacctctcacttttcccgtgcacgcagagaagaggccatgtggagacatagtggactagaaggtgcaagccaagaagaagccgcaccaagaaccaaccctgccagcacctggaccttggacattcagacttcagaatggtgagaaaatcaatgtttgttgtttaagccacccactcctgttgtcttcttatgaagacccagacagactaataccacataactctgttagctcctggagggagaagcagctccctgaggctgggcacatctctcagatatccatatgaagtaggcagaaatagtagttctcatataaaaatgtgtcatggccctgttggccatttttttttgacggagtctcgctctgtggccaggctggagtgcagtggtgcaatctcagctgactacaaaccccgtctcctgggttcaggcaattctccttcctcaacctcctgagcagctgggactacaggtgtccaccaccatgccagcctattttttttttgtatttttagcagagacagggtttcactgtgttagggtggtctcaaatctcctcactgcatgatctgcctgcctcggtttcccaaagtgttgggattacaagtgtgagccaccgcacctggcccctgttggccattcttggggcaatgtctctgaaaccagccctggtgcctgtaccacaaaattttcttttatctttcatgtggatataacaaatggacaatgaggaccagctgcatggagactgaccactgaacatcttctgctgtctcctaagtaagtcacaggaaaacacaccaacatcaccaacataactgttttccttcaacttcctcgaacgaactatagaaatgatcccttaaagtatagtctattccttcaactttctcaatttgcactgaatcccttcctaaattaggagctacatagggtctgagttttgttccctttctcccagtcttccccaagtatcaaggacagaatagatttaaattaaatttggccgtccatgcccccaacaccacatcggtttctaacatccttgtcatgtacccatccttctgtgggcaccccacatcaggttggccaggaatggccagaaggtgtcatcaccttatgggctgaggctacaagttatacacacgtgtgatttcagtcacacacactctactgcaggacacacctgtgttctgaggaactcaggcgcctgctgatctcaggtcttctctaataaattacacacctcttatgaatgaaggtccagatggccccatcagctgcagagcagtggattaaagctcatgggtgggtcagtcaggcagaagtcagacaatgggataatagaagtcagacaatagtcactgaggttcccaatgtattttaatggaataaaacaatattagcaacaaaggggcagtaaagaagactggctcttgaaggtatttaaggaccaggaactttatttggggggaaagtgagagacacttttacatggaaagccctaaagcacatacagcagctgacagagtggccactgtgcacatgagggctgaggagacggatgataggttacgttgctccaagatgtccctgggtgtgtgatggttggactcctcatgcatatgaaaataagagctggactcagggagaaacaagggccataccccatagaaaaggaagaaaaaaagcagatgggcacccctggagagagctcattagatttggtaggtttgagatgaaaattacttccaaaggttttaatgttctaagctaaatatgaatctcttcaataaagtgagaattaaaagaagaatggagctaggagttgagagaggaaacaaattatgagagagcagaaagcaaatccacccaaactgtcacatgacagaggccagaatggagctgatgcagctacttcactattctgcagacctagttgaccatgtggagaaggggttcgaacaaacggggatgttctccaaccttccaaaacaacctccttcttatgcatatgcagtaatcatgattctcagggtggccttcccaagtttcctgttcttacctcttcccccaggggtagagtgtcttttccaacccacagtggtttctctgccatgtcctcagcttctcctccattgtacttaacctgaagattaaggatttcatctggatggagtttcctgggaatcctctgttttctttggtttctgatgaccacatcacaggccataggacacaggttttagtggatttcccctggagacagtggaggtgaatccaggcgttccacagtccttaccgttcttctcttcctgtcagcaccgcaggacagcagataagggagctgactgtggatttttcagatccccgggaaaaagcctgcaaggactaatagtttcacatctaacaccattagcacatgcatccaaaattaaaaaaaaaatcctcactaaatatttccaggttagcctgttcctctctcaataccataccgtggcacctgccctgggttcggtaacatgtgggccccagtcctctctgtaggcgtctgcctcctcagatttcagtcctcttttttgctccgtgaaagcaactcagatatgttaaaaggttttcttcttcatttattcataatttttcaggtttgttgttaatgaggaaagagtaagatcatggtttcctcatttttcacattcccatactgagtaactgctctctctctatgaaagccagaaattaagagaacaactcaagtatccatatccattacaagtgaatgttagacaatttgatgtatgattatgaactaaagtacaacacaggattagaatccaggcatcctcattctcataaaatcatggctgcattcacaaataactgtgctgagtgaaagtagctaacaaattaacagtgcacttcataaacttctatttgtataaactgcagaaggtacagctattctaaagcaacagagaagattacatattggtgggaactgggttttgaaagtaatggggtggtgagatgaaattacagagaagtgacacaaagatttaggtgtgaattgtacacaaattaattgaagctctgattaaagggttgcacacatgttaccattttccaaattatgcagtatatatttgaattaattattaattgtatttaaataaagcagtaacaaagaaacaaatgaatacatttattgaggtggagccaaaactaaatgggaatgaacactcgaaacatctctgactcttgaaaatacacaagcgtgaacactggttctctctatgtatttcaggtcaatagcagaatacactaaaagaaaacagagatgtcctggcaggggtggaatcctgcagacctcactaggcatgtctcacactgccctggagttgtctcaggggagcagtctcctctagtggtcagaggcacaggccgagataatggggctaactctgtccagctgtgtgaccttgaatgcattgtataaacactctgttctctgtgtgatttatcttccttaaaatgtgacattgacacttgcattaaatgtattctacaaatatgtcaaaaagatgatgactgctaaatgattatcaaggcacaatcatataatataatgatattttcctgagtgataagatgactaccaatctcccccagggcactttgtctgctctgagccctgcacctcctcaggattcccatcccagagcttgctatacagtaggagacatgcaaataggtttctccctctgctgatgaaaaccagcccagtcctgaccgcacagctctgggagagaagcgccagccctgggattcccaggggtttctatttggtgatcaggactaaagacagaggacccaccatggagcttgggctgagctgggttttcactgttgctgttttaaaaggtgaactagagagattgagcgtgagtggatacccttgagagaaatggtggattatgtctgggagtttctgaccaggatgtctacgagtttgcaggtgtctagtgagaggtacagctcgtggagtccggagaggacccaagacaacctgggggatccctgagactctcctgtgcagactctggattaaccttcagtagctactgaaggaactcggtttcccaggctccagggaaggggctggagtgagtagtagatatacagtgtgatggaagtcagatatgttatgcataatctttgaagagcaaattcaccatctccaaagaaaatgccaagaactcactgtatttgctaatgaacagtctgagagcagcgggcacagctgtgtgttactgtatgtgaggcaccaggtaagaagacatcagtgtgaacacagacacagtttcctgcaatgataagggaggaggctgggctaaaaggggcactcaggacccactgaaaacgggcagctctagggcaggtacagatggttatcatgggctgctttccttcggggtctgtggcttcctctgcatctaccagttcccctcggagcctctggacatttatgtttctgtggccacccctgacatctctggattagaaaagtttattataggaagaggaaacattttcatttgtcccaaagcagatgtaagtaatggaagcaaaaaatgcacaggaggccaggtggggctgtagatactgtcaccccagaatgtcaatctcaccactagtactggagaggcatgggagtttgatggagcttccctaacaactctgtcttccaagataagtccagcaagaccattggtgcctcccagagcacagttgtccatcagggatgtccaatgcttcccagcagcagccatgcctcagtgtctccactgtgcacagccactgtctgggaggagctcccaggatgggtgtctttggcacacaccaggtggcgggtgttaagagtgcagtgcagcagctggctgcctggtctattgggcctgatgctggagagatgggaggtgcattcttggggccagcatgctgtttgtgaatttttatataaaaactctgattttacttcattttcgcagatgacatagataactaaaaacagaatctgcaaagaaattgtaattttcaactttaccccaaattcattgtttcttaattctgtgcaagatccagacatattattgccttcctcatgataatttattctatgtaaaaccgaaatcattttttctcctactctttgtttctgttcaagtacagagatcttgagcaaagtaagttgggttctttccacacactaaccctcaccttccccagagaatgagcagagattgtcctcagtctgagtctaagggaggagctgtttctgcacaactcagagcctgcagagacccccaggtgcagcttcagtgagtcagacatttctccatgtgggcgacctccagtgcctgtgactgctgctcaggcctaattgttggttaagcattaggacactctttaggtgatcacatctcaagcctattctgaaaatcaccatgatcagagatagttcaatggccattctcctaacataagtttctctttattacttggttccaagtatggagaaaaatgtgaccctatatttgtctgaatccaacatcagcatcaactgcattatgctaggagactcactaattgagcacaagtgagctcgttattctcatagaaatgtaagtatttggaaatttcagtgtgttctccagaacctgtggctgccaacaactgtatttctcggtgcactcttggcctggtgaagccttcacagaacctctccctcacctgtgccatctctgcattctccatcacaaccagtgtttcctgctggagctgcatccatcagcgcccccatgggaggtactggagtggatcgggtgcataggtcatggagggagcacaaattactcccctcttctcaagagtccagtcaccatctccagatccatgtccaaaaagtagttcttcttacagctgaactatgtgaggaacaaacacatagccatgtattttagagcaaaagacacagtgaggaaaccacagtgtgaactcatacccaagcctccctgtgggggtgcataggacagccagggttactcaggacaccaggctccctcaggacaccaaggggcactcaagaccattgtagaggcatgcaggtagctgggggctctcaggaaccatgggggaaaatcaggacaccaatgggtgcttggtacagcggggggctcaggattattgtggcgattcagaaagagcaggtccaaggctcaacctcagggcatgtgcagctggtgtgaaaaggagctggatgaggcgttttgtgtcaccatcatgtttcaccaccagacaccctccactacctctattctaatgcatgtgtttgtatgattagaaaatgatattgatataaatatataaccatagctaggtgtgtcaagttgtcctctccatcttatatcagccttgtctgtaaggactaattccccataattacttgagaacctcataaattgtggtcaattatgtaggattcctctctttttctgccttccttcctccctccttctctctctcacacagaaacttatatacagccaccccacaacacacataaatctataacttttattacctgatgtattgataagtaatctaaagttacataaaaatcagtagttcactgtcaatattgtaggagaagggaaggtctaggaaggaggaattacagaacaagaggatattttgagggtaattgacttgttatctatgtggataatgataatgtctgtgaccatatttgtaaaattgaacacttcgtgtggagactattatttttttatttaaccccatgccattattttgccgtattctagcatttctctaaaaatacagaaatgttcagcactcattcatgtgtatattcaggagtttctgacttttcatgtattttatttatctctgtctaattgctttgataccaaattttacctagtataattagtactacctttagcactgattataagtctcactcctccatcatctccttttttgccacacaagctgaatctagtttggactcataggagctgcttcattcaatgccagtggttgtttcaaaccctatcaacccccctacaaactgtcattaagaaagtttatcaaactccaccagtcatgtgatattagttcgttttcacagtggtataaagaactacctgagacgaggagtttacaaagaaaagaggtttagttgactcacagtgctgcatggctagggaggccacaggaaacttataatcatggtggaaggtgaaggcgaagcacggcacatcacacagcgcagcaggagagagagggggaagtgacacatacttttaaactatcagctcttgtgagaagtcactcactatgatgagaacaacatgggaaaactgccctcatgatccaataacctctcacctggtccctcccttgacatgtggggattagaatttgagatgatatttaggtggggacacaaaacaaatctatagcacatgtccagctgtgtcctggagttgtttcagggatccagtgtgtactgttgatagaaacagtgatcatcattctagctggtgtgagatggtatctccttgtggtttagatttgcatttctctgatggccagtgatgatgagaattttttcatgtgtcttttggctgcataaatgtcttcttttgagaagcgtctgtgaaaaaaaaaaagaaacagtgacaccaagctcacaccatccgttgtagttgacaacatgcaaagccaagagatctcaactgagatttagtgtgtgtgtcatgtctgatgaagtcataagctcagagcaagtgaatatggaaaagtgtattatctgcacagtgtaggtgtctgctgagtgcagggcaggtctcacaggaaaatctaaaatggcttgaaagaagaggaaaggagactggctcagggtttttataatggtttagtggtggcggcagagtgaggcttcccactcacagatcggggtttataaggtttgaaactcccactgccattgaatgaagaagctcctgtgagtccaaactagattcaccttgtgtggcaaaaaaggagatgatggaggagtgagccttaagtaatcaacaggcatgcaccaaaagatagagtgacaacttattctaggtagcaagaataaaaataatgaaaaagaaataagggttcagtatcgatggacaagacccagatctacagaaatgagatgactttagaaatataaggaaataataatgagagaaagaaggaggggatggggaattagggtcctggccgaatgtcttgggtagaagcttctcacaatcaaggactatcagcttattctgcaggtcttaggtcacacgtctgcttaaaaacatcagaaatgccaggcaatcaatgaggatgctcagtttagcatctcctatttgagtagatttacagttgtgtggaattcttaattgattctttttggtttgtttttagaggcaggctctcacactgttccacagcttaaagtacagttgtgtgatcatagctcactgtaattttgacctccagactcacgtaatcttcctgtatcagcctcctgagtatctagaattagaggggaatgccacccctcacctgcttattctttaaaatattttttcatagaaatagcatctctttatgttgcccaggttggcttcgatttcctggtctcatgtgatttccctcactttgcttctgaaagtggtgtgattatagggaagatccactgcatctgtcctgaattgattctttacttgtaaaacatgaagccaataattaactgcctgactgttttgtgcagtgagttagttaaaagtttctgataagattccttccaatatgattcaagagcagtattttctgccgatattcctttcagtttccttgttgaagatcagaagacactgcggaaaagatgtagtaaaaaggcagttttaactcttcatgattggagtggatatcacataggaatccctttccgtattttgtaacacatgcatgcaatagaacaaagatgatcccttggtgtaaaatctataaacgtatgggccttttagctaccaagtcatagggtaataactgatggaccctgaggagtgaaccatgattccatagtgctagtgggagaacccttggccaaggaagttcacattttattaaaattgataatttttatgtagggatgccattttttaaacattcccagaaggttgtgagtgggattgactctgtcttctgtgaacaatgacagtgccctccatggttagataatattttaaactagattgagctagaatggttgctgtattgaatcactatatttttttagcttcatgttagctttttgtgtgttagcatttgctttaaaatgatattaatcagccctctagtaggtagaaattcatctgagggtttcttcccttgttgtccatctcaataggatttccagaagacgtaagaaccctctctgtttctaaaaatattccaggctgggcgctgtggctcatgcctgtaaacccagcactttgggaggccgaggtgggtggacccctcgaggttgggagtttgagaccagcctggtcagtatggtgaaacctcatttctactaaaaatacaaaaattcgccgggcatggtggtgtacactcgtaatcccagctacttgagaggctgaagtgagaggattgcttgaaccctggaggcgggggtcgcagtgagccgagattgtgccactgcacttcagcctgggcgacacagcgagactccgtctcaaacaaaacgacacaaaaaattccaaagttgtgcaccctctaaaagcatacgtacttaattctcatttttaatttattaaacatctctaataagttcaatgtttcctgccttctgagttgatttcctaacacatagaagaatatatcctaaatgaaagtttgtgttcttaatagaaattactagttaataacctttacttttattattgaggtattatacatcaatgttaatcctctcaatgggactcttacctaaagaatatataaaatattttcctgatcatgacataaagtagatgtgaacacattcttagcattcagccatgtctcttgtctattaatattataaaccacatgctaactttgattttattggtaattgttctaatttctttttttttcccacttctctggttgtttttttttttaactttaagttttagggtacatgtgcacaatgtgcaggttagttagatatgtatacatgtgccatgttggtgtgctgcacccattaactcgtcatttaatattaggtatatctcctaatgctatccctcccccctcccctcaccccacaacaggccccggtgtgtgatgttccccttcctgtgtccatgtgttctcattgttcaattcccacctaggactgagaacatgtggtgtttggttttttgtccttgcgatagtttgctgagaatgatggtttccagcttcatccatgtccctacaaaggacatgaactcatcattttttatggctgcataggattccatggtgcatatgtgccacattttcttaatccagtgtatcattgttggacatttgggttggttccaagtctttgctattgtgaatagggaattgttctaatttcaaactagttaatttttatcttcatgcagctagattattatgtgtggctatttattccgagagtgataaagacaacattaacaattttcactgcaggcatgtctaggcaactccctgtgcactatgaccctggggcgttggagattctatggggactcttccctacctgcctaggagagttctctgccttctacctctagcattttcctctttgaagaagtacatctaactgtcattagaatagagacaaagacaagtcttaactgcttccagctgaggagggatgctgtttggggaagatctctcttggaggtctaagggaccccaggaaaagggagccattatcccaggcttcagttgcatgaccatttggagtttgatggtctgaaaatgagaagaggcaaatctggttattagaagacatgtatgaaaaccaaacaaggtggcaaggacagcttgaaagaaaattccaaggctgctgacattcctagataactgcagctgtagttatgcctgctaaggtttgggcgcatggggcttggcttttgtcagctccctgggatttattttcccaaacaaagaaacctccaggttaggggcaccctattcattcccatcacctggcatgatttaaaggataattgcttagaattaaaatattgatccagattttttatattccccatcgctttttgtttcttctgggctgtagccagagatcattgattggcgctcaggaataagcagagttagtctaaaatgcaggcaaatacttaaacaactgaagagattagaatttaaagacaagtgtatgatatgttttgaaatacaatgtttctctttccagttttggtttttgtcagcagcaaataatgataagactgagttgtttgcaaaataaactttagtcttaaacttggcctgattatttgcataaagtgcagcaagaatattaataataattctgtaggaaaagcctgcaagcaccaggagcttcacagtctaacactatgagcacgtgcatcctcacgcaactcactgaatatgtccaagtcagcctgttccgatcttaaatgccatccagtggcatctgccccaggtacactaatacatgggtcctgcttctctctgcagccgcctctctcctcagatttcaggttttgtgtattgtttgttttctctctgacatcaacacagatatgttgaaggttttcttttttttatttgtagttgttcagctttgttgttaatgaggtcagaataagctcatagtttacacatttttacattcccatgccgagtagctgcttttctctatcaaatccattaactgagagaacaatcacatttcgttacaggtgaacagttaaatagtttggcatatatttctgtgctggaatctaatgcagcttgaaatcaagtcatgcctcactcattgaaaaaaacatggctaaattctcaaagaattgtgctgagtgaaagaaactaaggaatgaagagtaaattttatatgatacatttgtagaaattttagaagatgccactattataaattaacatggagaagatttaaatgtttctgagaatatgctattgggagtaatggggatgtgagttaaatttcagaggaataagagaaagatttagggattaatttattcaaaccttgattgaagtgctgagtaaatggttgcaaacataggtctacatttttcaaatcattcaccataaatttgaattatttattaattacactcgaataaagcaataaagaaactgatgagataatatttgactgaattgcagcaataaatagatcgatattaacacaaggaatataactgacttccaaaaacatacacatgaaccgtggttcactctgcgtatttaggtaaataacagaaagttgtcataacagatggggaatcctgcagacttcactaggcatgggccatgctgccctggagttgtctcaggggagctgcctcctccagaggttagagcacaggcccaggtaataggactaaatttttagatgtgttatcttagacacactgcacaactgctgtgttctctatgtaaattatctcctgtaaaatataacattgaagcctgcattaaatatattgtgtaaatatgtaagaataaaagaaagttatgagagctaagtgttaatcaaggcacaagcatataagatataactatattttcctgaatgatggaattactaccagtctcccccaggacacttcatctgccctgagcccagcctctcctcagatgtcccacccagagcttgctatatagtgggggacatgcaaatagggccctccctctactgatgaaaaccagcccagccctgaccctgcagctctgggagaggagcccagcactagaagtcggcggtgtttccattcggtgatcagcactgaacacagaggactcaccatggagtttgggctgagctgggttttcctcgttgctcttttaagaggtgattcatggagaaatagagagactgagtgtgagtgaacatgagtgagaaaaactggatttgtgtggcattttctgataacggtgtccttctgtttgcaggtgtccagtgtcaggtgcagctggtggagtctgggggaggcgtggtccagcctgggaggtccctgagactctcctgtgcagcctctggattcaccttcagtagctatggcatgcactgggtccgccaggctccaggcaaggggctggagtgggtggcagttatatcatatgatggaagtaataaatactatgcagactccgtgaagggccgattcaccatctccagagacaattccaagaacacgctgtatctgcaaatgaacagcctgagagctgaggacacggctgtgtattactgtgcgaaagacacagtgaggggaagtcattgtgcgcccagacacaaacctccctgcaggaacgctggcgggaaatcagcggcagggggcgctcaggagccactgatcagagtcagccctggaggcaggtgcagatggaggctgtttcctgtcaggatgtgggactttgtcttcttctgacagttccccagggaacctcttaaatttagaaaactgtgcctaacaatgtcttctctatgcatatgaggaccttttctccctggcacaaaatgcagattgacgctgacacggatgaaaattcctcaaccatggtcacaaggatcagagtcctgagtaacctcagggcttcctggtgagtcttctccaatcagacccaggacagggacctccgtgagattccctgactggaacagtctttatggatcctggtcacagacaatagagaggctgaaccagggtcagcgtcatgtagaacctcacagatttcacgtctgatccttctcctgacacgaaagtatgcaaatcagtatcagcaccgatctggtgcttcttttgttcctaatccatttactttattttttcgtcgtttttctcctttttccatttgtttttcctgctttttgcaaaaggaagatgttttccctgtgagatgcaggggatgacaattttgggagatggctggaacatccaatatcctcagggccggccatcagtaagtgcaggctggaagtctcagaaagagctgaagctgcttaatcaccgtggagttttaccttctccagttctgctctgatggaatcagggccaagcaggttatcaatgataatctacctaacatagagtcaaccgattccagtttcaataacgtctgttaaaaattcacaccaccacctggattagtgttttgtcaaatcaatacacagtattgtccagctaagtagacccaaagacggaccgttgcccatggagaaaaacattaacctgagttctaggttcttacagtgttaaaggtgtaaaactgattattaaaaatgaggctatttttctttttgctgttgagttgtagaagtttcttttccatttggacattaaaactttttgagatatatggcatattatccaattctgtaagttgtagttacttggttgctttgcagaatctttttcataatctattcccacttgttcaattctgctttttttttgtaggtgatttgaatgtaaaatccagaaaaagattgctaattttttgagggttgagagttttacaattacaggtattaaagttagatatttgaggcatttggagtgaatttttgtgtttattctaacctaaaattcttaattcttttcatgggaaaatccagttttcataccaccctctttggaagacactacaatttagccatgttatattgatggttctcatgctaaaaatcagctcgtcatcaatatgtgggtttatatctaagctctgtataggtatttatgccaaaactttctatgtttttaacaaatgttaaggcctggaagtgaaatgcctaaagctttcttcttgccttgttacagatattggaccaaaatattctaaccttttactattgagtgtaataatagctgtggcctttcttaacggcttttattatgttcaagttgttttcttgtcttcctactttgttcatagtttttataatgaaactgatttttttcaaagtctttttctgtgtctgatgaaatgttactgaggtattttttctttagttttttaatgtggtgtaccaaattggttgatttgagaatgttgaatcaagtatgcatctcaggaagaaatttgagttggtcatggtgtatgtcttctaaaacactttggagcttagtttactattgttggggattaattcatgtctactaatgatattggtctgtagttttcttttattgtggtgcctttgtctattactggtaatactatcatggtagcctcatagaaagagtttagaagatatatggcagactacctttaaaatagattttatcagtggagaaatggtgatagttttttcttcacttttctgttgggaagaattttatgttgtttaaaagatattcagaatgacttaacctggtttatgagctttcattctattcctttcttccattctttttgaagaactgcttaccttttccttttaatttttaagtttgtttttagacatatgcaatacattttgaggtgaaacctggtggaattttttctaataaattagaaaaaaataaatcatttaattgactattttattcaggttgatttgtttaatatttgctaaaggccagttctttaagctatgacacataataaatcccaaatggcagtacctcattgtttacttagcttttgtacttatatttctcagaggaagaaccactactgtaaattgtaaatagccaatacataattgtattgtatgcaaatctgtgactgtttacagtgtcatctctgagaaacataaagtttatttactatatatatataaagagtttggaaggtggactcctcaccaatttttgaaagagttacagaagggctggcattacttctttaaatgttaaggttcattttatgatgtgacatataacccatcatggagaatgttcaatgtgttcttgagaaggatgtgtattacgtgactcttggttggaaggttctgtaaatatcattcagataaatttgttcaatagtgttgttcaagttcagaggcacattaggaattttctttccggatttgctatacattatggtcatgaggtattaaggtcttgtgttatttttgtattgttttctatttctttatatctcttacagtttgcttaatgcagttatatttgtatttgtacacatgtgtaaaaacaaaaatcataattgctaaatgagttttatggcacagtcacattataagtaatatttttccaaatgctaccattgccactaaactcctcctggagtctgacgtctgctttgggcactgccttcttctcaggcatcccacactggagcttgctatagaggaggagggagggcccctctcctggtgaaaacaagcccagacctgaccctgcagctctgggagaagagccacagccctgggattcccaggggtttccatttggtaatcaggactgaacacagagaactcactatggggtgtgaattaagctgaatttttcttgttggtattttaaaaggtaactcatagggaactagagtgagtgagagtgagtggatatgagtgagagaaacagtggatatgtttgccagtttctgaccaggatttgtttgtattttcaggtgttcagtgtgaggtggagctgatagagcccacagaggacctgagacaacctgggaagttcctgagactctcctgtgtagcctctagattcgccttcagtagcttctgaatgagcccagttcaccagtctgcaggcaaggggctggagtgagtaatagatataaaagatgatggaagtcagatacaccatgcagactctgtgaagggcagattctccatctccaaagacaatgctaagaactctctgtatctgcaaatgaacagtcagagaactgaggacatggctgtgtatggctgtacataaggttccaagtgaggaaacatcggtgtgagtccagacacaaaatttcctgcaaaaagaagaaaggagtctgggccaaaggggacactcagcactcacaaaacaggtgcagccccaaggcaggtgcagatggagggagggtaagggctgctttccttcaggatctgtggtttcctctgcttctaatatttcccctctgagcctctgtacatttatattttgtgcccaccatgaggtcgctggattagaaaactaatttgaaagaggaaatattctcatatgtcctaaaaacagatgtaagtattggaggcataaaaatgcataggagccgggtgtgtctgtagacactgccacccccaatgccagacccacaactagtgctggagaagggtgggagtttgatggagcttccctgatgaccccgtggtccaagctaagtccagcaaggccattggtgcctcgctgagcacagttgtccatcagggatctcccatgtgtcccagcagcagccatgcctcaatctctccactgtgcacagccattgtctgggaggagctcccaggatgggtgtctttggcacacacagttgatgggtgttagagtgcagtgcagcagctggctgcctggtctattgggctcctggatattggagggatttgaggtgcattctcagggccagcacgctttgtcaatttttatatgaaaaccatgtgatttaattcattttctcagatgacatagataattaataacacaatctgcaaacaattataattttcaactttaccccaagttcattgtttctgaattctgtgcaggatccagacatggtactgcccttctcatgagaaactgttcgatctaaactgaaaccagttgtttctcgtatactttggttctccccatgtgcagagatcttgattagagcaagtttggtactttccacgcactcaccctcacctccccagataaagagcagaagttctccttagactgagtctgagggaggagctgttcctgtaccactcagggcctgcggagacccccaggtgcagcttcactgagtcaggtgtttcactccctgtgattgctgctcaggtctaattgtggctcggaattaggacagtcttcaggttatcacaggtcaatcatattctaaaaatcatcgttatcacacaccatggtaacaattcaaggttcatttttctaacggcagtttctcttttttatttggttgcaagtttgaggaaaggaacatgtgataatactttttaacctaacctcgaaatctactgaattgttctaggagactcacaaattggacaaagtgagctctttattctcataaaaatgtgtggttttgggaatttcactgtgttgcccagaacctgttaacatcaacaactatgtttctcagcacacttctggcttgagacgtccttgcagaccctctccctcacctgcactgtctctggattccccatcataaccagtgtttcctgctagaattgtatctgcttgcccctagaagatggacaggagtggatcaggtgcatgggttgtgaagggagcacaaattacaacccactgctcaagagtccatatccagatccaagaaacagttcttacagctgagctctgtgcccagtgaacacacaactacgcatttttaagcaaaagacgcaatgaagggccttcattgtgagcctagacacaaccctccctgcaggggtgaataggagcagcagggggcattcggggcagtatgggggcttaggatgattgttaggggtcaggatgagcaggatcaaggcttcgcatcagggcaagtgcaacagggcagaaaaggggctgtagatgtgggttgttctcaccatcatatttcaccaccagacaccctccactacatctcttctaatgtgtctgagtgttgatatgattagaaaatggcatttatgtaaatactaatatgtacccatatggaggtgcatccagttgtcttctccatcttatgtggaccttgtccatcaagcactaagtccctgtatttacttgagtacctcacacattatggtcaaaacaggtagggtctccttttggcatggtctctcctcctgccttctctcttctgtcacacaaaaacacgtgaactgacacacacacagagcttcccaactttaattatgtgatgtattgaagcaaattgattagtgtgcagcttttctgctttgcctgctattcatgttatgtaaaaataagaaccatgtttttctcagcttgtcacttctctaagctaagtagcatctttgtttattatacccagagaccaaaagcgatccaactgttattcagcagcttaactggtaaacaaattgtggaaaattcacttactggaatcatacccactgctacaatcaagtaatgctggatacacccaacaccatgcttaaaatagcaagtacttgaataagtaaaataagtcagacaaataaaagtgcatacatacgattccacttctataatttctataaagtaaaaatgaacttaaagttacataaaaagatctgtagttgactggggacatggtacaagaagagaaggtatagaaaggagaaactacaggagaacaaaaggaaatttctaggataattgatttttttctctgttagtaaaagtgaggattatgtcaatatttgtaaaattgtacactttatgtaaagattcttatttgctaatttcacctcattaaaatattgcaattttttaaatgtctagtttggtagaaaaggtagtagagagagatgaataaaatacataaaaatcagagagtcctgaatacacacatgaatggaccctgggtctcactgtactttgagggagacactagaatacaaaaacataatgacaggatttcagtacatgaaaggagcttctcagaccccaggaggcatgtccaactgcgtctgggagttaactcagggagcaggcatgtcctttggaaggagccgtgacaccaagctcccagcatccattgtagccgacaccatgccaatgccaagagatctcaactaaaattttctgtggatgttgagtctgattatgccacacactcacaccaagtgagtatggaaaggatagttacctgcatccttaaggtgtctgctgagagcagggcaggtctctcattaaggtccaaagtggcttgatagggcagggaaggagactggctcagggttgttatcatggtttggtggggagcggggcagagcatcctacttgcaggaagggttttgtggggtttcaaggccaaattggcatcaaatgagggagctcctgtgatttctaactagatttaccttgtatgcttaaaaaaagagatgatggaggaatgagcctgaagttatcagcagtcaggcctaaacacagagtctgatgacttactctaaatagcaagtatacaaatgatgagtaagaaaagagacaagactccaatatgggtggacaacagccaggtctgcagaaaatgagaagactgtttataagcaaagaataatgagtaggatatggaggaggattctggtccaatgtcttgtgtggaagcttctcatgatttgagatcatcagcttattctgaaggtcttaggtcacctgtcttcttcaaaatatcagaagtgcctgatgatatgtgaggatgcgcagtttaacttcctctatttgagtagctttacaattgtgtaaaattcttaattaattaatttttttttgagacggagtctcactctcttgtgcaggttggactgcagtggtgtgatcataacatagctcacggtgattttaaattcctggctcatagaatcctcccacctcaacctcctgactagcaagtagctaggtttccagggcccttcatctacacttggccggttctttacattctttttttttttttttttaggtggagtttccctcttcttgcccagaccggagtgcaatggcgccatctcagctcactgcaatctccccctcccaggttcaggtgattctcctacctcagcctccagagtagctgggatcacaggcatgtgacaccatgccccgctaattttgtatttttagtagagatgacgtttctccatgttggtcaggctggtctcaaactccctacctcaggtgatccttccacctcagcctcccaaagtgctggaattacaggcgtgaggcaccacacctggcctcttcgtttttattcatatattccttcagcagccactatgtcttcccactgatttcttcagtttctgccttttccttttgaataaggctgttactcctgagggaagatgggaggtgggcctggacagggacttggtgcattcctctctcccctcccagttcttattggtttctccagtgtctgtagaacagtggttttgatggctttacctctgcagataatttctcttgcaatgtagtggtgatggggaggtgtgtctggatgcatttcagctgtagttgctgttttgctttcccagacagcaccatcccaaggggtagaggctggagcattttgtgatgtatccccagtactgaagaaaaaggcttcaatagcaggaggaattcctcaactgcatacactctgagaatttaaacaataacttctctatcacactcaaattgaaaccacccaatgaatatgtctactttaatcgtgtgctaacttaaatgacatttggcagcctctgtcccagaaaagattatcatctgctcctgtttatttccctgcaagtctttatgtctgttcagatttcagatatattgtttgtcctataacatcaaaaatttgatgtatatatgctaatttgcagatcagtaagtttagtatttgttataagaatagtaacatatttttatggggtgcttacatctccaagctgagaagcacctctgtgtaatactaagcaactagaaatggtacaaataccaagaagacacatagataaacagtaatggcatgctaatttatggtaataacatccatcattagaatcaatacattgttgatgctcaacatgtgtgcatcataagtagttatgtgcgagaagccacacaaataaaacacatactatgtaattcctgtataataaattcttgaaactcaaaactaaggtattaaatgtgaaggactgactcagaatatggtggaggaagaaaataattgggaaggaggaattgtagaggaacacaaggaaacttttaagtgtaatttgtttattcattatttggatggcttttggggatgcacaggtgagcacgagtggaataacattttgttttgtttgtttgtttgtttttttctgaagagatgtggtcctactctgcgacccaggctggagtgtagtggtgggatcatagttcaatgtagcctccaacttctggtctccaacaatactcctgcatctgccatctaagtagctggaactaccgttgtttgccagcaggcttggcttgagtacttattaaaccgcacactttttgcaatatttaatgtatagtaataatgtctcaataagactattacaaatcaatgaatgaataatttgttctgtacagatttatggaaaaatagacactaacatgatgaatgactgacatttatgaaaatacagctgcatgaaatgtgcttctctttacattcattaggtaaacacaatagtgcatacacatcacaccgtgctttcattacaggaagaaacatctgaaaatgtcactggggtgaaccatattgtgctgggcttggttcaggaagcagtcaggcccagtgttgtgaccttcaaccacagaatcctaaaaaataataaaagaggctcccccaaagtccccatcagttcctggactcgccatgtgtctgggccgtatcagtgcatccggagctccctggtggctttagggattccttgcttgccatgctgaggtctcgctgtagattatgttgggttttctgaggccgttttgctatttaagacccactccctggcacagagcgattccctctaaacctgatagaggttctgaactacaaataacgttaagtgaatcctggtgtgtctgaactcacatgattgttacattaagctgctgttgcaatctgtttcctcacctgggaaaagaggagccaggacatagtgagttgaggccccaggaagataactgaattctcagagggcacaaccagcatcctccttccagggagagcctaaaagactggggcctccctcatcccttttcacctctccatacagaggcaccacccacatgcaaatctcacttaggcacccaagggaaaccatcacacatttccttaaattcagggtcctgctcacatgggaaatactttctgagagtcctggacctcctgtgcaagaacatgaaacacctgtggttcttcctcctgctggtggcagctcccagatgtgagtgtctcaaggctgcagacatggagatatgggaggtgcctctgagcccagggctcactgtgggtctctctgttcacaggggtcctgtcccaggtgcagctgcaggagtcgggcccaggactggtgaagccttcggacaccctgtccctcacctgcgctgtctctggttactccatcagcagtagtaactggtggggctggatccggcagcccccagggaagggactggagtggattgggtacatctattatagtgggagcacctactacaacccgtccctcaagagtcgagtcaccatgtcagtagacacgtccaagaaccagttctccctgaagctgagctctgtgaccgccgtggacacggccgtgtattactgtgcgagaaacacagtgaggggaggtgagtgtgagcccagacacaaacctccctgcagggaggcggaggagccggcgcaggtgctgctcaggacgagcagggggcgcgcggggcccacagagcaggaggccgggtcaggagcaggtgcagggagggcggggcttcctcatcagctcagtggtctccctcctccccagcacctcagctgtccccaggactcctctttctttattatctgtggttctacttcctcacatccttgctgcaggttttaacagtcactggcacccttttttcaacaaattcccacaaggcccattttaccttcttgacaagcaaaatattctaaggcttctcactatcccttgattggcgtcatctactgcatcgtgtctttctcttaaattcatgtgatgaaaccccaatcccagtggctctgtattggacagagggattttaagagggcaaataagttaactgtggccataaatgtgggaccctaatccagtaggactcttgtccttatgagaagtggaagacatcagaggcctctctctccacatgcacacagaggagagtccatgtggggatgcgctgcatgagaaggtggccctttgcaagcctggaagaggcctctcaaaaaacttaccctttctgcacccagatcttggacgtcaagactccagaacaataagaaaattaatatttgttatttgaaatagcctagtctgtggtatcttctcatggaaagccaagtagattcagagattcaattgtgttagctccgtctcctgcatggagtagcagcccaccgaggctggacacatctctcaaattattttcataaagaaaaatagatccaagatgaaaaccccaccacatttctgctgagccattcacttagcagcagtctctgagatcagccctgggggtatgttctaggtcgtgtatctcactttccactatgagaatccatgtagataatgagaaccagccagatggagtcctgatccctgcccaccttctgcttccccccaagtgacacacggtcacagaaaaccactccagcatcaccctgtgtcttgtactctctaaaatcccactaaagctgaccctaaactaggagctatttggggctggactcattctgttcttagtcttccataaggtccaggtgccgagtagagcctcagtaaagagtgagcttcaattcccctaacccacatcattcccttacatccttgtcatgcacctgtcctctgcaggcacccagggcaggttacacaggaattgcctgaagctggtctcaggtgccctgctgagaccactggttatgcacacgtatgatttcaggtcatgcaggctcttctgcaggacagacctgtgtcctgtagagcacagacacttggtgacccagggcctcctctaataactcatacatctcatgtcagtgtatatccaggtggcccctcagtgcagcacactagggtgattaccctcacaggtggctttttcaggcggtgaacagaaaatggggtgggcacgctggtcattcccatcatcggtgatatccaagtgaattttaaataaatgaaacaaaactaacaacaaaggggaaggatatgtacctgtatctgggaggtagactgggtcccagaactgtactgggagtgggtgtgaaaggcccttttgtgtgggaagccctccagcatgagtgaaagctgaaggaatgatcactgtaggtggaggctgatggagaagctggcagggtacatttcctgaagctgttcccgggtgcgtgatggttcaatggcccatgtacatgaagaggagggctggactcatgtaggatcaaggaaactaccccatggcaatggaagaaaagaaaatggagatggacacccctggaggcagcttattagctttggtggaggaacgatgggaatttattccaatgaccccagcattttcagctaaatatgagttgcattaacagacagaattatgaagggaagggagaaggagtttatagagggaaaaagcagaacagaaaaaaagaactatgcaagtctatcaaatggcagatgacagagtggagctgatgcagctacttcattcttcccggaacctaccagagaccttggcattcctgtaaggcaggtctagtggtgatgcacttgtccactttttgctttttggagaaacgtttgaaacatcctacattactgaagaaaagctttaattagtgtaatatttttacttgacagttttattggttttgttttattttcagcaacttgaatagaatcatgcacatcatgatatttgggtgaacaacaggccacatacacgataatgatctcattaaattataatactgtattttcactgcatttcttccatacttagatatgttcatatatatacatacctaccatggtgattcaactgcccacagtattcactacacttacatgatgtacagatttgttatctaggagcactatgctatcccacacagcctgggtgtagcagggtatttcacgtaggttcacgtaaacacactctatgatcctcgcatgatgacaaattgcctaaggacacattgctcagatgtatccctactgttaagctacacatcattgtatctcatctctctccatttttggtctctgataaaattctcgtgttgtttttgcattcttctctgagctcattgaacacatttataaggtttcctttgaattttctgccaggtaatcaatatacctccttttaatttgtgtcagtttctagtgctttgctttgttacagaatttggactgctttttttctctttcattattattatcactttgtacattctctgttgctttctgctcattagaaggaaaagccatggtaaccactcttcacagaatatgctcagggcaaatgccatcacctgttagcccagtccatgatagtggtgtctcttaaaatttcatactggtccaaactttttgttgttgttgttagtggcactcagacctatagaggattttaagttttcccctactctaaattaggtggcatcaaaattcatcctgcaggcagtctctgataaagtggagaaattggacaaagttttagcatgtatatggttcataaaaataatatgagtttaaggttttctcagccagttgctacatattgatattttataatcatttctttgaatgtctctggagtttatcttttgaaaatttagatcagaatatataccaggtttgaggcttcttgtctggcttaacgatctcctataggtcagcgtgtgaaaaggcacagagtctatctgaagaggagaactcagggaagccccaaaacaacagaggagacaaaactgaggactttgaggaatctaaagcttctgggacctgcagcctccagacatgctcagcaccctcttgttatccacggactaatttctttctcttttctgagtggtattttctagggttcccgtcctccactttgacactttggtatgtccatgtgtgtccattgtgtttcagccagggacacagaaccaggaaaacatcatggcttttctagagggagctgacctgggtaatcaacagttggagtagaaagtgcctttgtccatgtgtcacaggcctaagggccatgggcaggaggtcaggaagagaggatgaccagacggctggggaaaccaggatgaacaaagccactctccttcctggtgagaaggggcatgtggaagcctggtgtccctgtagggctgaaccacactcacctgcccactgctacctgccagcgaggtgacccacagagcagcagcagctcctgagtcactcacagaggctgcctcctcctccaaaccctccagtgtatgtgcttccataagtgtgagccccagcagatcccaaagttttcaatgggttcatctagctagtgtctgtcctcagccccatccccaggctcctgccctggttggtgtccacagtgtcccagcagcggtgacagtgacagccagggcctgcactttccagagcagcaagtttggaagaatcaagtcccagaaccagcctggatttggggcaaacacacaaatttcactctgaggggaagtgctggaaagtagccttgagtcttcctcagctcacctgtggctgatcctctgcatcccatcagcgatacatgagccctccccaaccccagcgtggagctgtttcaatcgcagcaggatgggaatgtgtcttctttctggggactttttaagcacagctcttatgttcctgagatttgaggtttataaaggtgtgtcagtcacccacagagtggacctgcacaagtaagacaaggacaggatccccaggagaggcacctcatatgagacgggacaggcaggtcccatcacagacactggtcctcagaaaccctgaccagctactcaccttcccaggtcacctgtgtctgatcagttcctgtgtttgctcctgaaaagatccccatcaagggtccccaggtcctgcccccttccttgatgtgcctctgggagtggggctggctgggctgtgggtctgctgtgactttccccacaggtcagcggctcagtgcaggctgcgccaactcggtggggctgggctgtggccgaccctcccagggggagcctggatgcttctcgggggcatctgcaggatcccaggttctgggagaacagggaagccacagtgtgtgcagggccccatctccaggtgtaaagtgtttgctgtcactctgttgacaagggcatatccccaggcctaggggcactgtgggtgcacaaccaatgtggtagacacagagagtaaggcacatttccctcccattactgtggggaatctaggcactgtgtgtgtgtgtgtgtgtgtgtgtgtgtgtgtgtattaggagttttgcagtgggctctgagccccgtgattttgtaggtttagaaattatctgatgagatgttcatccacaggaaccgacaagagattaggtgttctcccaaagcccctgggagctcctggactcattgtgagtgtggactgatccattgcttccagagctccacagaaggggctccctggtggtttcatagaatccttgcttggggtctttctgcagagttcactggctttcctacggccagtttagtattgtaagagatggtgtcagcagcacatggtatcacatgtcactaaatgagcattctgagccaggacacagcatcttcatactggggggagggaaatgctttgggagcccagacaggagcctctctgcagtgcaagggctgggctgcagggggcgctcaaggcccacccatcacaggctccacccccagagcaggtgcaccggaggctggggagggattcctctcaagatctgtgtcattcttctaaaaaaaatctaaaatgagtatttgacaaagactgctgaacattctataaatatcctattcaattgtgagcatttatcaaatttgatgttgtaatgagaaccacttttatactagatatttctaaccctgctagatatcttaatagtatgcagctggaggttaagcaagcttttcttttatataaataagtgcaactttggagaaacacactcatcccccgaataagacattcatgtattaaagcctagaaatactttaaattacctctgagccattcaagtgtgtgttcacagtgaagtcctgttctagggaaaattgttctccagggggagaagctttgtcaacatagagcttagggatgtatcaggaggcacatgacctctaaggggattatagcttgaacccttagcatcctcctgttggtaatacatgtgtcactctccaatctttctcatgcagtatcaggtatgaaataggatcgctcatgaatatgcaaataactgaggtaaatatagatatctttgtgccttgagagcatcatccaacaaccacaactctcctcagaagaagcccctagaccacagcacctcaacatgtactggacctggaggatcctcttcttggtggcagcagcaacaggtaagggacctcccagtcaccgggctgagagagaaaccaggccagtcaagtgagacttcacgcactcctgtctcctctccacaggtgtccactcacaggtgcagctggtgcagtctgggcctgaggtgaagaagcctggagcctcattgaaggtttcctgcaaggcttctggatacaccttcacaagctatgctatcagctgggtatgacaggcccatggacaagggcttgaggaaatgggatggatcaacaccaacactgggaacctaacgtatgcccagggcttcacaggacggtttgtcttctccatggacacctccgtcagcatggcatatcttcatatcagcagcctaaaggctgaggacacgtgcaagaggcacagtgtggaaacccacatcctgagagaaccagaaatcctgagggaggaggcagctgtgctgagctgaggcagtgacagggacaacgtggctgcaccctttgttgacatagggttatacacatacatatatatgcacccaacactggagcacccaggtatatcaagcaaatacaattagagataaacagagagatagacccaataccataatagctggagactttaacaccccactttcagcattggacagatcttccagacagaaaattaacaatgaaatcttagactaaatctgcatgacagaccaagtggacataatggatattgatggaacacttcatccaatggctgcagagtacacaatcttttcctaagcatatggatcattctcagggatagaccacatagtagaccagaaaatttgtcatttttaattaaaaagatatcatgtaccttctctgatagtaatgaaagaaaactaaaataataagaggaattttgaaaacacatggaaattaaacagtatcctccttaattaaacaatgtgcttccaaactgaactatatgctctaaaatgggttaataaagaaacaaacaagaaaattttacaatttattgaaagaaatgataatgaaaacagcgtatgaacacctatgaaatacagtgaacatagtactaagaggaaagttcacagctataagcacctatgttaaaaaagtagacaattataacataaacatcttaggaatatctctcaaaaaaaactagaaaagcaagagcaaatcaaatccaaacatagtaaaataaaaaagttaagatcagaacgttaataaataaaattgaaataaataaaacaataccaaagatcgatcaaatgaaaagttgttttttaaaaagataaaagacatctataaacctttaaccagaccaagaaaaaaaacaaagaagaccaaagtaaataaaatcagaaagaaaactggaaatattacaaccaatagtgcagaaaatcaaaggatcattagaggctactaggagcaactaaatgccaataaatcgaaatatctggaagaaaaggataaatttagagacacatacaacctaccaagattgagccaggaagaaattgaacagatcagtaacaagtagtgagagtgaagccataataaaaggtctcccagcaaagaaaaaacccgggacttgatgacttcatcactcaattatgacaaacatttaaagaagagataatacctaatctcactcaaaatattccaaaaatagataaaaagtagataaggaagggaagaattcttccaaacttactgtacaaggccaatgttacccttatatgaaaaccagataaagccataccaaaaaaaaaagaaaactacagttcaatatcactaatgaatatggatgcaaaactcctcaaggaattcttagcaaaccaaattcaataacatatcaaaagagcattcatcatgaccaagtgtggcttatcccagagatgcaaggatggttcaacctatgcaaatcaatcaatgtgacacatcgtatcaacagaatgaagggcagaagacgtaagatcaggccttaccttgttctcctcactcaaagtctaccattagttctttggtcctcttgaccagtcctgctgtacttggtctcccgtgattctgttcccaggtcctgaaacactgggcttctgcacacctggagtctctctctttgaacatggagaccctgtatcctcagagagggatgatgcctcattgtggctcccatgccccatgcaaacaattcttccaacacagtcatgatttttcctgttggaaattgaaaggggatgtgggaattgatgtgtgtgtgtgtgtgtgtgtcctcaggcctgttgggcctgttgagaacacagcagggctctatgtacaacaggaaagcaatgttttctctataccatctattttcttataaagtgttcataggtaatcaaaaggaaatgaatcacagtttataagatgttgtggactggactgatgttgtcactcaaggctactatgggggctccaggaaaagaaacctagaaaaggataagactgtgagcaaagaagcaaaacctgggaagcagcagggagagggtgagcaggggtgactcaactggggagggataacaccacttaccacagagggtgaaaactccgtgctcagcaaagaggagaacttactcagcatttcccctaatcctccctccagaagcgcgactgccaggaaagttcacaatgtatcatctccagctgggaacccaaaagaaacaggagattttagggcataggtcctgggcacaaggtgtttccctggttcctaccccttccctctctgtccagcaaaactgcttgtttctatcacttgccttcctgtccttggggtaagaatggatgctttgacactcagcagagggatgctctttcagaggaggaatgagtttgtgttatctgatgtctgagcaggacactcacctctgggaagaggctccaagacagaaggtcgccgtggttcctgccccttatatgtgaggggctcttgacacatgcacacttttcctcaaactctgtttataccccagcaacaatgctgggtgttgtcagcctctctcctccccagatactgctctatcatcagcttgagcacagtttccccatgaaaggcattattctctctctcaagaagatcaactttttacatgtcttcgatggatgacagtttttctgtgtgagaatctagaaataagaaatggggtaatggggacaagtgagctctctgtgtgactcactaggaagtccactgttattccaggtgtcctgtcccaggtgcagctgcaggagtcaggtccaggacccatgaggccctcagacacttccctctgcctgtgctgtgtctggattcttttttttaccatggatattatttgagatgaatccaccatcccgtgggcaacaggctggaatggctggggcacagttactagactggatcatcaaggaatacacatcatgcaccctccacccaggtccatgtccccatcaacagtgactcaaccaagagccagttctctgtgaagctcagctccatgaccacctaggacacggctgagtattactgtgaaagactcagtgaggaggtgtccttatgagccctgacacaaacctgtcagggcacttaggacctccaggaagactcaagaccaccaaggggactcacgaccactggggaagggcaggttgcagtaagcacagggccagccccagagcaggtgcaggtggagatgagaggctggtttactgccagggtctggggctgcttctccatttagatgtttccttcagagaccctcccttatttcatgatgctctgcttagctgtaagtctctgaaatatcacagttttgttgtaccaggaggaaaccttctctcaggtgctaaatgtagaacaatctctctgccagtggttgccagggtcacagccctgtggaagctgaagggtacccagtgagtcttctccagtcacattcaggacaggaaccttagtggggttccctgaggagaacagtctttaggaattctaacctcagccaagagaggctgggccagggtcagtgtcaggtagaacctcacaggatttacgtctgacccttctcctgacactaaagcatgcaaatcagtatcagcactgatctggggccccttttgctcctagcccattctatttcttgttagttgtatttgttgttgattttccttttgctgttcctgatccctgtaaagtggagatgtggttcctgctgtaaaaattccagggctcaagccctttccctgcagctcaggtggggctcagactgtggctcctgcaaccacgtgggagaggctgatgggactatcttctctcccgttgctcagaaccctccagtgtgttgtgtggagactcacctgggaatgcaagtggccaatagttgtgaaaggtatgcgcttgtttggtcaaagtggaatgtggatgtggaatttatcctgtgttgtgcaaactaacacaggttcaccttcctcacctgtagtgttagaaagagtgtgaaagttgtaagaatcaaaacagagccacttgtgttaacaccctgacaaatggacctaggaatgaacatgaaggagggttcttaggcccatattcctgataacaaaaactatcataaatagactctgcttagccaccatcttggatagaagcccaccacaaccttattaaaaattacacttgcaagaacatcagctcagaaactggctgttcaaccttacactgatgccaccattgctattgattctacaactatatgataattatctcaaaacaacttttgtaacccacctcattttcacttcataaacctgtggattgacatgttggagttactgctgcatttgtagataatgataaataataaggccttttaacaatgtttgaagctgctattctctgatgtctcttctaaaataaagaatttccaagtggatgacaatgaaaaaattgttagaaatatttggtggtaaggcatctttaacatcctgttgaatgtttctgcatagcacatcaatcccttaaaatactttgctatatctgcatttaatgaatgagtctaatattgaggtgcaattgaaaatacctgggcctttgatgaatcagctcatagggtgataatgtctgggtccttgagaaagcagaccctgtgttgtaagttttagtagaagtaccttttgcaaagaaagttcatgtgtttctgaacattatgctacttttaacttaagaatgcaatatatgatttatttttacttcaaactgggtatatacccagtaatgggatcgctgggtcaaatggtatttctagttgtagctccttgaggaatcaccacaatgtcttccacaatggttgaactaattttcactcccaccaacagtataaaaatgttcctatttctccacatcctctctagcagctgttgtttcctgacttgttaatgatcaccattctaactggaatgagatggtatctcatcgtggttttgatttgcatttctctaatgactagtgatgctgaacattttttcatttgtctgttggctgcataaatatcttgttttgagaagtgtctgttcatatcctttgcccactttctgatggggctgtttgttttttccttgtaaatttgtttaagttctttgtagattctggatattagccctttgtcagatgggtagaatgcaaaaattttctccgattctgtaggttgactgttcactctgctgatagtttcttttgctgtgcagaagctccttagtttacttagatcccatttgtctattttagattttgttgtgattcatacttggttaatttttaattgcattgttttcttctgattagttgtaagtatacctgcatattgatcaaaaaagccgtttaacaaatcaaaaggaaacatttaacaaatacgtgacttggaagtattttctccaagtctgttgttgtcttttactcccttgtcagtgtgtattgcagaaaaatatgtatgtgtgtgtgtgtgtgtttacaaattaaagaaacaggtataatttcatttatccatagatcacgtctttggcattacatctgaaatctcatcataaaatatactaatagtgatttttttttccatgtctctaatctcaggccacaatctactcatgagtgtttaaacatcacctacttgattagaggactatcaccctaagatatttggaatatttctggaaggagatgtgttctttttcccattatttctctatttagtcatttattaatatccgtattggtttatgaatgtctatttcatactctgaagtaaatccatgctatattattcattttattgttcaaatcaccacagctttattatgtgcttggaactcatttagtttggatgctgcatccttacagcacacctcatcattttgtttttgaacactttcctgtttcctggtattacaatacattctaagcccattttctatattaactttttcatacatagaatcagacatttttctaaagattgcttctttctgatgttaaaatatagtattaaaataaaatttgtgatactgggtatatgtgttgttaatgtggtataagtacttttaggacctctcaaccaactggcctagtaaatgtgcatgtttatatgaactcatgtttaaggacacattgaaactatttatgtatcttatattctgtaactttattacattaaaaatgagaatacactggtctcctcacccaactatgttaccaccatatcgacctttctaggcttccttgactgtccataatcacccactgcaaagtgaggaaccccatcccatcatatgccattgtattacttagctgcacaatttcaggacacatgcattgcagcatcagaaatgtaaagctgtacccttcttggaaccatttttatctactagaatagagtgcttatgtgcagtttctttacactttaaacttatagaatttcctcattttcaaagttccttagatcagcaacttcgttttccactttcttcatgaagtcatttcaattacactgtataatttctttatttgaattctgtaaaagccaaaactacagtcaagtaaacatagagaggatattccaggaatttacagagtgggtatcaaataagttaaaaaggcaatgtttaagaagagtaaaactatttttagtgatatgcaatggttgagacatgacacaattaatttgtctaagctcataattttgtgatgaaaaatataaacctaaatatatacaatttaaaatgatgtttagcagtacattatccctaggatcaaatgcagactgtataaaattatctaataacttatttggtgaggatgccatgagacacatgcaacaaagaatgaactaattttccttatttgcatataagatgttgacattcactaaagatctttaatttaaaaaaaaatcaattttctatgtgacccaggttttttcttccagacaagcaaataacccacaggattattttctttccttgattgagaaagattttccccaaacttcagctcagttcaggcatatactgtccctaaatgggcatttaccctcagatgagtccacacacctgtcaacacgtggagtcttctgtcagacaaacacacctttactgatgtggattcttccctcagacaaaaacacatgtccccacatggacactttcctcagactaccatgtatgtccttacatttacgctttcctcagaaaacagacttttcctcatgtggactcttgtctcagacaagcaaatatgtctccatgtgaactcttcactcagataagtacacatatgtccacatttactgtttccctacacaggcacatatattcaatgttgaattgttttgtggcaaaatgatctcaagataatggtaattataaaccccctccctaataaagtgtagatctgtattttttttgttgtaacctaactttgccttattgtcaaaaacagtaatttgcagctctaaatgcaccagttagagacaggtgtccattttctctggaaatgtatttttattttcttactggacatatttgttgataatgttgctactatgaagatacctgaacagtatccacattaaagaataaaaaagagtaatgggcagaataaccctgtgcatccagacccagaaatcctttgaccctgccctcccgaaatgtagacacagaggatggatgagcagtgctgagcagtgtacccatgaccacaaacatgaagacatggaaatgtgtccccactcctcctcatgaaaggcagctcatgccctcttccttcaggccctggtatggagccaccccatgtctctgcccttccttagtgtccacaccatggggtctgcactgatctggattcccttctcatccccctcaatattagtgtgccttgtgaatcaggtccagctgtggctgttctcagtctgtttcctctgtattcacagaagtcctgtgtgatgtttactgatggagtcagaaggagaaaaatttaacagcccagcagttcactgagactgtcctgcaaagcctctggtttcgggtttactgggtgcagcatgagcttggtccagcacgcttcacaacaggaattggtgtgggtagcaacagtgagagatcatatgggagttctaagggttactctccatgagtacagataaatcaacattcccaagtgacaccctttcaagtgcagtctaccttacaaggaccaacctgaaagccaagggcaaggccgtatattacagtgagggacacaggggagggaagatctgtctgagcccagacacaaaaatctctgcagagagacaggagggaactgcgtggtagatgctgctcagaaccaccatggggtggccaggaaacaaggggtgcttaggacctctagggagcgctcaggacgccaggggggtgctcagaaccactaggggacgctcaggacactaggtggcgctcaagacaacactactgcactcatgtcaccacggggtactcagaaccaccagggggcgctcagaaccaccagagggcgctcagaaccaccaggtggcgctcagcaccaccagggggcgctcaggacaccagggggcgctcagaaacactcggggacgctcaggacaagagggggtactcagaaccaacagggggcgctcaggaccaccaatgggtgctcagaaccacaagggggcgctcaggacataggtggtgctaaagacaacaattctgggctcaggtcaccagggggcgctcagaaccaccaggggacgctcaggacatgcaggttctcttaggaggcagctgcacatcaggagcttcagaggctgtgatttcctttcagaccctggaaattcctgacctggtcaagcaaaagtcttccccaggatgtctgatttttccttttaattccatgatttcttttacctacaaaacactaacttagaacagggatgtaatgcaacttttattgctgcgtattttctgagtaatactagcaatgatctctcgggacaattattaaaataggttatttatatattttaattattaaaaataatactattattaaaatagtaaaattttttaaatcacacttgtaatcccagcacttggggagactgaggcagacagattacttgagctcaggagttttagaacagcctggcaacatggtgagatgctttctatacataaaagaagaaatagctgagattggtgcaaccagctacttaaaaggctgaggagggaggattccttaagcctgggaggttgaggctgcagtgagctatgattgtgcctccacacaccagccttggtgacagagtgagaccctgtcttagaaaaaaaaatgcatatcctcaatacagactatttccatgaatagagttttgtgtttttgtgctgtaatagtcaaacaattgtatatgttttctaactttaactcagcatatgcatggtgttttgtttctttttctttcatctgctgtttgtggaaaataaacagcactttaaaggctctgtttctccactttgtttggcttccagtgtcctgtttttcagactgtttctccaccttcccttcttctttgaaagccatttatcttcctcagtctccatgcagaaaaagaaagtccctttactttctgtcttccaagtctggtgaatcagttcccttcttttcataatcactgaagccaaccaagtttagaagtataacagttctccttagaatacgctcatctacctgcactctctgccctcctcatccttttctaggtccctccagacatcaccctcatcccataccctcccttccttaagtaccacagagtgggctcttcacctcctgctgccctctatgtgctcagccctggggctcactagtcctttgattatgaagtccaaatccctatgtgcttgcacactctcacgccaccctctaggaagctgccattgtgagagagtcctgaaaagcatgggctgggtttagtttcataatgcatattatggtcaattagttattctatttgaacattctatttaattaatagatagagttaattaaatagagttattctatttaattctattaaactattaataaattagttattcaatttattaataacaggccaatatttaaaataaataccattgcacgtttaagtgacatatttgacaataattgcatttacatacagttttaccaaaacatgtatcgaagtgtatttgtttttttaaatattggaataggcagacatacacataggaaaacattattttgtactacaatctcaaactgcaaacacaatttaaatgccattaaataattagaataatatgaaacaaatgggcatggtgttttggtgtttaaatatacattcatttcacctgatcatacttatgtgtctttgctgggctgctgtgcatgtatgtgtatttgtatgaccatgaagctttcagatacatcattaaattacataaagtgttaccatgcacttccctcttttaggggacaaagtaaatctttcagggcaatcgcagggaaaatgtgtggttggatcttccacacagagtccctaccatgacattgccaagtagagctatggaagggggctaccaacctccagaccccagaatggtagatccacaggcagcttgcagctcgagtctggaaaagccacaggcacccagctccaacccatgagagcagccttatgggctgcattagggaagtcacaaaggtagggctgcccaaggccttgggcacccacccttgcaccaggtcacaagacatggagtcaatgattattttagagccttaagattgaaggactgtccgactaggttttggccttccataaaaatctttacccaatttttgggccattttctctttttagcataggactcctcacccaatttctgacccatcattgtactttggatgtaaataacttatttttgatttttcagtctcataggtgaaaggaacttttccttgagtctgaactttggattttgaattaatgccaaaacaagttcagattgtcagggaccactggggagggattattgtatattgcaatgtaagaaagacataaggggcagaatgatgtggtctggatgtgtgttttctccaaatcttatgttgaactgtgaaccccagtgttggaggtgaagtctgctgggaggcatggcattaggggcatatccctcatgagttacttcgtgtcatccccttggtgatgaatgagttatcagttcacatgacagctgattgaaagagcctggtaccactcccttctcttatcttcccccctattgtcatgtgacactcttgctccccttcatcttctgccttgactgtaagctttctgaggcactcagcagaaacagatgtcagcaccacacttgctgtacagcctgcacaactgtgagccatataaaacctatgtcctttataaattatccagcctcaggtatttctttacaattcaataatggacgaacagaagaagtatttaattgtgcagcaaattaggggtgtggaatcattaaaatggacttaacgcctgtagaggtaaagacacaagagtctctctctctctctctctctctctccttgaacccttctctgtctttacatacacacacacacacacacacacacacacacacacacacacacacgctccacgtgaagatgtcatgtgaccaaatagcaatatggtggctgctatgagccaacagtagaagcctcaaaataaaacctatcttgccagcatgtttatctttgaatttccagaattgaggaactgagataaaattaaggttgtgtaagttaccaagtatgattgtttttaatgtttgaactgactaaagagaatttgggatgaagaagtggggttctgatgttacaattatttcaacactgtggaaagtgccttggaattgggttatgtgtaaaaggctggatagttttgacatgcataaagaaatttatatattaagtgtcattctgatagattaaaatgagtagagtgctattggaaactggataaatggtgatctttgttataaagtgacaaaaaaaacttgtctagactatgttgtgatatttagtaaaagagaactttgagcagcaaaattgaatatttagctgagaacacttctaagtaaaatgttgaaagtgtagtttggtttctcctgggcatttataataagaaatagatgaattgaaaatgaaattataagggagaaaatatccaaaacttaaaggcttggaaaattctcaatctatctgtgttgcaaaaatcagaaagtgcgttctgaagagaacagtgagtatgaggctgtaatatcacttgataaagaatttatggtattaaaagagaataaatgcaggttttaaagaacaaggatggagatgagacaaaatggacgaatactgtcagattcttcagatttaagaggatggagctacttggttgcaaatgtgcaccattcttccagaacaaagaaaaataaaccttgaatttatttagaagtaatcatgaccactaccttggtttcaacagaccagaccatccatgcttaaaaccttgaggaaaagacctcctaccactgcctggaacttaggaactcccagtgagccttgtgtgtagggctgcatggggtctttgggatgggaccttaacccagcagttacccattggtgcctctacttaaagcattggaattaattctgctgctgcaatgagctgggaaagaagaagcttggcccagagaagattccacttgagccttaaggtctatggtaatttgttttgttatgtgttgtacttgctggggacacatcacccctcctttcttttctatttttctctttgggggagaaaatgtctattttatgcctaactcaccactgtattttgaaatcaaataacttgtccagcgctatggactgaatgtgtatgcaactccaaaattaatattgtggaaccctaatccccagtgtggtgtaattggggtgtgggccatttaaggggtgatcaggtgaaaaggttgaagccgtcataaatgagattagtgctctaataaaaagtcacgggagagcttttctctcttgcttccctgtcatgagatgatacgataaaattacggccatctgcaattcaggaaggaaacctttacatacacatgattggctgtcttgggcttcccagcattcggcactgcacagaataaatatgtcttgttaaagtcatgcactttatgacactttgttaaagcagccccaataaaataagatatctggttttactggctcagagttggagagaaatttgtttcagaaataattctacctcaaatcttactcatgtatggtttagttaatatttaaattatgttttaaacttgtttagagttgatgatgaaatgagttaagagtttggggactgttataatcaaatgaatgaactgcgaatgtgtaaatgccatgcatttgggggatggtcttttctattctgggtctttcatgcctacgtgtgaattgaaggattgcttttcttatttctgtgaagaaggccattattattttgatagataatttatctaatctgtaaataactttgggtagtatgaaaatttcaatactattaattcttccaatccataaatgtggagtatctgggatatatgtcctatttatgtgtgtccatttcattttctattaccaataatttatagttatcctctagaaatctttctcttatttggtaacatttattcctaggtatattttgcagctattgtaaaaggaaaggcttcatggatttcattctcagatgttttgctgtcaacatatagaaatgccaccaattattgtatgtagatgatgaatcttacaactttacttaatttgcttatgaattctaatagtttgtgagaaggctttagttttctttttttaatataagatctttttgtctgctcacaggaaatctgacttccacaattccaaatttgaggtcatttccttttactgttaactaaatactctggctagcatttcagtactattctgaataaaagtgataaaaatggttatttttgtcttcttccacttcttagatgaaaatttcccggtttttccatgcttcgtgtgatgaaagctgtgtttttctcatatatgcgctttattttttgagatatccttcttgtatacctaatttttgataatttctatcagaaatgaatgttgaattttattctatgattttctaaaatatcttgactacacaataacacagtaatatgcaggtcaatacatatcaactgaatttcacttaatatcatcccaacttctaatatttattttttagtattagaacatgcctgtttccatattatatttgctcacaggtattggtacatattttagctaatttgtcattattttactctaagaaataactcaaaaaatcatttttattatgaattgaaaggtaacatcggcaaaattagcccaatcttaatctttcccagactttgaaacattattgaagacaatgagaggggaaagtcagctttagttgagcttctaagaggtaagtgaggtaaaaacccagggcttattggctacgactttgaatgttactgtcttcttttccataagccacatccagaccattttctaaatctaagaaaactaattttatctcactgcttcttagtcttgtttcctgcagctgacaaccaaaactgtcagcgatagagcccagtgtaaatcaccagcctttaattattgcagaactatgattttacaacaacattgtgagttacataatgatcctactttatggccgcggtgcaaatgcttaacttccactaaatcacagagctcagaatggctagcatggaggtgtatatgtatatgtgcattgttctagaaatttccaattactgtatattattgtttgcagtaattaggtcaatctgaactgacaaaagtctccatggccttataagcacagagaccacctccacggcaggtggaaatcaaggctgggaacagtctaccagctgctcccctgggattcctccaattaccctgtttaaagcctctgctcactcatgcgctggaagagggatgtcagagatgcagtctactcttcctaaagggctgacagggcataaagacaagactgattatccatggaacattcctataggaatgcacctatgtgcagacacactaataagctgtgtgtcttgcagtgtgtaaatggctgagatgccatttacacttctttacacaatacatttttaaatgttttgttgatgtattctctatcattcaaaaaaatcatcactttccccctaaacaaagaggatttttatcagaacacttatgggaagccccttgctctcccagattcccaccctcatttctcctgaaggaagaaagaaaaccatctctattgatttccactctcatcctctaggactaaaaccagaaagctgcatgctccctgggtgagccttagagaagaccctgtctgtaggagcaggaatctcagagccttggctgagaggcatggtcctgaaatgagatggagtcccccatggagatcccacgtggacgcccacacctgagggctcactgctcctcaccacagatgcactcccctactgagtcctgagacctgagtgcaccccatagagtaggactcagatgagggaatgcaaatctccaccagctccaccctcctctgggttcaaaagctgagcacggggcctcgctcagtgactcctgtgccccaccatggacacactttgctacacactcctgctgctgaccaccccttcctgtgagtgctgtggtcagggacttcctcagaagtgaaacatcagttgtctcctttgtgggcttcatcttcttatgtcttctccacaggggtcttgtcccaggtcaccttgaaggagtctggtcctgtgctggtgaaacccacagagaccctcacgctgacctgcaccgtctctgggttctcactcagcaatgctagaatgggtgtgagctggatccgtcagcccccagggaaggccctggagtggcttgcacacattttttcgaatgacgaaaaatcctacagcacatctctgaagagcaggctcaccatctccaaggacacctccaaaagccaggtggtccttaccatgaccaacatggaccctgtggacacagccacatattactgtgcacggataccacagagacacagcccaggatgcctcctgtacaagaacctagctgcatctcagtggtgctccctccctacctctgcagaacaggaaagtgtgactgagatgccatttcctgccagggcttgtgtttcctataccaaccagactcagagccctgtctgttttcctattctgtactattaaatggcatgttccctgttagtgattcacgcaagcagaggctgtatcctgtttgacaaagattgagcatgaaagattcccattacctgggccacatgcatcactgatatgtggccacttatttcttgagctcatatccttccaaggggctgaatacaaatatctataacataggccatcttaaactgcaggaagtaatgttggagaagaatgtggagataaaagagcaggatgattaattaaaatccagataccatctttttttgcagagaaaaatttacactaataaagtaattttatgaaacaacaagaaagatggaatgtgtcctcatcatggagtgtctcacttgcagtgcacaaataaatttctaaaaattttatagggaagatgtgatagatgaggctgatttccacacagggagtgattaaatacccaggtaagtataaaatccaacacttggaaaggaaaatgcctcagcttgacatcagaaacccagctcagtaagtctgaggagcaatgcggaaaagaaatgaaaaattcgacaacacttttcttatgaaatccctagctcatgtttgaacacgaaaacagaattgtccacaattttaggacagccatcgcatgacaacaaaccactacaatgataggagcatcactgagtcaacggagttcaagcagtgagcagatcagtactgaggccccaggagaaccaaggctctttggtacattttacagaacccagaaccgagccacataatctatggccaagtgatctttgacaaagttaacaaaaattaaccaacgtatacaccagggaaaggacaccccattcaataaagggtgctggggatattggatagctatatgcacgcgaatgaaactggacccccaccctcaacatgtaaataattaacacaaaatagattaaaggtttaaatgtaagtcttcaaactgtaaatgtattcaaataaaacaccaggacaactcttctggacaaaaagcaaacaatagacaaatgggacttaatgaatctaacaagtttcttcacagcaacagagtgaacagacaaagtgcagaatgatagaaaatatttgcacactgtgcatctgacagagtactaatatacagaattaacaagaaactcaaaccacaacaacaaaagaaaacaagaaccaaataaccccattaaaatgagcaaagaacatgagtagacatttttgcaaataacacataaaaatggacaatagatatataaaaatgctcagcattactaataatcagggaaatgcaaattaaaactagtgagatataccattcacaatggctgttattaaaaagtcaaaaataacagatgttggagaggatgaaatgtaaagggaactcttagacactgttgatgagaatgtggacgagtacgacctctatagagaacagtatggattcagtatgatattgactgtgcatttgtcataaacagctcttattattttgagatacattccatcaatacatagtttaatgagagtttttagtattaaggggtgttgaattttattgaaggcctttgctgcatctattgagataatcatgtgttttttttccattggttctgtttatgtgatggattatgtttattgatttgcatatgttgaaccagccttgcatcccaggtatgaagccaacttgatcatggtggatttgaaaaccggcacaagacaaggatgtcctgtctcatcactcccattcaacatagtattggaagttctggccaaggaaatcaggcaagagaaataaataaagggtattcaaatagaaaaagaggaagtcaaactgtctctgtttgcagatgacatgattatatatttagaaaaccccatcatctcagccccaaatctccttaagctgataagcaacttcagcaaagtctaaggatacaaaatcaatgtggaaaaatcacaaacattcctatataccaataatagaaaaacagagagccaaatcatgactgaactctcattcacaattgctacaaagagaataaaatacctaggaatacaacttacaaaggatgtgaaggacctcttcaagagaactgcaaaccactgcccaaggaaataagagagggcacaaacaaatggaaaaacattccatgttcatggataggaagaatcaatatcgtgaaaatggccatactgcccaaagtaatttatagattcaatgctatccacatcaagctaccattgactttcttcacagaattagaaaaaaactactttaaatttcatatggaaccaaaaaagagcccatatagcctagacaatcctaaggaaaaagaacaaagctggaggcatcacgctacctgacttcaaactatactacaaggctacagtaaccaaaacagcatggtactggtaccaaaacagagatacagaccaatggaacacaacagaggtcccagaaataatgccacacatctacacccatctgacctttgaaaaacctgacagaaacaagcaatgtggaaaatgatcccctatttaataaatggtgttgagaaaactagctagccatattcagaaaactgaaactggatcccttccttacaccttatacaaaaattaactcatgatggattaaagacttaaacatgagacctaaaaccataaaaacccaagaagaaaacctaggcaataccattcagtacataggcatgggcaaggccttaatgactaaaacaccgaaagcaatggcaacaaaagtcaaaattgacaaatgggatctaagtaaactaaagagcttctgcacagcaaaagaaactatcatcagagtgaatgggcagcctacagaatgggagaaattgtttgcaatctatccatctgacaaagggccaatatctagaatctgcaaggaacttaaacaagcttacaataaaaaaaaaacaaccccatcaaaaattggcggaaggttatgaacatacacttctcaaaagaagatatttattcagccaacaaacataaaataaagttcaacagcattggtcgttcgagaaatgcaaatcaaaaccacaaagagataccacctcacaccagttagaatggcgatgattaaaaagtcaggaaacaaaagctgctggagaggatgtaaagaaataggaacgtttttacactgtggtcggtagtgtaaattacttcaaccattgtggaagacagtgtggtgattcttcaaggatatagaactagaaatgccatttgtcccagcaatcccattatttggtatatacccaaaggattataaatcattctgctataaagacacatgcacacatatttttattgcagcactgttgacaataacaaagacttggaaccaacccaaatgcccatcaaagatagactggataaagaaaatgtggcacatatacaccatggaatactatgcagccataaaaaggatgagttcatgtgctttgcatggacatgggtgaagctggaaaccatcattctcagcaaactatcacaagaacataaaaccaaacaccgcatgttctcactcataagtgggagttgaacaatgagaacacaaggacacagggaggggaacaaacatcacacaacagagcctgtcggggagtggggggctggaggggatagcattaggagaaatacctattgtagatgatgggttggtgggtgcagcaaaccactatggcctatgtatacctatgtgacaaacctgcacattctgcacatgtatcccagaacttaaagtatagttaaaaaaaaagagagagagagagaaaggaaacagtatggagactttccaaaaaatgagaaacagtactggcctttattctaccaatcccactactgggtagctacccaaagagaaagaaatcatatttcaaaaagatacccacacttctatgtgtaccacaaatctattcccaatagcacatatgacaacctgagtgtccaccaacagatgattttataaaagaatatagcatatatgcacaatttaatactagtcagccacaataaggaatgaaactgtgtcttttgcagcaagatgcctagaactgggggacattataattagtgaactaactcacaaacagaaagccacatatcacacattattacttataagtgggaggaaaacagtgtgtacacaaggatatggagagagggattatggacattggagacttagcagaatgggagggtaggagttgggagcatgatgaaaaatcacctaatgggtacaatgtacgttacttgggtgttgggtacactaaagccaataccactgtgtaatatttccatgtaacacagttgcacccatagcccttaaatttatacaaataaagataaaaacaattacaatttaaaatataaaattattaatagttgaccaaagatcttgaaaattaaaatttaaatcatgatcaataaatgaaattaatatcagttgaacttcatttaacttaaaatccttttgtactcaagtgattttaagaaaatgaatgtcaagttttagatgaggagatttgcaaatcatatcaccacctatgtaattatagtaagaaccctcaaaactcaacagtgaataaaagaagaggcaacccatggataaaataggcaaaggtttgtgcaggcatttcattaaagaagatgtacagattacacataggcatataaacaggatctcaacaggatttttcatcacagaaattcaaatcaagaccacaataagatacccaaacaccctttttagaatggctgaaattaagaagaaagatggatcataccgatgctggtgagcataccaggtttctagagtctaaaacattgctaatgggaatgcaaaatgaaacagctacacaggaaaataattcttagtttcttgtaaaattatatatgcccttaacacattacctaaaaatccccctcctgtaatacagtaatacatggctgtgtattactgtgaaagaggcatagtgtgaaaacccacatcttgaaaccctgagggagaaggcagctatgctgtggctgaggagattacagggattatttgattaaagacttttttagaaagtgaggttaaatcagccgggcgtggtggttcacacctgcaatcccatcactttgggaggccgaggtgggtggatcacgaagtcaggaatttgagaccagtctggccaacatggttaaactccatctctactaaaagtgcaaaaaattagccgggtgtggcggtgtacacctgtaatcccagctactctgggcgctgagacaggagaatctcatgaatcggggaggctgaggttgcagtgagccgaaatcgacccactgcaccccagcttgggtgacagtgcaagactccgtctcaaaaaaacaacaacaacaacaaaaagcgaggttaagtcattgaaaaataggaaaatataaatgtgtatgcactctaattatttgggaaattttccatacaacttgtattctgtaaacaaaattcagggagtggaaaacaaatcaaattaataaaactgatataagaattcctctgaagatattagtgtgagcactaacacacacttttgaatgggtgttgtaaatattttggaacacacctcttaggtcacattttaattctacatttatgtaaattatataaaatatcgaaattttttaatgtctccattttgtgcagttataattttggtttcatgccagcaatgcatgatagattccgttcttccacatcctcgttgccatttggcactataagcattgtgtattttaaccattctaatctattggtggtgatagctcattgttgtttaaatgcacatgtctctaaaattttatatttaattattttatataattgtgatgaagtgtttgttatggtatttggctcatttttgatagcattgtttatttttgatcagttgtaagtttctttacatacccattatataagtcacttaaaaaagtacttagctggtcatgaaccccaggatgagatgcagactgtatagaaatctctagcaatgttactcagtgtgggcagggatggcatgagatacggggaataaagaataaagtaactttctccatttggatataagatgtgtccattcactagagagttttctttcagaaggttcccatgtgagccagtttccttcctgacaaggaaatcacccagaggattctcataatctcttaagtgagaaaagttttcctcaaactccagctcagtctagctcacactgtctctaaatgggcaattactttcagacatgtacacacatctgtcccaacgtggactcctccctcagacaagcacacacattgcaatgtggactctcccctcagaaaaccacacatgccccacaatgactccttcttcacataagcatatatgcctgatgctgaactgctgtgtagcaaaattagctcagaatacaagcacttatggactctagccataacaatgtgtagatctgcattttattttaaattctaaatgaacattttgccttcttgttaagaacagtggtttacagctctacatgtagagactacaggcagatatatgtttcctctgggaaaagtttattttcatgtatttactgggttattttgttgataaacattcatctataaagacacctgaaaagtgccctcattagagaaaaagaaagtgtagtttgcagattaactctgagcatccaatcccaggaatcctttgatctgccctccctgaaatccacaggcagaggggggatgatcgctgataagtagcaaacacatgtccacaggaagggagacatggaaatgtggtcactcccacactcaagaggagcagctcatcccctgtccgtagtggtcctggtgaggagccaccccacacctgtgccttcctcagtatccacaccatggggtctgtgctgatctgggcttcccttctcatcactctcaatattagtgtccttgcggatcaggctcagctgtggctgctccagatgaggctgttctcagtctgttccctctgtgtttgcagaagtcctgtgtgaagttcaccgggggagacagaggaaataacggtgcagccgggggctatctgagtctctcctgcaaagactctggattcaccttcactgattgcagcataagcttggtccagcaagctccaggaccagggttgatgtgggcagcaacagggagaaattgaagaggaagctctcagtggtgccctccatgaatacaaagaatcttcacagtccccaggacacccttacgtgcatggtctcactgatatctttacttcttttatcacttttgttatgtaaatcacaatgaatagtgtattcctcatctattatacatttgttaagtcttttttggtgtctttaaaaaaactgataactttatagtatgtaatatccttaagtcctgaaagtgttttttgatgtctaccttgtcttaaatttatacagctactatagcttttcttggttcatgttttctcatatttatcttttctatttgtgaatatgtagagaaactttcttgtacatagctaatagttgtgtattgcttttttattttggcagtccttaaatattctaattttttatgatactttaagttttagggtacatgtgcacaacatgcaggtttaaacaaacaacctcatcaaaaagtgggcaaaggatatgaacagacacttctcaaaagaagacatttatgcagccaaaaaacacatgaagaaatgctcatcatcattggccatcagagaaatgcaaatcaaaaccacaatgagatatcatctcacaacagttagaatgacgatcattaaaaagtcaggaaacaacaggtgctggagaggatgtggagaaataagaacacttttacactgttggtgggactgtaaactagttcaaccattgcggaagtcagtgtggcgattcctcaggtatctagaactagaaataccatttgacccagccatcccattactgggtatatacccaaaggattataaatcatgctgctataaagacacatgcacacgtatgtttatagcagcactattcacaatagcaaagacttggaaccaacctaaatgtccagcaacgatagactggattaagaaaatttggcacatatacaccatggaatactatgcagctataaaaaatgatgagttcctgtcctttgtagggacatggatgaaactatctattgcttttttaaatcaactataataaattctattttttttttttgagaaggagtctcgctctgtcgcccaggctggagtgcagtggtgcgatcagggctcactgcaagctctgcctcctgggtttatgccattctgctgcctcagcctcccgagtagctgggactgcaggcacccaccaccacgcctggctagttttttgtatttttagtagagatggggtttcaccgtgttagtgaggatgctctcaatctcctgaccttgtgatccacctgcctcagcctcccaaagtgctgggattacaggcatgagcaataaattctatttttaaaccaacaatatttttttccgttaatttttgtttaaattaacattttgtaatgatgcttatttctctattaacatggtatttaattacctttttataaatattgtatagttaccataagatttacaataaaaattgtatgtaattagattctaatgtaaatcctgtgatggccttgatatgaagaacacagatagtgtaactgtgtgctttgaattcctccttctcgccactctttcttgtttattctgtttgcacttacatatgctgtaaaatagaatatgtaattttttattactttatacagttatatcttatagcaattacaaatgttaaagagtacaattcatctagatttttccatttttacaatctttatttctttgtagagatttctattttgagtgcatatcacatggctactcgcagagaatctttgtaaaatgtgccctgaaacatgaatgtgctgacaacacatattctccagatctttttttctgacagaattttatttgccattcacctttaatgaaattttaatgcatgtagaatttcagtttgcatttcacctgtaatttattttcttgtaattattattagtttttcctggagatgatcacacattacattctgctgggcctttattaaccatgtttctgcgaacctagtcaggcttgggtttcaagtgtatggttgccgtggctatcagagttgaaatcagcttctcctgttcacaaaaacttcaggttcctctggtgatacctgcgtttgtgtccctgtttggctttggatcttcacatttcattctccccaaagaaaggctgtctctttcagctgtggcaggtgcatcctgctgacacatttacttggtgactttttgtgggatgaaggggcttggacacaggggcacgttttccaaccttctggctgagcctccttcttagctatgggtggtgagactggctctgatgcatgatcttccaagtgttcctgttccttcccttcctcagtgtcacagtgtctcttcccagtcatgctgttttttcatcagtgtcctcagcttctgacccactgtccttaccccacagattctggatttcattcctcaggaaacagacgggaggtgattctgggtagagtttccctgatgtcctctgtttccttgtgttctagttgattctaccagtgcccacaggacacaagatttaataaatgtctcctgcatataatgaagggggattcagcattgaacggagctactgttcttcctccccagtcaacaccacaggacagcaggtgggtgagttgtctggggatttccccaattctgtaggaaaagcctgcaagtgccaggagtttcacactctcacaccattagcacacacgtcttcaagcaactcattaaacatttccaggttagctttttcctatcttcaataccatgccatgagtggcacctgccccaggtactctaataaacgcaccctagttctctctgcgggcccctattttctcatatttcagggatttttttctctgtgacatcaactcagatatggtgaggggtttattttttgtaattcttcatgttttttgttaacgaggtcagaataatatcattttctcaatttttacattctaacgcttagtatctgatttctaaataaaattcagaaactaagacaacaaatgaagtatccattatttggtgcattgttaaacaatttgagaaatattcatgtactgaaatagaatgaaccactgaaatcaaggcatgcctcattcacataagaacatgagggcattatcaaataattttgctgagtggaggaagctaaagaattcaccatcaatttcatgtgatttcatttgtataaatcacagaagatgcaatattctaaattaacatagagaagatctgaatttctctgaaaatagggtgggcagagtaacaacgtggtgaaataaaattatagacaagttagataaaaaaattagaggttaacttaattgctaaaacatgattgaagtgctgattcaatgactgcacacatatatcaacattttccaaatgcttcactatcaatttgatttcattattgattgtttttttaataaagcagtaataaaaatgaatatattggctgagaaagagcaagaaatggataaataccgacacttgaataatcaaggactcctgaaaatacacacatgtgaacactgattgtagatttcaggtaaacactagaaaaggcaaaattacacaaagttgttatgacaggagggacatcctgaaaacctctctaggcatgtcccacaccaccctggagctgtctcaggggagcagtctcctccagtgtttagaggcacaggcacgcataatagggctaactctggccagatgtgtgatattggacacattgcacaactgctctgttctgtatgtaatttatcttctctacaaatgtaacattgacagttgcattaaatatattctgcaaatatgtaaaagttaaataagctgatgtctgctaaatgattaccaaggcacaatcacataatctgaagttatattttccagagtgataggattacctccagagttttccaggacactctcatctgctccgggcactgccttctcctcagccgtcccacccctgagcttgctatatagtaggagacatggaaatagggcccactctctgctgataaaaaccagcccaaccccgaccctgcagctctgggagaggagcccagcccccgaattcccaggtgttttcatctggtgatcagcaccgaacacagaggactcaccatggagtttgtgctgagctgggttttccttgttgctattttaaaacgtgatctatagagaactagagatattgagtatgaatggatatgagtgagaaacagtggatacgtgtggcagtttctgaccggggtgtctctgtgtttgcaggtatccagtgtgagatgcagctggtggagtctgggggaggcttggcaaagcctgcgtggtccccgagactctcctgtgcagcctctcaattcaccttcagtagctactacatgaactgtgtccgccaggctccagggaatgggctggagttggtttgacaagttaatcctaatgggggtagcacatacctcatagactccggtaaggaccgattcaatacctccagagataacgccaagaacacacttcatctgcaaatgaacagcctgaaaaccgaggacacggccctctattagtgtaccagagacacagtgaggggaggtcagtgtgagcccagacacaaacctccctgcagggccatgcgggtggtttcctttctcagctgcaggaggcgggcttattgttgcaggactctggagacttattaggttgtgatattttactatggttatttatcatgaacttttttattgggaattgtgttttattaatttttattttatatgtaaggttatttttttaaaatacataccttcaagaaataattcttcctaataatttgcacttgttctttttagagttttgttaacatctgttgatatcagctactacatagctatagggacattaatttacatctatagacatatgtgtaaatacacaaacttatacatatatgtggtcttttatatttaatgttataataaaattattataacaattataaaatacatcctaaagaatgaaacatatatagtaatccatattcctttcaatcattgcctatagtttacataaattgatgtctatttgtaaccttaaacatagtgtattggtcattttcaaacatccaagaacaaatttcaaatgtccttgtcacacacacaaaaataaaaatttgaggatttgaggtgatatatatgtcaatcagctcgattcaattattccatattgcattcataaatcataacatagctttattcactataaatacatacaaccaaaatttctcaattttcaatgaaattttaattatacatattttatctgtcctaggtcatgaatgtttttctccctgtccggatgtgattagattgtcctgagaaacaaattcagcttcctgcctcctgaaggcttcaggaagcagctcctagatggggtgaagcaggcaacccgtgtgtgtccacaggacccggagcctctctctccttggattaggccccctcctcaggattacagggctcttcagttttctcaacatgctgttataccagagaagcacaaaacacttaatttcattatatttttcttcaatttttcaaaacaacacaaaggtaataattttaacaataaacatattacaacctactatacatgagacccttcctgtgcttcgaggtttcttctcaggactttgtatgtattacatgttttcagtttttttctgagatggaatgttgacgtctccttattacagattattcttttaatttgtctcttagaataattttttccagagctcctgcccgcccgcgcctggcggaatggagcggcgccagggctgagccaggcgcgcaggggccgccgcacgtgccgcgcggggagcggatgcccagcgggcggagagccagcgccagaggccgggtcggagcggccgctggagcagcgtcagaatgggagaacagcccatcttcaccccccgagcgcgggtcttccagattgaccccaacaccaagaagaactggatgcctgcgagcaacaggcggtcaccatttcctgtttctatgatgtcacaaggaacagctatgggatcatcagtgtggacagcgccaaggtgaccataaacaacacaattacacagaatatgaccttcaccaacacgtcacagacgtctgggcagtgggccgacagcagagccaacacggtgtttggtttggggttttcctctgagcagcagctgacaaagtttgcagagaaattccaggaggtggaagaagcggccaagacagccaaagacaagacccaggagaacatggagccctcgagtaatcatcctgagaatcagggcgtggagccccatcttctactccggcatccagtgtcaacgggacggacgatgaaaggcctctcaggccgctgcagccgacacgcacctgcagtctgggaaccacaagctgaaggcggcctcgacgcagagctgcccacgggaagaggtgggagatggagctgcagacccggcgggagaccgacttccggctgcccacggcgctgcaggagtcgacggccagtgcggagcagaggaagaggccgtgagtcagagtgcgactgtgtctctgagaagatggaggcggcagagagaggatcaaaacctggaagataaagtgcgttccctaaagataggccctgaggagagcaaatcccgacagcgccacctggaggcgcttcctggtggcgctggaccggaagatccaggcctgcataacttccgcccaggcctcccaggctgggcaccaacaactagggctggcagaggcccgggatccccaacgtgagtcctaagtatgtgtgcgagaccagatggcgctaggacgttccctgtgtgcgttgcttctgtaaatgcaggcgccgtgtgtcgtgtttccaaaccagttgtgccatccactcactcctttccagaatagaaatctctcgcttctctggccttgtgaggttgtggacaactggaagattctgactgaggaaaccagaaccaggtctaccttcaacatttacgcagtcaggccagggatgtttatatcgttcataagggttgttggaaccatatgaactgaaaaaaagcattttctcatccaaatattgatattctttacaccaggccatcgggctccttttatccgatagcattcagagtatttgaaggtcctccaggtgccagccttgggggcacagggagaacaacattcctctccgaaaacatggggaagctttaaaataactgtttagtggagacttgcccagagatggaaaacaggtttctggtgagtacattttctggtttgggaatcacctgcatccccgatcctgccccgtgccccccagtttgtatggttgtgacaatgttccatttctttgttttaatttctgagcagttgactgtggtgcgggaacagcacacagtgagggtgcctagcacaatgcctggcgcaaagtaggtgctttataaatatttgttcaattaaaaaaaaagagggaggctgaggcaggagaatcacttgaagctgggaggcggaggttgtggtgagccgagatggcgccacttcactccagcctggcaacagagcaagactccatttcaaaaaaataaaataaaataaataaaataaataaataaaataaaaaatattttttccaagccccactcaaaaccatggtattgttagaggtgtaatagttggaccaacattgaaaatacattccatttagttcatgggcgtgcaaatatccttttttctttaaaaattgttctcagttgtaatattacaaaaaatattggtaatttataccaatgacacaggttaaaatgttgtataaataatttaatgacgtttgattggaaaaaatacatgtgccacatgtcgacaattttttccttctctatgaaatatatactcattaataagtttcagatgttacagttatctttttgatttctgggatttaattttagtaggtatacttgaatgcattttattaattcctataatgatgttgatatttcatgtaggattttaatactaattttactatttactgaattttaaactattctacatgttttatttatataagaaaaaaattacatatgagaaaaaatgcgtagacctgaaatgtatcactagagagtttctgtcaaatgtgaatacctttgttcccaacacctaaggtagcctgaagagcaagtccttccccacaacatgcgtctttttctgtgcttgcggtcagctcctgcatggggaaatgttttgatttctgacactatagatccattttttttctgttttgaactttatataaatgcaatcaaacattttagaccttaatttggtaatgggctacattgctattttttgaggttatttcctgctatttaaggtattaaattagatcaacatattatcatttattcaagtaatggactgactctgatatgaaacctcaaagttttcacatatatatggagagagagagagagagagagagatgagggagagaggttttatatctgagtcagtctgttaaataagtaaatgacagtattttgatttattttcctgtaaatcgactttaaatttgtttccagtttatgaatattataaacaaagctgttacaaatgtcttagtgtaagttttcctatgttgtcttccttttattgagaaaatatgaagtatgtatttattataagcttaaattttttcagttttattgaggtataattgaaatattttaataatgtatagctttaaggtgccccacttgacgttttgatgttgtattagtccattctcacggtgctataaaaaatgcctgagactgagggatttgagaaaaaaagtgtgtttaattggctcacggttctgcaggctgtacaggaagtgtagtggcttctccttctggggagagtcaggaaagttaggatcatggcagaagacaaaggggagcaggtgcgtcacatggccagaccaggagccacaggaagcagggaaggtctacacactgttaggcaactagatcttatgagaactcacacactgtcatgagaacagcaccaggagtttgttctaaaccattcatgaaagacccaccccatgtcccagtcatctcccaccaggtcccaccttcacaattgaggattataatacaacatgagatttggggcaggacacagatccaaaccacatcagatacacattgtgaaatgctcatcatggccaaggtaatttgtatatccattttctcatggagctaccattttatttttttaaaatgtactacatgtgtgtgtatgtgtgtgtgtctcatgagaacacctacgatctacccgttcagcaaaaatcacatttacaatacagcattaaatacaagaacattgcagtacattagatctgcagaactcattcaccctgcacaactggacctctacccttcgaccgacatcatctgatttccctctcctcacaggcctgggacccactattctactctctgctttcaagagcttgaatattttagatcccacatgtaaatgagatcattaagtctttctgcatctggcttattccactaagcatcatgtcctctagccccatccctgttgttgcaaatgtcagaatttccttcttttcaaagcctaataaaattcagttttctgtgtacacattttctttacacattcatcaatctgtggtcattaaattattttacaaatctacactattataaataatcttgcagtgaacatgtgtttgacataataattttatttcttttgaatatatgacaagaagtgggatcaccagagcatatgatagctttatttttcaatataatgaataaccaaacctaccacaccatgcttttgaagtcttagtcatattttatttgcctaggccaatgtcccgaaaaatttctcctacattttcttcagtttgtacatttaaatattgaatccatattcaattaatttttgtctatggtgaaaaactagaagtctagttttattcttctatgtgtggctgtctaagtttttcagcaccacttactgaatagagggttgtttctccattgcatatttttgtcagttttgtcaaagaacaggtggttgtagaaacttgtctttatttcttggctgtctattcttttacattattattattgttattgtttttagtagcagtaccatgctgtctttcttactgtatctgtgtagtataatttgaaatcagggaatgtggtgctttcagctttggtctttttccttgggatttcttttgctattcaggctgttttttgattccatatatatttaaggattttttttaaaacatgtaatcaattatattggttacttgataaaaattgcattgaatatgtatcttgctttggacagtgtattagtctactgtgcattgctataaattaatgcctgaggccaagtgatttacaaagaaaagaggcttatttggcttacagttttggaggctgtgtgagaagcatggcaccagcatctgcttcttgtgagggcctcaggaagcttacggtcatggtggaaggcaaaggggaagcaggcggtgtcctgtggtgagagggggcacagaagaggggaggagggtcgctagactgtttttaacaatcagatttcaaattagctaataaagaaataattcactaattaccatggggttgataccaagccatacctgaaggatcttttccccacaatccaaaaactcctactaggacccacctcaaatattttggatcacatttcaccatgagatttggaagggacaatcacctaaactgtagcatttcactcttgtgtcccctggtctcaaatccttgtaagattgcaaaatcatctttttttaaaatagttcccaaaagtgttaacttgatcaacctccaactgaaaattacaaagtctcgccagggtcttaaggcaatttccctccagctgcgtgctggcaaaatgttttaaagagttatgtacttccaaggtgcaatattgccattgggtaaatattgtcaatacaaaaggaataaattggccaaaggccccacacacacctaaagcctagcaggacagatattaaatcttaaagctacaaaataatctatcttgactttatgttcttagtcagggtacaccaggacaaagtgggtcccaaaatcctcaggcatctcatccttatggctgggcacattccatggggctaataacacaggccagagtcaagtgccagaagtagttccaggttgggagtacaagctgcctttggatctaccattctgggatcttgagggttgtggctgcatttctgtagctccactatgaagtgccctagtggggactctgaatggggttccaaccccatctttccccatctttggtactgccttcgtagaggttgtttgtggtggatccagtcctgtagcaagcttcctcctgggcacatagggttctctacacatcttctgaaatctaggtagaaactgcccagcctccttcactcttgcattctgcatatctgccagaatccagttatcccagcaccatttactgaacacagaggtttttttccacattgtttgtttttgtcagccttatgaagtatcagacggtttaggtgtgcagctttatttctgtttcctattttgttccgtttcttctgcatatctgctcttgtaccagtaccaagctgtttttgttaccatgtcattatggtgtagcttaaagttgggtatcatgatgcctctggcgttgttctttttgcttagcattgctttggctattcagggtcttttttggttccatacaaattttagaatagattattttttctaattctgtgatcaatgatgttgatagttttatgtaaatagtactgaatctgtaaattgctttagacagtatgataatttttacaatattccttcttctaatccataagcatgaaatgttttcccatttatttgtgtcatgtatgatttatttatttatttatgctgtgttttgtagttctccttgtagagatctttcaccttgtttgttacctgtatttccaggcatttcatttgtgtgtgtgtgaatattgtaagtgggataagactgtgttcttgatttcactctcagcttggacatagttgggtatagaaatgttagtgattcttgtacattaagtttgtatcctgagactctaccaaagttgtttatctattttagaattattttggcagagtctttagaattttctatgtgtagaattatatcatcagtttggacagatatatctacttcttttcccatttagatgttgtattagtctatttgcacactataaagaaacacctgagactgcataatttataaagatttttaattgtctcatggttctgcaggctgtacaggaagcatggctggggaggcctcaggaacccaacagtcatgacagaaagggaagcatcatgtcttacatggctggagcaggaagagagaggaggtaggtgccaagtacttggaaaccacatctcctgagggctctgtcatgggaacagcacaaaagagggtgaagcatccccatgatctaatcatccctcaccagtccccacctccaacactgggaataacaatttgacatgaaatttgggtggggatgcaaatacaaaccatatcagctccgttttattttttctattgcctggttgctctgactacgatttccagtagtatgctcaataggagtggtgagagagggcatccttgtcttatttcagttctcaaggggtttgagcttttgctcactcagtataatgttgagtgtggttttgtcatagatggctgttattattttgagttttttttttttttttttgagacggagtctcgctctgtcgcctaggctggagtccaatggcacgatctcggctcactgcgacctctgcctttcggggtcaagcgattctcctgcctcagcctcccatgtagctaggattatggttacgggcatgcgccatcacgcccagctaattttttgtatttttagtagagacagggtttcactgcgttagccaggatggtctccatctcctgacctcgtgatccgcccgcctcagcctcccaaagtgctgggattagaggcgtgagcccccgcaccaggctattttgaggtattttttgatgcctagtcttttgagagtttttatgagtgaatgttggatctcatcaaaagctttctcagcatgtattgagaaaatcatatgttttttgcttttattttgcttacatggagaatcacagttactgaattgtggatgttgaatgaaacttgccttccaggggtaaagcctacttgatcatgacgtatcacattttaaagtgcttctggattctatttgttagtattttgttgagaaattttaggtctatgttcaccaagaatattcatctgatgttttcttttttaattatgtatcttcctgattttgtatcccaaggacacacaatgaaggaaggacagtctcccaacaaatgatgtaaaaactggacatccatatgcaaaataaataaaattagaccttctctaacaccatatacaaaaatcaacaaaaataaacataacatgaaaccataaactcatagacaacatggaaaaataattcatgtcattgattcagaaatgatttatttgaagttaatcccaaaagcaagcccagcaaaaaactacatgcaattatatatctgacaagaagttctatcaaaatgtataaataatccatacaactcaatagcaaatatcaaatgacctcataaaaagagcaaaaacctgaatagatttttttcagaagacacatgcatgaaaaacagagcataaaaatgtcctcaagatgactaattgtcagaggaattcgaatcaaaagcacaatgacatatcacctcacaccacttaaaatggctattatcagcaagacaaaagataagaaatgttggcaagaatgatccacagccataaagagagctttgattggccaagagactgatttcagtaactttctcctgtgaagagaccactgaccatggacttgtcctggccaatttccagaggctgtgcactgtgtgtctttctgcccctgcacaaagcccttttgatatgcaggacccaactgtaattcatttagttcttaagtcctcaccccaaagcaaagctgaaatgcatgtatcatgtgtgtttgcttattagacatgagagcctccactccatgtgaatatccatagctccttctatagcctgctgagtgtgtacactcgaccaatccatttgcacaaatttgtttctcatctttccctctcttaaagtgcctgctcacagtctctgtgggaggctttccttcccagcctgttaagatggccatcctgcagcttcaaccctttctgagaaataaagtctcctttctaaatttataaactgggtgattcttccgttgaaagcacaagctgttgggaagagttatatggcaattccataaatgcctggaagacaagtgtggatagggtagggtaagaagtcctgggggctgcacaccccactctgatggaatttccctccagaaacttctgggttctcaagatgagaatccaaacagattccctcatggctctgtcatcaggagaactatactctgataagtatgcccagaacttcctccagacagaccctatagggaaaaaatacttttcaagatctttattctgtgaggggaagggattcttttccatcccagacagcttcatcttagccttcctgagtcatgaaaaggagtataattaataaaacatctggggtcagattcaagaaaataatctgtggatgctgcagccaggagggggagtggaggacggaggaaaatcagctgtaccactgaatactccttgtaaatggtacagcctagagaaagaatagcaagaaatcattggaattcaatttccagaacatatactgctcccctacccaccacatcacctcaccaccaatatgattaatctggattaaagagaaaagtgtggaaaggcacagactccatctaaggactagaatttagggaaaccaaaggcagtgggagagaaaaagtcaaggacagtaaagtgacttaaaacctcttagaccaacagcttcaggaacaaggtcacatcctctccctcactgaaattagatttacctctcatggggcatctgcagggtgcgcaggtgagaactggcaaagagaacatgaaggcactttccaaatctccattagtacctagctcgctttagctgtttggaaaaagcaaaaccacaacaaacataaccaggactaggatcagtgttggaagcacttttcactggcaagacactaagaaggagggcaaattcgaggccagttactatgcaaatatgccactgtgagtgtgtgtggtggtgagctttgagacatagggtctgtgggtaaagttataatcgataaaatcttcaaccacagaatcctaaaaaaaagagccttccccaaagtcccatcagttcctggactcgccatgtgtctggaccgtatcagtggatccggagctccagggaaggggctccctgatggcttttatgattccttgcttgccgtgctgaggtctccctgtagattatgttgggttttctaaggcctattttctattgtaagaggtggtgggggaaacaatttctgtcactgaaagagcattctgagccagggcacagccccttcctactgagcttgagattctgggaggaaaaagttctctgacaggaggaaaaagttcccagacaggaacttccctgcagggcaggagctgagcggcagggggcgctcagggagcacccagcacaggacccagccctggggcaggtgcacaggaggctggggcagggttttctctcaggaattgaatgttccttatttcaaagcaataatgacctaacatttaaataagaatttagcaagtactgatgtgcctgtaagtattttattgtatacgcagcctatacctaacccaataatttaatgcaaaccggatttaaaaggagaaatgtctaggtctttcaaatgtatttctagttaggaattgaggggtggttttattaattcaatgggtgttactgtccggagacacactcatcccagaagttagatgtgcagagggcaaggctcaggaaaagttcaggtagacagtgagccatatgaacagggaatcacattgaggaccatgtcctgtgagattctgggtttctgtgagaggagttctgtcttcatggacttctgggcatgtcagaggacaaatattaaacaaagttcagggcagggagctcagcatcccactgtggcgtggtccacatgtcacctatcttcttcctcagggtggcgtggcctgagctatgaaaaacctgcctcatgaatatgcaaatgcactgctgtctaccgaggtaaatacagatctttccttgcccagagaccatcacacaacagccacatccctcccctacagaagcccccagagcgcagcacctcaccatggactgcacctggaggatcctcttcttggtggcagcagctacaggcaagagaatcctgagttccagggctgatgaggggactgggtccagttaagtggtgtctcatccactcctctgtcctctccacaggcacccacgcccaggtccagctggtacagtctggggctgaggtgaagaagcctggggcctcagtgaaggtctcctgcaaggtttccggatacaccctcactgaattatccatgcactgggtgcgacaggctcctggaaaagggcttgagtggatgggaggttttgatcctgaagatggtgaaacaatctacgcacagaagttccagggcagagtcaccatgaccgaggacacatctacagacacagcctacatggagctgagcagcctgagatctgaggacacggccgtgtattactgtgcaacagacacagtgtgaaaacccacatcctgagagcgtcagaaaccctgaggaatgaggcagctgtgctgaggctgaggagatgacaggatttatgaagtttaaatctgtttagaaaatgggttgagtaattgagtaaaacagcaatggaaagatgtgtacactgtcattatgtaggaaatagtattttcaactgtcaccctataagtaacactcacagagtgggaaaggcagccatcaatcaagctgatgcaaacattcccatgggggctttgtggggacatacattttataattggatctataaatcattagaaacaggattgcttgatctcatggtaagactaaatataatttccaagaagtggccgaaatttcttccaaaatgtctttgcccttccttttacattgaatttattttaaaggagttttaggatcacaacaagtttgagtagaagaaacagagttcccatgcactcctgccccccgacgctcagccttctctgctatcaacaccctgcaccagtgtcataaatcggttacagaggatgaatctccacagacacattggttgtttccttttctggtggtccctggtataacaagcctcaactatcttgaagcaccccaggttcaagtggattcttcaagtgggttactgggaatgatgccaggtagaaggaaagtgggtgggaccattcctctttgcactctttcctcaaggatccataaaatgtacatttacatggagctcctctttctcctggttttatatgcctcttccccaatggtaaggtttcccagtgtttacagcgggggtccccagtccccgtgctgtggatccgttaaggtgtgcagtgcgttaggaactgggccacacagctggagatgagtgggggcgagccagcatcgctgcctgagctctgtctcctgtcggatcagctgtgcattagattctcctacgagccgaattcactttttttatatatatactttaattctagggtacatgtgcataacgtacaggtttgttacataggtatacatgtgctatgttggtttgctgcattcatcgaattctattgtgacctgcacatacaaggggcctagactgagcgctccctatgagaatctaatgcctgacgattgcagggggaacaagttcatcccaaaaccacccaccgccatcatccatggaaaaattctcttctaccaaactgttccctggtgccaaaatggttggggacactggtgtagaggcaggtctgtaccttggaaagccagcagcttctggtgaatcccataattaatgtcctttaatgagaagtggagactttggtcatgagggccttcgtgaataatgccctacagttggattcaaaacattgtaagctcttggggggtgtttctggataaagccctttgtgcagaaaatgcagacacatccatgggatccatgcaggaaaaaagcttcctttacaaagtggtttggcacctggaaggagctctcagggttgggcactgtaccctttgctggctgcactttagccagaggcttaagcctgattggtcttgcagtgggagagccttcctggggtcaaaggttacaaaaatgcctgtcatcttccagctgagcaagcccatctgcgtgcttgtcagtgtcaaccccatgaagggtgcactctggaagatgacaagatgcacacaaacctcctcccactgattatccactaccacacactcagctgcaacccgtgctccagaaacggacaggggcctgcaaggataaacagaatggaagtattttattacctgggaaagcactgccaaatgccacgtttcaggaaggttaactcataagtgttcaggaagtgactgaagggcagtggtgggtgaggtgacgggactgcctcagggctgcacatgaggagggctccctcccacacagccttttcctccaggagctgcaccaggaactcacagaggatcaggaaggattctgagaacattcttctgtggcgctgactagaggggcaaaataaattataaaaaataaatcaattctaaatataatatgatgtttgttattagaaactatttctggatcctgtgggaaccctgacataagccaccattctctgtgaacaaacatttaacctctccttccatggggaggtcgacgagcttggattggttctttcatggatagtatcccccaaactcctctccactccctgcgtatccccgggtctctcagtgacaagttctcctcagtggaatttggttgatgtagtgagatcttcaaatttcctgtcgtctgtgttctcatgttctccccttatctgagattaagaaacgcacctgcatgtagtaaattatagcctactgtctctcatggacaaaataatggccacgccaaccaaccttgtggctgacagcaaccactggcggccaccatcccctccacagcctgtgttggaacatcacctgagagattgtgttagcaactttccttcagaatcatcttaaaaactttgtgtcccatttcacatggagacgtcatttttccatttcatcttcatagagaaatagaaggagaagaataccaaatacacttcctatctccagattattcaaatataattgtccctttatcaccttctgatttctggtcttcacagaatactctacaaatttttctcactggcgttataccaaaagttgtgaagcaccagatactgggattaatttaaccaacattattattctaataattcttagaatttagaattacaattatcatcttttcgtatacggataaactaacctatgcctttgaaaataagcccttacatgagagtgaaaagctatagatttggaggatttccttgcaaatccaatatttggaaaacggattttatcacaaatatacaaattaacttacaattgaacaacaaaaccacagaatttaattttaaaatgggcagagacctgaatagaaaccatatccaaaaaacaaacataaaaagtgatcaacttgattttcattaggtgtacttatgtttaatatttaaaaagttctactaaactatgagaatgggtaaaaattacaaggtagacaatatcagatggtgatgaggaagttgaaaaacaggaactttcaccccttgctggtgggaatgccgaaatggcacatagaaaactacagttaataatttattgtatatttcagaatagctacaagataagatttggaatgttcataacactaagaaataatcagtgatatagatgaaggatatcctagttatccagatttgatcactgcacataaaatgcttttatcaaaatatcagttgtaccacctaaatattttgaaatattgtgtatctatataaatcaaacattaaaaaacaccaatgcagtggaatccagctaattgcagattcccattagatgggatgtgctgcatgatctgtaaactaatcagaatctgtgggtttgtaaaggactttagaaatcaactaggctgcttgtttctaaagataagtctccctagtttaaatattttcttaatgggtggcgattttgaacatagaagaaatagtaatatttgtgtcttgtaagttttcttcttctcgtgtcacgagaaaaggtttgcagggaggaatctgggaccatctttcaagtctcaacttcactgtgattacctcagtaagtattttctgatacccctgactaagataagtctcgtatctgtcctagaaactaaaagtagaattctaagcatctacctgaccagatggacccttcctcttcaccaaggagttccagagacacttttaaacctagctccggccgtgttagaaatagaggatcagaaatgcctcattataccctcctccctttggaattcaagcacaactaaccagcatttttatgaaaacagagcttaaggctcagaaaacagattatttgtagcagtaagataccaaattctaaccttattcgagaatatcatcacaggacagagagcaggcattgaaaggaatcaaaggcttttaccctaaaatatattcctttgacatattttaaaatagccaggcacagttatcttttgtgagagagatttacattctgtagagaatctccttccctttccaggtctttttcttataccgaggagattagctgagggtctagcttcttttaaaggtcttaggagaaaacatttcccagctattgcctctaaaggtggtcacataagagacttcatctacatagtaagaatcttgttctccaaaacctgttatcttaacctagaaacatttttctaccggtttcaggtctttagaaaaaagcttaaatctttcaatcaattgtcaatcagaaaatattcgaactcactgtaagttgtaatccccgccacacactgcctcacttctagctgttttgtctttatggaccaaatcaacatatatctcacatgtattgtttggtgactgtctctctagtacactaaatttaagctgccatcaagccactttgggcacatgttctcaagatcttctggggctgttcacagttcatggtcctcacattcgcctcagaataaatctctctaaatattttgcaaggttgctttttcatcagtagttctaacagaacctactctgtggtttttgttaaaagcattatattaatatagtattagtaatattagtattagttataacacatgttggaaaattcttatgaagttatgcatagactaacaatgggatcaagtgtaaatgtttcaaagtatttaagcaagttatttcaaaatttatcttctgcagatacttctatcagattcattatatcagctaattacttgctttatgatttttgcattttattgtagatgatcacaccctatattttcttggcctttattgtagaaaattgtgtgaaactagtcagggctacatttgcaagtaattgtcgcagtggctgcctgaattgcagtgggtttcctctgcagccaccagtcactcagattactccaatgacaccttaattttgtttcctgcttggctttgggccttagtcttgtgctctccagacagactctgtctttcatctcccctaggtcaggccagagccacatggacctgatgattgtcaatatggtgggaagggtcgcactgaacgggcactctctgtccttctgagggagccatactgcaggcagacatggcagtcctggctcagggtgtgtccttccaagtatccctgcccttccttcaggtgtgatgctgatccatgcatcttcctcccattcctgggtagagggtctccttgttctttccccaatcttctcccagcagccactatgtcttcccactgatgtcttcagcttcctcttttctgcccttcccagcagatgagtctgttattcctgagggaagagagaggaggtgggagatgaggctgttattcctgaaagaatggacagagctttggagcttttctttcttctaccccagtttctacgagttcctccagtgcctgtaacacagagctgtcagtggctttgcccctgcatgttaattctttggtcatgtagtggtggtgagggagctgggtctggatgcatttcagccacagctgctgttccacttccccacacagaaccgtctcaggaggaagaggttggagatttttctgatgtgtcctcaatcctgggagaaaagttttcaatagcaataggaatctctcagttgtatgtccgctgagaatttaaacaataacttctttataatactaaattttaaacaatccaatgaatatatctaatttaattttgtattagcttatgtgacatttgctggcctctcccccagataaggtcatattctcttcctgtttgttcctgcaagtcactgaatttcacaagatgtaaggtctcttgattatactataacatcaataatctggtgtactaaagaaaatgtgctaatttgcagcttactaaaattagttgttttagtaaaaataatatatttgttatagcatgcctacatctccaggctgagtagaagctttgtttgtaatactcagaaactgcaaataacacacatattaaggagctttctaaataaatactatgggtgaattctttaactggaatactgttcctcattagaatcaacacattctttatacacaaccaaattactgactcacaagtaattatactgagcaagaagccacacaaatgaaattgaaaatataagatttcactttaacaaaatcttgaaaaatagatctgaattaacaaagatgagaggttgactcagtatggtgagagggaaataatggggaggcaggaatgagaggaacacagggaggcttttaactgtaatcatcgttatctcgattgttattttggatacacaggtgagcacacgtgaaattacgttttttttccttcggagacatggttttgctttgtcgtccaggctggagctccgtggtgagatcatagctctctgcagcctcagaccctgggtctccagcaatcctcctccctctgccctatgtagctgggactacaggtgtgcaccaccatgctcggcttcagtgcgtattaaaccgcacacttcaattatgcagtatttattatatagcaataatgcctcaataagggtattacaaataagtggatagataatttgttaaagattgatggaaagatagataccaacatgagaaatgtatgacactcaagaaaataaaactgtaggaaacttgcttttctttatatttgttaggtaatcaccacagtgtgtacacatcacaccatgttcccattacagagaaaaggttctgcgaacctcacgagctgtgacccctgtgtgctgggcttggttcagggagaagtcaggtccagtggtgagaagcacaggcccagatgcccaggctcactctgaccaaatgtgagcactggggacattgtaaaacccacctgtgcttttgctgataatttttcatctttaacatggaaataatattgatactatataccatggtttctctgcgtatgtaaaaataaaagatgattggtgctaactttaaaaatatgcagtttatgtagatctatggtacctcaataaaactgttttaaaataaaaattacaaaattataagattttcaggttttaaggtttaagtttatcacaaaacaaactgacaataggaaagcacaatttcccaatgctttcaatatcacagatctccccgaggacattctgacatgctctgagccccactatctccaaaggcctctcaccccagagcttactatatagtaggagatatgcaaatagagccctccgtctgctgatgaaaaccagcccagccctgaccctgcagctctgagagaggagcccagccctgggattttcaggtgttttcatttggtgatcaggactgaacagagagaactcaccatggagtttgggctgagctggctttttcttgtggctattttaaaaggtaattcatggagaaatagaaaaattgagtgtgaatggataagagtgagagaaacagtggatacgtgtggcagtttctgaccagggtttctttttgtttgcaggtgtccagtgtgaggtgcagctgttggagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaaagacacagtgaggggaagtcattgtgagcccagacacaaacctccctgcaggaacgatgggggggaaatcagcggcagggggcgctcaggacccgctgatcagagtcatccgcagaggcaggtgcagatggaggctgtttcctgtcagggtgtgggacttcatcttcttctgacagtttctctagtgaacctctctaacctcagaattctgtgcttactaatgtcatctctacgtattttttaaaagatcattttaatatgagcacctattctcacacgcaccaaatgcagattgacgcttacagagatgaaaagttctcaaccatggtcaccaggatgagagtcctgaggaaattcaggggtgcctggtgactcttccgcaatcagtcctgggacagaaacctcagggacagcctttatgagttttgatcacatctaacagagaggatgggccagggccagagtcatgtagaacctcacaggttccacgtctgacccttctcctgacactaaagccaatcagcatcagcactgacctggtgctccttttgctcccaatccatgttctttctttggagagtttcttctcccttttttatttgcttttcctctttcctgaaaaagaaacagatggtccccttggtccacattccagggctcaaggcattttcttggagctcaggtggggctcaggctgtggctcctgcagccacgtgggagaggctgatgggacttccttctctccccattttctcaggaccctctactgtgttgtgtgtaggctcatctgggaatgcagttgaccattaatactgaaggggacaaactcatttgatcaaaatgggatgtggatgtggagttaaccctgttccgtgcacagtgtcagagtcgtctgcttcagaagtagtgttagaaagagctggtgaaatttatcagaatcaagatggagccacttgtgttaaagccctaatgaatgaagctggggaaggccatgaaggagggttctaacacacatattcctgataataagaactaccataaatagactctgcacaaccataaccttgcacagaagccaccacaacattaaaagaattacttctcccattgtatctgcccagcaactccctgttcaactttacaccgatgtgcccctgttattgatccttctagcccaggacaattgtcttaaacagctgatgtgaccctcctcatttttcctttattctttatcttcctataccaacctgaatgcacccatacatttcaattgcaatacacttcctagaatacatattattatattttagagtctctctctctctgttattcagggttgacaagctacagatggacatgccactttctttttttatgactttttttaaaaattttattattcttgtactttaagttttagggtacctgtgaacaatgcaggtttgttacatatgtatacatgtgccatgttgttgtgctccacccattaactcgtcatttagcattaggtatacctcctaatgctctccctccccactacccccaccccacaacagtccctggagtgtgatgttcctcttcctgtgtccatgtgttctcattgttcaattcccacctatgagtgaggaaaaaaatgatgagttcatgtcctttgtagggacacggaagaaactggaaaccatccttctatcattctcagcaaactatcgcaaggacaaaagacatgccacttttctgtgagatgtggaggatgacagtttttggagatgtctgggaatacccagtgtccagaagatcatccatcaataagtgcaggctggaggtcccagagagaggcaaagctgctgaaacaccatggaatttcattttctccagttctgctctgatggaatcaggcccacctgttttgcttgtcttaagtaaattcacagcaccacatatattagtgttgcagtgaataactacaaagtctatcctaaccaagtgtaccatcaaatttaccattacccagagggaagaatctttaacatgagatctatgttcataattttttaaggtgaaaaagtgatcactatccaatcaggcaaatatgattttgctaatgagtggtagatgttgcatgtatttttggatgtcatccctttttcagatgcatggcttgcaattatattttcccattctgtaggttggaattatttccacactttgtagaatctttttgttgtgatgtagttccacctgtttaattctgcttttgttgtctgtgcctttaatgtgaaatataggaaatcattgttaatatattattttctgggtcggggaaattttacaattgcaggccatatgtttaaatatctggcccattcagagtgatttttgtgtttattctaacccaaaattcttaactctttgcatgtgtacatccagtttttctaacacattcatagggagagacttggtttatctgttttatattgtgggttcttatgctgaaaatcagtttgccattgatacatcagtttatttctgagctctttctacatatttatgccaactccatcctgtttttattattctacttttgttattacttttgaaatctggaagtaagatgtaagtttatttttgcctttttacagatgctatagcaaaatattttaacctttcactcttccatataaaagtatggctttaaataatgacttttattatatacaggttatattcttgtattcctaacttttagaggttttattatgagatcttgaattttttaaatgttattttctatgtctggtgagaagttaactgatgcttttcctttattctcttaatttaccacatcagatttattgatttgaagatattgattcatcagcgcatctcaaaaataatttggagcttgtcatggtgtacaatccttttaaagtcttatagaacttagttgactatgaattgggagtagcttgtttatatatactaagaacatttgtcagaagctctttcttgtttattcccagtttgcacttacatatactataaaacataatatataaattttttattcctttcatagttatataatatagcaattacaaagataaaaactgcacttcatcttgattttcccattttgtacagtcttaatttcttcgtatagatttatgttttgaatgtatatcacacggctactagcagagaaagtttgttaaaatgtgcactgaagcatgaatgtgctgacaataaattgtctcaagatctttttgtaatgacagaattttatttgcctttcacttttaatgaaaatgtaatgcacatagaattccagtttgcatttcacttgtaatttattttcttgtgtttattattttgttcatggagatgatcacacattacattctgctgggcctttattaaccacatttctatgaacctagtcagggttggatttcaagtgtatggttgccacggctatcagagttgaagtcagcttctcctgttcacaaaaagttcaggttcctccagtgatacccacttttgtgtcccggtttggctcttcccatttctttctccccagagagagcctgtctctttcatctgtggcaggtgcatcctgctgacacttttacttggtgattgtttgtggggtgaaagggcttggacacagggggatgttctccaaccttctgaccaagcatccttcttagctatgggtggtgagaatggctctgaagcatggtcttccaagcgttcctgttccttcccttccccaagtcagagtgtctctttctagccacagtggtcttccatcagtgtcctcagcttctgacccactgtccttactccacagactcaggatttcattcctcaggaaagagacgggaggtgtttctgggtagagtctccttagtgtcctctgtttccttctgttctagttgattctaccagtgcctgaaggacacaagatttaataaatgtctcccacatatcgtgaagagggattcagcattgaacggagctactgttcttcctccccagtcaacatcacaggacagcaggtggctgagttgtctggggatttctccaattctgtaggaaaagcccgcaagtgccaggagtttcacactctcacagcattagcacacacatcctcaacaactcatgaaacatttccaggttagctttttcctatcttcaataccatacaatgagtggcacctgccccaggtactctaataaatggacctagttttctctgcaggctccccattttctcagatttcaggggtttttttctctgcaacatcaactcagatatgttgaagggttcattttttgtagttcttcaagtttcttgttaatgaggtcagaagaagatcattttctcatttttttttttacattcccgtgcttagtatctgctttctaaataaaattcggaaactaagacaaaatatcaaatatccactatttggtgcattgttaaactatttgagaaatattcatgtactgaaatacaatgaacaattgaaatcaaggcatgcctcagtcacataagaatgtgaggacattatcaaataattgtgctgagtgaaggaagctaaagaattcacagtaaatctcctgtgatttcttttgtataaattgtagaaaatgcaactattctaaattaacatggagaagatctgaatttttctgagaaaagtgtggtgaggtaacaagatggtgaaataaaattacagagaagtgagagaaaaaaatttggaggttaatttaattgctaatagcacgattgaagtgctgattcaaaggctgcacacatataccaacattttccatatcgtacactataaatttgaattcactattgattgaatttttgaataaagcagtaacaaaaatgagtatattggctgaggaagagcaagaaagagatgaatattgacacttgaataatcacggactcctgaaaatacacacatgtgaacactgattgcatatttcaggtaaatactagaaaaagcaaagtcacataaagtcgttatgacaggtgggataccctgcaaatcacactaggcatgtcccacactgccctggagctgtctcaggggagcagtctcctccagtgtttagaggcacaggcacggataatagggctgacgctgtccagatgtgtgatattggacacattgcacaactgctctgttatgtatgtaattcatcttctctaaaaatgtaacattgacacttgcactgaatatattctgcaaatatgtaaacattaaataagatgatgactgctaattgatcatcaagtcacaatcacataatctgaagttatattttcctgagagataggattacctccagtgttttccgggaccctctcatctgctctgggcactgccctctcctccagcgtcccactagagcttgctatatagtaggagacatgcaaatagggccctccctctgctgataaaaaccagccgagcccagaccctgcagctctgggagaagagccccagccccagaattcccaggagtttccattcggtgatcagcactgaacacagaggactcaccatggagtttgggctgagctgggttttccttgttgctattataaaaggtgatttatggagaactagagacattgagtggacgtgagtgagataagcagtgaatatatgtggcagtttctgactaggttgtctctgtgtttgcaggtgtccagtgtcaggtgcagctggtggagtctgggggaggcttggtcaagcctggagggtccctgagactctcctgtgcagcctctggattcaccttcagtgactactacatgagctggatccgccaggctccagggaaggggctggagtgggtttcatacattagtagtagtggtagtaccatatactacgcagactctgtgaagggccgattcaccatctccagggacaacgccaagaactcactgtatctgcaaatgaacagcctgagagccgaggacacggccgtgtattactgtgcgagagacacagtgaggggaagtcagtgtgagcccagacacaaacctccctgcaggggtcccttgggaccaccagggggcgcccgggacactgagcacggggctgtctccagggcaggtgcaggtgctgctgagggctggcttcctgtcgcggtctggggcggcctcgtcgtcaaatttccccaggaacttctccagatttacaattctgtactaacatttgatgtctctaagtggaaaacgtttttgtcctttttgtttctttgtttttgtaacaagaggaaacatcctcagctccacagaagccagggtgtcactttggggacagaaataatcctttcatggtcaccaggataagagtcctgaggaatcccagggaaacctggagagtgttttccagttagactcagggcagagacctccatgggaatctctgattagaacaggccttgagctctgacgggagccaagagagaggctcgcccagggtcagagtccttaaaacctgatggttttcacagctatcccccctcgtcttgtaaactcagactgattcagttgaccctctttctgctaatccatttccttctctgtaggtttgattctcacagttcgctttcttcttctcttccctgaaaacagacgatgtgttttctgtagtcaaaatcccagggctcaggtctgcaggacctgggtaggctacggggactttctcactcaccattgtctggacactcttgtcttctgtgcatggaggcatttggaaaatgaagtggacattagccatgaagggaataatactagttttctccaataggatattgatgtagagctgatcttgtgcttctcacactgtctcagagtttggactttcacctgtgactttgagaagagctggggatgggcactccattgtgctgtgagctctgggtaacgataattgtagaatctgcctaggcagtctaaggtcaatactactggtcatcaggaaagacagctggaattcctgggaagatctgcatctgccgtccaccatggagtcccatcgtcttctgttatgctctctttgaatcagtcccacctagattatctagaacactcttcctgacttaggaaaaataatggcaggctccactaacacctgtgttatgccatgggagcaacacctaagctagtgtgtgaatgagtagatgagactgtggtctagtcaaggtgacaggtaaaattgattgttgccattatgatattttattttatatttggcaatatagtcatgctcctattataaatattttttgagacggagtcttgctctgttgccagcctggagagtgcagcagcacgatctcggctcactgcaacctcttccacctcccaggttcaagcagttctcctgcctcagcctcccgagaaactgggattacaggtgcacgccaccatgcctggctaatttttgtatttttagtatcgacagggtttcaccatgtgggccagtgtggtctcgatttcctgacctcgtgatctgcacacctcggcctcccaaagtgctgggattacaggcatgagccaccacacctggcctagttttattaatgtctgtccataccagcaactacatacctatggggacattaatttacatctgcagacagatgtgtaaatacacaagcctatacatacatgtgtagccatttatatttaacattataataaaataattctaaaatattttctaaagaattaaacttaatgatgagctaaatataaattagagtaatctataattgatttcgatcattctctatagtttgcataaatggatgtctatttctaagccttaacatagtgtattcgtcattttaaaacagtcaagaaaaaattacaaatgttcttgtcacaaaaaaagataaggatttgatgatttgaggtaatatatatgtcaattaacttgattcaattattctgtattgcattcacaaaccataacatacctttgtgccccataaatatatacaaccaaaatttctcaattttcaatgaaattttaattatatatttttaaatctgatgcctctccttggattaagccacctcctcaggcttacagggctcttccattttctcaacatgctgttataccagatgagcacaaacacattaatttcattatgcttagctttaatttttcaaaacaacatgaaggtgataattttaccaatagacgtattgcaacctactatgcatgagaccctttctgtgcttcaaggtttcttctcaggactttatatgtattgcaaattttcatttttttctgatatggaatgctgatttctctttattacagattatcagtttatttttcaaatttatctcttaaaattaattttttcaaagtcccactcaaaccagggtattattagaactttgaagtgtaatagttggaccaactttgagaatacattcaatttagttcacgtgctctcaagtatcttttcttctttaaaagttgttgtcagttgtaatatcacacaaaatattagtaatttatactaatgacacaggttaaaatattgtataaataatttaattacatttgattggaaaaaaggaatatatgttcctcatatcttgacttttttttcttctctatgagatgcatgtttattaattattaagtttaagatgttacccttgtctttttgatttctgggatttaattttagtacatatacttgaatgcattgtattaattcatataataatgttcatattttggatagggttttaatattaattttgttattactgaattttaaactattctacactttttcattttttgtttttatgcgataaaatttacatataagaaaatatgcatagatctggaatgtatcactagagagtttctggcaaatgtgaatacccttgtccccagcacctaaggtagctgaagagcaagtccatccccacatcgcgggtctttccctgtgcctgcggtcaactcctgcatggggaaatgttttgatttctcacactacagatccatttttttccgttttgaactttatataaatggaatcaaacattatagaccttttttttgaaaggggcttcgatatttttgagattaattcatgctatttaatgtataaaattagatcaacatattgtcatttattcaattcatggactgactctgatatgaaacctcaaagttttcatgtatatatggagacagggagaggaaggagaaagattttatatctgagtcagtccattaagtaaataaatgagaatattttgatttattttcctgttgatgtactttaaatttgtttccattttatgaatattataggcaaagccgttacaaatatattagtgtaggttttcctatattgtctcatttttgttgagaaaatatgaagtatatatttctttttttatttttgattactatttatttatattttatattttactttaagttctgggatacatgtgctgaacatgcaggcttcttacgtaagtatgcatgtgccgtggcggtttgctgcacctatcaacctgtcatctaggtttgaagcacctcatgcattaggtatttgtcctaatgctctccctcccctttcctaatgcttttcctcccctgacacatcccagtgtgtgatgttcccctccttgtgtccatgtgttctcattgttcaactcccacttatgagtgagaacatgtggtgtttggttttctgttcctgtgttagtttgccgaggatgatgatttccagcttcatccatgtccctgcaaaggacatggaaatcattcttttttatggctgcatagtagttcatggtgtacatatgccacattttttcatacagtctatcattgatggacatttgagttggttccatgtctttgctattgtaaatagtgctgcaataaacatacatgtgcatatgtctttatagtagaatgatttataatcctttgggtatatagccggtaacaggactgctgggtcaaatggtgtttctcgttctagatccttgaggaatttccacactgtcttccacaatggttgaactgatttacactccccctcaacagtgtaaaagtgttcctatttctccacattctcaccagcatctgttgtttccagactttttaatgatcaacactctaactggcatgagatggtgtctcattgtgattttcatttgcatttctctaatgaccagtgataatgagctttttttcatatgtttgttagctgcataaatgtctttttttgagaagtgtctgttcatgtccttcgctcactttttgatggggttgttttttttttgtaaatttgtttaagttccttgtagattctggatattagacctttgtcagatggatagattgcaaaaattttctcccattctgtaggttgcctgttcattctgatgatagtttcttttgctgagcagaagctctttggtttaattagatcccatttgtcagttttggcttttgtcgtaattgctttggtgttttagtcatgaagcctttgcccatgcctatgtcctgaatgatactgcctatgttttcttctagggtttttgtggttttagattttacatttaagtctttaatgcatctagagttaatttttgtataaggtataaggaagggatccagtttcagttttctccatatggctacccagttttcccagcaccatttattaaatagggatcatttccccatcgcttgtttttgtcaggtttgttgaagatcagatggttgtagatgtgtggtgttatttctgaggcctctgctctgttccattggtctatataactgttttggcaccactaccatgctgtttttgttactgtagccttatagtataatttgaagtcaggtagcatgatgccttcagctttgttctttttgcttaggactatcttggctatacaggctgtttttagttccatatgaagtttaaggtagttttttctggctctgtgaagaaagtcaatggtagcttgatgggaatagcattgattgtataaattactttgggcactatggtcattttcacaatattgattcttcctatccatgagcatggtatttatttattataaaagtaactttaattttttcagttttaatgaggaacaattgaaatatttttaaatgtatatgtttaaggtgcaccacttcatgttttgatattgtgttagtccattctcacactgctataaagaaatgcctgagactgagtaatgtgaaacaaaaaaatagatgtttaattggctcatttttctgcagactgtacaggaagtgtagtggcttctccttctggtgagactcaggaaagttagaatcatagcagaagacaaatagtagtagacacatcacatggccagagcaggggccacaggaagagagggaggtctacacagttagacaaccagatcttatgataactcacacaatattatgagaacagcgccaagagtcagtgctaaaccattcatgaaagacccaccccatgacccaagcatctcccactgggtcccagcttcaggattgaggattataatacaacacgagattcaggccaggacgagttgcaaactgtatcagatacacattgtaaaatgctcatcatgatcaaggtaatttgtgtgcctatcatcccacatacattttttttttaaatggagtgtgtgtgtgtgtgtgtgtgtgtgtgtgtgtgtgatgagaatatctaagatctaccctttcagcaaaaatcacttttacaacacagtattaaatacaggaacattgctgtagattagatctccagaactcattcaacctgcacacctgaaattctgtaccctttaaacatcacccaatttccctctcctcccacatcctgggacccattattttactttctgctttcaagagcttgggtgttttagataccacatgtaaatgagataatgcagcatttgtctttctgcatctggcttattccacttagcatcatgtcctccaggcccatccgtgttgttgcaaatgtcagaatttccttcttttcaaagcctaataaaattcagttttatgtgtacacattttctttatacattcatcagtctgtggtcattaaattattttacaaatctacactattataaataaccttgcaatcagcatgtgtttaacataataattttacttatttgaatacataacaagaagtgggatcaccagatgatatgatagctttatttttcaatttattgagtaaccaatcctaccacaccctaaaaggattctcttttcaccacattcttgccaatatgtgttatatgtcttgctgatgatagccattttaagcagagtgaggtgataactcatcatgattttgatttgaattcctctgataattagtaatgttgagaaccctttgaggctctgtttttcatgtgtgtgttttctgaagaaaaacctatccagtttttgccctttttatcagatcatttgttatttgctattgagttgcatgagttatttatacttttggatagaacttatgtcaggtatataattgcacatagtttttttcctgtgcttttttctattaaattcaaagaaatcatttctgaatcaatgacaggaagtttttttccatgtgttctatgagtttgtggcttcaggttatgttcatttttagtttatttttgaatacggtgttagagaaggtctaattttatttcttttgcatatggatgttaagcttttacatcatatattgaggagactgtccatccttcactgtgtgttcttgggatacaaaatcaggaagatgcataatttaaaaagaaaacatcagatgaatattcctggtgaatatagaccgaaaagttctcaacaaaatactagcaaatagaatccagaagcactttaaaatgtaatacctcatgatcaagtaggctttacccctggaaggcaaggttcattcaacatccacaattcagtaactgtgattcaccatgtaagcagaataaaagcaaaaaccatatgattatctcaatagatgctgagaaagcttttgataggatccaacatccgctcataataaaagccctcaacagactaggcatcaaaaaaacttacctcgaaataataagagccatctatgaccaatccacagtcaacattatactgagtgagcaaaagctcaaaaccctttagaagtgaaagaagaccaagatgccctctcaccactgctattgaacatagtactagaaaccctagtcagagcaaccaagcaatatcaaaataaaaggcagctgatatggtttgtacttgtgtccccactcaaattaaatgtcaaattgtaatacgcagtgttgagggtggggcctgatgaaaggtggttagatcatggggatgagtctctctctcgtgctgatcccatgatagagccctcaggagatctggtttcaaagtacgtggcacctccctcgtctttcttcctcctgctccagccaggtaggacatgatgcttggcgcg

SEQ ID NO: 9 - DNA, 172895 bp, Artificial
  BAC3
ggccgcctggccgtcgacatttaggtgacactatagaaggatccgcggaattctctttcttgtttattcccagtttgcacttacatatactataaaacataatatataaattttttattcctttcatagttatataatatagcaattacaaagataaaaactgcacttcatcttgattttcccattttgtacagtcttaatttcttcgtatagatttatgttttgaatgtatatcacacggctactagcagagaaagtttgttaaaatgtgcactgaagcatgaatgtgctgacaataaattgtctcaagatctttttgtaatgacagaattttatttgcctttcacttttaatgaaaatgtaatgcacatagaattccagtttgcatttcacttgtaatttattttcttgtgtttattattttgttcatggagatgatcacacattacattctgctgggcctttattaaccacatttctatgaacctagtcagggttggatttcaagtgtatggttgccacggctatcagagttgaagtcagcttctcctgttcacaaaaagttcaggttcctccagtgatacccacttttgtgtcccggtttggctcttcccatttctttctccccagagagagcctgtctctttcatctgtggcaggtgcatcctgctgacacttttacttggtgattgtttgtggggtgaaagggcttggacacagggggatgttctccaaccttctgaccaagcatccttcttagctatgggtggtgagaatggctctgaagcatggtcttccaagcgttcctgttccttcccttccccaagtcagagtgtctctttctagccacagtggtcttccatcagtgtcctcagcttctgacccactgtccttactccacagactcaggatttcattcctcaggaaagagacgggaggtgtttctgggtagagtctccttagtgtcctctgtttccttctgttctagttgattctaccagtgcctgaaggacacaagatttaataaatgtctcccacatatcgtgaagagggattcagcattgaacggagctactgttcttcctccccagtcaacatcacaggacagcaggtggctgagttgtctggggatttctccaattctgtaggaaaagcccgcaagtgccaggagtttcacactctcacagcattagcacacacatcctcaacaactcatgaaacatttccaggttagctttttcctatcttcaataccatacaatgagtggcacctgccccaggtactctaataaatggacctagttttctctgcaggctccccattttctcagatttcaggggtttttttctctgcaacatcaactcagatatgttgaagggttcattttttgtagttcttcaagtttcttgttaatgaggtcagaagaagatcattttctcatttttttttttacattcccgtgcttagtatctgctttctaaataaaattcggaaactaagacaaaatatcaaatatccactatttggtgcattgttaaactatttgagaaatattcatgtactgaaatacaatgaacaattgaaatcaaggcatgcctcagtcacataagaatgtgaggacattatcaaataattgtgctgagtgaaggaagctaaagaattcacagtaaatctcctgtgatttcttttgtataaattgtagaaaatgcaactattctaaattaacatggagaagatctgaatttttctgagaaaagtgtggtgaggtaacaagatggtgaaataaaattacagagaagtgagagaaaaaaatttggaggttaatttaattgctaatagcacgattgaagtgctgattcaaaggctgcacacatataccaacattttccatatcgtacactataaatttgaattcactattgattgaatttttgaataaagcagtaacaaaaatgagtatattggctgaggaagagcaagaaagagatgaatattgacacttgaataatcacggactcctgaaaatacacacatgtgaacactgattgcatatttcaggtaaatactagaaaaagcaaagtcacataaagtcgttatgacaggtgggataccctgcaaatcacactaggcatgtcccacactgccctggagctgtctcaggggagcagtctcctccagtgtttagaggcacaggcacggataatagggctgacgctgtccagatgtgtgatattggacacattgcacaactgctctgttatgtatgtaattcatcttctctaaaaatgtaacattgacacttgcactgaatatattctgcaaatatgtaaacattaaataagatgatgactgctaattgatcatcaagtcacaatcacataatctgaagttatattttcctgagagataggattacctccagtgttttccgggaccctctcatctgctctgggcactgccctctcctccagcgtcccactagagcttgctatatagtaggagacatgcaaatagggccctccctctgctgataaaaaccagccgagcccagaccctgcagctctgggagaagagccccagccccagaattcccaggagtttccattcggtgatcagcactgaacacagaggactcaccatggagtttgggctgagctgggttttccttgttgctattataaaaggtgatttatggagaactagagacattgagtggacgtgagtgagataagcagtgaatatatgtggcagtttctgactaggttgtctctgtgtttgcaggtgtccagtgtcaggtgcagctggtggagtctgggggaggcttggtcaagcctggagggtccctgagactctcctgtgcagcctctggattcaccttcagtgactactacatgagctggatccgccaggctccagggaaggggctggagtgggtttcatacattagtagtagtggtagtaccatatactacgcagactctgtgaagggccgattcaccatctccagggacaacgccaagaactcactgtatctgcaaatgaacagcctgagagccgaggacacggccgtgtattactgtgcgagagacacagtgaggggaagtcagtgtgagcccagacacaaacctccctgcaggggtcccttgggaccaccagggggcgcccgggacactgagcacggggctgtctccagggcaggtgcaggtgctgctgagggctggcttcctgtcgcggtctggggcggcctcgtcgtcaaatttccccaggaacttctccagatttacaattctgtactaacatttgatgtctctaagtggaaaacgtttttgtcctttttgtttctttgtttttgtaacaagaggaaacatcctcagctccacagaagccagggtgtcactttggggacagaaataatcctttcatggtcaccaggataagagtcctgaggaatcccagggaaacctggagagtgttttccagttagactcagggcagagacctccatgggaatctctgattagaacaggccttgagctctgacgggagccaagagagaggctcgcccagggtcagagtccttaaaacctgatggttttcacagctatcccccctcgtcttgtaaactcagactgattcagttgaccctctttctgctaatccatttccttctctgtaggtttgattctcacagttcgctttcttcttctcttccctgaaaacagacgatgtgttttctgtagtcaaaatcccagggctcaggtctgcaggacctgggtaggctacggggactttctcactcaccattgtctggacactcttgtcttctgtgcatggaggcatttggaaaatgaagtggacattagccatgaagggaataatactagttttctccaataggatattgatgtagagctgatcttgtgcttctcacactgtctcagagtttggactttcacctgtgactttgagaagagctggggatgggcactccattgtgctgtgagctctgggtaacgataattgtagaatctgcctaggcagtctaaggtcaatactactggtcatcaggaaagacagctggaattcctgggaagatctgcatctgccgtccaccatggagtcccatcgtcttctgttatgctctctttgaatcagtcccacctagattatctagaacactcttcctgacttaggaaaaataatggcaggctccactaacacctgtgttatgccatgggagcaacacctaagctagtgtgtgaatgagtagatgagactgtggtctagtcaaggtgacaggtaaaattgattgttgccattatgatattttattttatatttggcaatatagtcatgctcctattataaatattttttgagacggagtcttgctctgttgccagcctggagagtgcagcagcacgatctcggctcactgcaacctcttccacctcccaggttcaagcagttctcctgcctcagcctcccgagaaactgggattacaggtgcacgccaccatgcctggctaatttttgtatttttagtatcgacagggtttcaccatgtgggccagtgtggtctcgatttcctgacctcgtgatctgcacacctcggcctcccaaagtgctgggattacaggcatgagccaccacacctggcctagttttattaatgtctgtccataccagcaactacatacctatggggacattaatttacatctgcagacagatgtgtaaatacacaagcctatacatacatgtgtagccatttatatttaacattataataaaataattctaaaatattttctaaagaattaaacttaatgatgagctaaatataaattagagtaatctataattgatttcgatcattctctatagtttgcataaatggatgtctatttctaagccttaacatagtgtattcgtcattttaaaacagtcaagaaaaaattacaaatgttcttgtcacaaaaaaagataaggatttgatgatttgaggtaatatatatgtcaattaacttgattcaattattctgtattgcattcacaaaccataacatacctttgtgccccataaatatatacaaccaaaatttctcaattttcaatgaaattttaattatatatttttaaatctgatgcctctccttggattaagccacctcctcaggcttacagggctcttccattttctcaacatgctgttataccagatgagcacaaacacattaatttcattatgcttagctttaatttttcaaaacaacatgaaggtgataattttaccaatagacgtattgcaacctactatgcatgagaccctttctgtgcttcaaggtttcttctcaggactttatatgtattgcaaattttcatttttttctgatatggaatgctgatttctctttattacagattatcagtttatttttcaaatttatctcttaaaattaattttttcaaagtcccactcaaaccagggtattattagaactttgaagtgtaatagttggaccaactttgagaatacattcaatttagttcacgtgctctcaagtatcttttcttctttaaaagttgttgtcagttgtaatatcacacaaaatattagtaatttatactaatgacacaggttaaaatattgtataaataatttaattacatttgattggaaaaaaggaatatatgttcctcatatcttgacttttttttcttctctatgagatgcatgtttattaattattaagtttaagatgttacccttgtctttttgatttctgggatttaattttagtacatatacttgaatgcattgtattaattcatataataatgttcatattttggatagggttttaatattaattttgttattactgaattttaaactattctacactttttcattttttgtttttatgcgataaaatttacatataagaaaatatgcatagatctggaatgtatcactagagagtttctggcaaatgtgaatacccttgtccccagcacctaaggtagctgaagagcaagtccatccccacatcgcgggtctttccctgtgcctgcggtcaactcctgcatggggaaatgttttgatttctcacactacagatccatttttttccgttttgaactttatataaatggaatcaaacattatagaccttttttttgaaaggggcttcgatatttttgagattaattcatgctatttaatgtataaaattagatcaacatattgtcatttattcaattcatggactgactctgatatgaaacctcaaagttttcatgtatatatggagacagggagaggaaggagaaagattttatatctgagtcagtccattaagtaaataaatgagaatattttgatttattttcctgttgatgtactttaaatttgtttccattttatgaatattataggcaaagccgttacaaatatattagtgtaggttttcctatattgtctcatttttgttgagaaaatatgaagtatatatttctttttttatttttgattactatttatttatattttatattttactttaagttctgggatacatgtgctgaacatgcaggcttcttacgtaagtatgcatgtgccgtggcggtttgctgcacctatcaacctgtcatctaggtttgaagcacctcatgcattaggtatttgtcctaatgctctccctcccctttcctaatgcttttcctcccctgacacatcccagtgtgtgatgttcccctccttgtgtccatgtgttctcattgttcaactcccacttatgagtgagaacatgtggtgtttggttttctgttcctgtgttagtttgccgaggatgatgatttccagcttcatccatgtccctgcaaaggacatggaaatcattcttttttatggctgcatagtagttcatggtgtacatatgccacattttttcatacagtctatcattgatggacatttgagttggttccatgtctttgctattgtaaatagtgctgcaataaacatacatgtgcatatgtctttatagtagaatgatttataatcctttgggtatatagccggtaacaggactgctgggtcaaatggtgtttctcgttctagatccttgaggaatttccacactgtcttccacaatggttgaactgatttacactccccctcaacagtgtaaaagtgttcctatttctccacattctcaccagcatctgttgtttccagactttttaatgatcaacactctaactggcatgagatggtgtctcattgtgattttcatttgcatttctctaatgaccagtgataatgagctttttttcatatgtttgttagctgcataaatgtctttttttgagaagtgtctgttcatgtccttcgctcactttttgatggggttgttttttttttgtaaatttgtttaagttccttgtagattctggatattagacctttgtcagatggatagattgcaaaaattttctcccattctgtaggttgcctgttcattctgatgatagtttcttttgctgagcagaagctctttggtttaattagatcccatttgtcagttttggcttttgtcgtaattgctttggtgttttagtcatgaagcctttgcccatgcctatgtcctgaatgatactgcctatgttttcttctagggtttttgtggttttagattttacatttaagtctttaatgcatctagagttaatttttgtataaggtataaggaagggatccagtttcagttttctccatatggctacccagttttcccagcaccatttattaaatagggatcatttccccatcgcttgtttttgtcaggtttgttgaagatcagatggttgtagatgtgtggtgttatttctgaggcctctgctctgttccattggtctatataactgttttggcaccactaccatgctgtttttgttactgtagccttatagtataatttgaagtcaggtagcatgatgccttcagctttgttctttttgcttaggactatcttggctatacaggctgtttttagttccatatgaagtttaaggtagttttttctggctctgtgaagaaagtcaatggtagcttgatgggaatagcattgattgtataaattactttgggcactatggtcattttcacaatattgattcttcctatccatgagcatggtatttatttattataaaagtaactttaattttttcagttttaatgaggaacaattgaaatatttttaaatgtatatgtttaaggtgcaccacttcatgttttgatattgtgttagtccattctcacactgctataaagaaatgcctgagactgagtaatgtgaaacaaaaaaatagatgtttaattggctcatttttctgcagactgtacaggaagtgtagtggcttctccttctggtgagactcaggaaagttagaatcatagcagaagacaaatagtagtagacacatcacatggccagagcaggggccacaggaagagagggaggtctacacagttagacaaccagatcttatgataactcacacaatattatgagaacagcgccaagagtcagtgctaaaccattcatgaaagacccaccccatgacccaagcatctcccactgggtcccagcttcaggattgaggattataatacaacacgagattcaggccaggacgagttgcaaactgtatcagatacacattgtaaaatgctcatcatgatcaaggtaatttgtgtgcctatcatcccacatacattttttttttaaatggagtgtgtgtgtgtgtgtgtgtgtgtgtgtgtgtgtgatgagaatatctaagatctaccctttcagcaaaaatcacttttacaacacagtattaaatacaggaacattgctgtagattagatctccagaactcattcaacctgcacacctgaaattctgtaccctttaaacatcacccaatttccctctcctcccacatcctgggacccattattttactttctgctttcaagagcttgggtgttttagataccacatgtaaatgagataatgcagcatttgtctttctgcatctggcttattccacttagcatcatgtcctccaggcccatccgtgttgttgcaaatgtcagaatttccttcttttcaaagcctaataaaattcagttttatgtgtacacattttctttatacattcatcagtctgtggtcattaaattattttacaaatctacactattataaataaccttgcaatcagcatgtgtttaacataataattttacttatttgaatacataacaagaagtgggatcaccagatgatatgatagctttatttttcaatttattgagtaaccaatcctaccacaccctaaaaggattctcttttcaccacattcttgccaatatgtgttatatgtcttgctgatgatagccattttaagcagagtgaggtgataactcatcatgattttgatttgaattcctctgataattagtaatgttgagaaccctttgaggctctgtttttcatgtgtgtgttttctgaagaaaaacctatccagtttttgccctttttatcagatcatttgttatttgctattgagttgcatgagttatttatacttttggatagaacttatgtcaggtatataattgcacatagtttttttcctgtgcttttttctattaaattcaaagaaatcatttctgaatcaatgacaggaagtttttttccatgtgttctatgagtttgtggcttcaggttatgttcatttttagtttatttttgaatacggtgttagagaaggtctaattttatttcttttgcatatggatgttaagcttttacatcatatattgaggagactgtccatccttcactgtgtgttcttgggatacaaaatcaggaagatgcataatttaaaaagaaaacatcagatgaatattcctggtgaatatagaccgaaaagttctcaacaaaatactagcaaatagaatccagaagcactttaaaatgtaatacctcatgatcaagtaggctttacccctggaaggcaaggttcattcaacatccacaattcagtaactgtgattcaccatgtaagcagaataaaagcaaaaaccatatgattatctcaatagatgctgagaaagcttttgataggatccaacatccgctcataataaaagccctcaacagactaggcatcaaaaaaacttacctcgaaataataagagccatctatgaccaatccacagtcaacattatactgagtgagcaaaagctcaaaaccctttagaagtgaaagaagaccaagatgccctctcaccactgctattgaacatagtactagaaaccctagtcagagcaaccaagcaatatcaaaataaaaggcagctgatatggtttgtacttgtgtccccactcaaattaaatgtcaaattgtaatacgcagtgttgagggtggggcctgatgaaaggtggttagatcatggggatgagtctctctctcgtgctgatcccatgatagagccctcaggagatctggtttcaaagtacgtggcacctccctcgtctttcttcctcctgctccagccaggtaggacatgatgcttccctttctgtactgattgtcaggatcctgaggcctccccagccatgcttcctgtatagcctgaagaaccatgaaacaattaaaaatctttataaattacacagtctcaggtgtttctttatagtttgcgaatggactaatacagaatccaaataggaaaagaagaactcaatgtatctctccaaactgatgatataattctatacctagaaaattctaaagaccctgccaaaataattctagaatagataaacaattttggtaaagtgttgggatacaaaatcaatgtacaaaaatcactagcatttctataccccaactatgtccaagctgagactgaaatcaagaacacaatcctatcccacttacaatattcacacacacaaaatatgaaatgcctggaaatacaggtaacaaacaaggtgaaggatctctgcaaggagaactacaaaatacagcagaaataaataaataaatcgtacatgacacatgactcatctgacaaagggctaatatccagaatctacaatgaacttaaacaaatttacaagaaaaacaaacaaccccatcaaaaagcgggcaaaggatatgaatagacacttctcaaaagaagacatttatggagccaacagacacatgaaaaaatgctcatcatcactggccatcagaggaatgcaaatcaaaaccacaatgagataccatctcacaccagctagaatggcgatcattaaaaagtcagggaacaacaggcgctggaggggatgtggagaaataggaacacttttacactgctggtgggactgtaaactagttcaaccattgtggaagacagtgtggcgatcctcaaggatctagaactagaaataccatttgacccagcagtcccattacttgctatatacccaaaggattataaatcatgctgctataaagacacatgcacacttatgtttattgtgtcactattgacaatagcaaagacttggagccagcccaaatgtccaccagtgatagactggattaagaaaatgtggcacatatacaccatggaatactatgcagccataaaaaaggatgagttcatgtcctttgtagggacatggatgaaaatggaaaccatcattctgtgcaaactatcacaaggacagaaaaccaaacactgcatgttctcattcataggtgggaactgaacagtgagaacatttggactcaaggtggggaacatcacacaccggggcccgtcatggggtcgtgggagtggggagggatagcattaggagatatacctaatgtaatgttaatgggtgcagcacaccaacatagcacatgtatacatatgtagcaaacctgcacattgtgcacatggaccctagaacttaaagtattatttaaaaagaaagaaaaaaactattaatttttctgaaccatgaacatggaatatttcagatatattttcaatttgtgtgtgttcactttattttttattatcaatcatttctggttttcttttagaaatctttcacttatttggtaatatgaaatataatttttagctattataaacaaaatgctttattgattttttgctgtttgcatttagcaatgccaccaatttttgtatgtaggtgttgtattctgcaaatttacagaattttttatcaattataacagtttttccagcaccatttattaaatagggaatcgtttccccatttcttgtttttgtcaggtttgtcaaagatcagatggtcgtagatatgcagcattatttctgagggctctgttctgttccattggtctatatctctgttttggtaccagtaccatgctgttttggttactgtagccttgtagcatagcttgaagtcaggtagcgtgatgcctccatctttgttgttttggcttaggattgagttggcaatgcaggctcttttttgttccatatgaactttaaagtagttttttccaattctgtgaagaaagtcattgatggggatggcatcgaatctataaattaccttgggcagtatggccattttcacgatattgattcttgctacccatgagcatggaatgttcttccatttctttgtgtcctcttttatttcattgagcagtggtttgtagttctccttgaagaggtccttcacatcccttgtaagttggattcctaggtgttttattctctttgaagcaattgtgaatgggagttcactcatgatttggctctctgtttgtctgttattggtgtataagaatgctagtgatttttgcacactgattttgtaccctgagacttcactgatgttgcctattagcttagggagatttggggctgagacaatggggttttctagatatacaatcatgtcatctgcaaacagggacaatttgacttcctcttttcctaatcgaataccctttatttccttctcctgcctgattgccctggccagaatatgtagaaagctgaaactggatcccttccttgcaccttatacaaaaattaattcaagatggattaaagacttaaatgttagatctaaaaccataaaaaccctagaagaaaacctaagcaataccattcaggacataggcatgggcaaggacttcatgtctaaaacagcaaaagcaatggcaacaaaagccaaaattgacaaatgggatctaattaagctaaagagcttctgcacagcaaaagaaactatcatcagagtgaacaggcaaccaacagaatgggagaaaacttttgcgatctactcatctgacaaagggctaatatccagaatctacaatgaactcaaacaaatttacaagaaaaaaacaaacaaccccatcaaaaagtgggtgaaggatatgaacagacacttctcaaaagaagacatttatgcagccaacagacacatgaaaaaatgctcatcatcactggccatcagagaaatgcaaatcaaaaccacaatgagataccatctcacaccagttgggatggcgatcattaaaaagtcagggaacaacaggcgctggagaggatatggagaaataggaacacttttacactgttggtgggactgtaaactagttcaaccattgtggaagacagtgtggcgatcctcaaggatctagaactagaaataccatttgacccagcagtcccattacttgctatatacccaaaggattataaatcatgctgctataaagacacatgcacacttatgtttattgtgtcactattgacaatagcaaagacttggagccaacccaaatgtccaccagtgatagactggattaagaaaatgtggcacatatacaccatggaatactatgcagccataaaaaaggatgagttcatgtcctttgtggggacatggatgaaaatggaaaccatcattctgtgcaaactatcacaaggacagaaaaccaaacactgcatgttctcattcataggtgggaactgaacaatgagaacatttggtctcaaggtggggaacatcacacaccggggcccgtcatggggtcgtgggagtggggagggatagcattaggagatatacctaatggtaaatgacaagttaataggtgcagcacaccaacgtggcacacgtatacatatgtaactaacctgcacattgtgcacatgtaccctaaaacttaaagtataataaaaaaaagaaaaaagagacccaattgttgacaaagttatgaaaaagatagtttttaaggagtctttaagtaatattgtattttctgcaaacagacaatttgatttcccctattccaaatttcaggacatttcttcttttttcttgtcaaattgttctggctagaattacagtaccatgtagaagtggtggaaaagagcatttttgtcttgttcaacatcttagagaaaaggctttcagtttttccagccttggtataatgcaagctgtgggtttcacatatctggactttattattttgagatatgtttcttgtataccaagtttgttgagaatttctataaggaatggaggttgaatttttttctatgactttcttaaagcaattaatcataaaataataataagcaggtcaatacaagatccataaattagtggaagctagttatttgcactgctgccatagagtaggatcactacacaactcatggtgttgatgggaaactataattctgcaataattaaagactagtgatttacactgggctctattgagagatttggttgtcaactacagaaatcgagatgaaggggcactgagaaacatttcgcttcatatcatctcaacttctaatatcaatttttagtactaatacagtcctattttctcagtatactgtctcacaggttatagtatatgtcttagaaaattaagggttgtttcattctaataattaactcagaaaaattcatttcctattatggatgacaagtgtaaattcatatcttaataattacccacactccaaaacactactacaggcaaaggcaagagaaaggcaggtatagatgagattctctgaggtcagttatgtaaatacccaaggactattgtctatgaccttgaatgtcactttcttcccttccatgagctacatccaggatattctgtgaatctgagagcgttgagcatgtttaattattttatctcactgccccttagtcttgctttctccagttgacaaccaaatctctcaacaataggcccagcgtaaatcaccagacttcaattattgtagaactatggtttcccaacaacattatgagttacaaaatgatactactttatggcagcagtgaaaatgatgaacttccactaacttatgaatctctgaatggctagcatggaggtgtgtatgtatcagcgcactgttctagaaatgttccgtttctgtccattattttatgtagtaatgaggacaacgtgaactaaagggagtatccatggccttataagcacagagaccacatccagtgcaggtgcagagcaaggctgcaacagtcagcaagttgctctctgaagagtcttccaattcccttgcccaaagcatctgctcattcatgggctgagaaaagggaagtcatgcatgcagtctactctctctacagagctgacaggggacacggacaacatcgattattcatggaattttcccataggaatgcagctgtgtgcacacacacataatacatttttaaatgttttttttatttatcctctccaattttaaaaaagtcatcaccttttctcctaatcaaagaggattttgaccagaatgcttggtgggagccccctgctctcccagatgcccacccttatttctcttgaagtgaagaacggcagctctcttgatttctactctcatcctctaggactaaaaccagaaggttccacgccccctgggtgaacatccaagaagaccctgtctgtagcagcaggagcctcaagccttgactgagagctatggtcctgaaatgagacagtgtcccccatggagagcacacgtggacgcccacaactgagggctcactgctcttcaccacagatgcgctcccttactgagtcctgagacctgagtgcaccccatagggtagggctcagaagaggggatgcaaatctccaccagctccacccttctctgtgttgaaaagccgagcatggggacctagttcagtgactcctgtgccccaccacatggagctttactccacgcttctcctgctgactgtcccttcctgtgagttcagtggtcagggaatccttcaggggtgaaacacctgttcttttctttgtgggcttcatcttcttatgctttctccacaggggtcttatcccaggtcaccttgaaggagtctggtcctgcactggtgaaacccacacagaccctcatgctgacctgcaccttctctgggttctcactcagcacttctggaatgggtgtgggttagatctgtcagccctcagcaaaggccctggagtggcttgcacacatttattagaatgataataaatactacagcccatctctgaagagtaggctcattatctccaaggacacctccaagaatgaagtggttctaacagtgatcaacatggacattgtggacacagccacacattactgtgcaaggagaccacagagacagagcccagggtgcctcttgtacaagaacccaggctgcttctcagtggcgctccctccccacctctgcagaacaggaaagtgtggctgagatgccatttcctgtcagggtctgggtgtcttatcctatctgactcagagccttgtcttcctccctcttctttagtaataaatggcatgacccctgttagtggttcatgcaagcagaggctgtatcctgtttgacaaagattcagcatgaaaggttcctgttacttgagccagatgcatcactgatatgtggccaccagtttcttagactcataccactttaagggaccaaatacaaatgtccatagcatatgccattcttaaactgcagaaatgatgtcaaagaagaatgtggagataagagagcaggaggaattatgaaaatctggatagcatcttctcttctagggtggaaggtatgctagtaaagtaatttaatgaaacaatcagacagatgcaatatgtcctcatcatggagtgtctcacatgggcagtgcacaaataaatttctaaaaattccataaggtagatgtgatggatgaggcttatttccacacagggagcccacaaatatccagagaagtaaaaaatctgacacttggaaagaaaattgcctcatcttgacatcagaaacccatttcaacatgtccgaggggcaatgtggaaaagaaatggaaacttcaaaaacacatttcttatgaaatgtctagctcatgtttgaacataaaaacagaattgtccatgattttagaaaaaccaacccatgacagcgagtcactacactcagaaacaccactgagtcaacagacttcagtctgtgagcaggtcagtactgaggccccaggtgaatcaaggctctcacgtacattgtacagaacccagaattgagccacacaatctataaccaagtcttctttgacaaactttacaaaaattaacaaaaaaatacaccagagaaattcaatatatgaaattcaatatacccattcaatatatggtgctggggaaattggttagccacgtgcagaagaacaaaactagacccccaccctcaacacatatatactcaacacaaaatgaattaaagacttacatataagacctcaaactataaatctactcaaacaaaacaccaggacaactcttctgggctttggcctaggtaaagaatttatgactaagaccccaaaagcaaatccaagaaaaaaatagacaaatgggacttaattaacctaaagcatttttcacagcaccggagtgaacagacaagttgcagagcgaaagaaaatttttccacaccacacctgtgacagggaactaatatgaagaatttgcaaggaactcaaactactctacaacaacaacagcaacaagaaccaaataactccgttaaaattagcagaggacatgagtagacattttcaaaagaacacataaaaatggataataaatatataaactacgctcaacatcactcatcatcagggaaatgcaaattaaaaccacaataagatatcatcttccaccagtcacaatgactattactaaaaactcaaaaatatcagatgttggtgaagatggaaaggaaagggaactcttagacactgttgatgaggatgtggatgaggacaacttctatggaaaatggtatggagatttcccaaaaaactagaaatagaactcccctttgatccagcaatcccactactgggtttactacccaaaggaaaataattttttatttccaaaagatatccacacttctatgtttatcacaaaactattatcaacagcacatatgtcaacctgagtgtccaccaacagatgattttataaaagaatatagcatatatgcacaattcaatactagtcagccacaataaggaatgaaactgtcttttgcagcaatatgcatagaactggaagacaacataattagtgacctaactcacaaacagagagtcacatgtcacatgttattatttataagtggaaggtaacaacgtgtccacaaggatatggagagagaaatgatggacaccagagacttagaaggatgggaggtggaaggtgggagcatgaggagacattacctagtgggtacaatgtacattatttgggtgatagtacactaaaagccaagaccactatggaatatagccatgtccaaaagtggcattcgtagtccttaagtttatacaagtaaatgtacacacaaataaaattaaaaatataaaataattaacagttgaccaatgatcttaaaagttgatttaaaatataatcaataaatgaaatgaatatcagttgaacctcattaaatttgaaaacgttttatactcaaatgactataagaaaatgaatgtcaagtttcagatgagaaactgtttgcaaatcattagccaccaacataagtataataagaaccctcagaactcaactgtgaaaaaaagaaacaacccatggatagaataggcaaaggtttgtgcagacatttcatcaaataagatgtacagatgacacataggcatataaatgggctcgcaacaggattttccattcgaaaaattcaaatcaagccgacagtgagacactactatacaatttttagaaattaagaagaaatacagataataccaatgctggtgagcatatcagggtccaagactctaaaacgttgcaaacaggaatgcaaaatgaaactgctactcaggaaaataatttatagttttttctaaaatcaaacattttcttaatatatgacctaaatatcccactcctgaatatttgtgtcagagaaatacaatcttagattcacaacaaacttccatttaaatgttcaatatattgtgctcacgtgtgtgtgtgcacgatagaaacaaaaagtaacatgaatgtctcaaaatttgaataggtaaaaagtaggaagtgtctattaattgaataccatcagcaataaaaaataacaaaatgactgatacacaaaccattacaggtgaactccagacatgatgctaagtgagagaagccagtctcaatgatcaaagggacacatctgtaagcaccacggtcatcctcaggtgtcagtggtttgggctgggctctctgtctctttcctgaccagacccagatgttgagctccgccacttgcagatggaaaattctactattttcaacaatgcactgaggtttgaactgcttcacagactgaacgaaacaaacacgggctcctttgaacagtgtgcagcatttgttccaaccacaagagaatgtctcccagctctgccccttctcagttttccctgcaagccagcagccctgcagtttagcctgcatctcccatgcatgcacccatctccttccaagggccttactccacaacctccacttattttgagtgcactgactggctttgaacttttccacattctgttgttattgaagttaggatgtttagagccatattaaggatcatattttatgactgaattccagtgccccctctctcctgggacagagcacgtaaccaacattctgcatgtggagacaaagatgagcttttttcttcctcagcctaggagatgagcgctcagtggagggttggatagaagcttcccaccttctcagcactccagttctggtggggagaacctctgccataggagcagagctagaaaccagggaccgaatgttcccagtgacactggacccagggtagagcctccatccacgagtggggctccatggaagaagcgagtctctggctctcagtagcttttgtccagaactgagccttaggatcgtgtactgtgggcagagtcagagggccaatgtcctggctcctggggaacagtttcctctgaagggagctgggtagaaggtgtcctgtcttcttggctacatctgtttgcagtggagtttacatcatgctgagttgggatgtggaaggaaggaggagcatcttagatcaattatgatggctagacttactgaattttgtagattttcttgaataaatgtttcttcacttgctgtatgctgtgagagcctttccaaaccctgtattttttcaaaataattttcactggtctcatgagggcatggattcattgagcccctcatgctatcaaagagaaatagaactttttttgttcactttttagagaacatccatgggttataaaacaatgggttgacttctcttccaaaactttacagataccgtcaattttcctcttgcttgtaaggttttatccagaagaatgctgtcatcattttttctgcttttttggaaggaatgccccttctactcacctcaaattgcctgcatgtatttctatttttctttggttttcagcagttttaataagatttagctaaatgtgtgtggggggagcagggagtgtcattctgctgttctgtgttctctgagatgcatggattcacggtttactctgtctccattttggggaacacaattagaaaaaatgtcagtgtgagcccagaaacaagcctccctgaagtgggcagaggaccacctgggggcgctcaggacccactgagcacaagagccagccccagggcaggtgcagacgggggttaagatctggtttcccgtcagccctgtggcttcctctccataaaacagttccctcgggggcacgtctctggattccttatcttgttcttactgtgaagtctctgaagaataaacatttgttgtaacaagagaaaaattttctcccatgcaccaaaggcagagtcacctacagtcaattagtcctgtttctcaatgttaataaactatcaatgtttctgaaggtacattgtacagaacccagaattcagccacacaatgtatagccaagtgatattgacaaacttaacaaaatatacaccagggaaaggacgtcccattcaataaatggtacttgggaaaatggatagaaacatgcagaagaacaaaactagatccccaccctcaacacattagtcaggtctctaaaatgcaggagtacatatctaaaatttattattttattgtgcatttttacgtgttccagaaggtgggagaaatttctttctgtgaagagcatcccaaagtcaggcactcctctagaacacgtgtttaatccttgtctttggcttattgatgagctctgttggctgcaataacttctgccatccgggctgactttgcatcatgtagaggagcaaattctgaatgaaagtttgcactactcaattgagtgcataacctacagttttgttactgatgtatgattcatcagagatgatatcagatcaaggatttcaatgagaatctaatctaaaagatgtaaacaaattttcctaatttagataaaattactgtgagcacactgctagtattcagccatgtctcctatcacattgaatctacactaagtttgacctaaaagctagcacttgttctcatgttccaatatgttatttttattttaatgtattcagattactatgtgttgctattttacccaaagtgaaggaaagcaattttaactgactgaaaatgagaaaaagcacaacctaatgaaatggaagtcaggacatgagtgtctccagccttgtctatttcaaaaattcacgtacgcagggggatttctttcctcaattttacacagagaaacttccaaaatgtttgtttcctctcccatggactctatcatcagtttctatgtcagtttgcttagaattttggcctccagctccaaccaatttggtgcaaaaacatgatttcattcttttttatagctgcagagtattgcactgtgtataagtaccatgttttctttatgcagtctataactgatgggcgtctaggttgattccctgtattaggtaatgtgaattgcacagagataaacacatgagtggatgtgtctttgtgttacaatgattggttttctcttgggcatatacccagtaatgagattgctgaggggaatagtagctctgttttaagttctttgagaaatctctagactgactgaattgttttctctgtgaatggtgataattatgtcaatatttgtcaaattttgaatgtattgtttgaagattgttatttgtcaatattacctcattaaaactattaaaaatggaagtgtataatttggtagaaaaggattaaaagaaagataaaaataatacaagaaaagtcacagactcctgaatccacatgtgaattagcactcagtttttctatattatttataaaaacactaagatacagccaaataatatcatgatatccttataagaagagtgtttcgtaaacctcactgggaatttctagctctgtcctagagttaatttagggagcagtcggatccagtcctgagcaacacaggccagacactgagacttaccacatcttaccagatgtgagctcttagacacgtcacatggcctctccatgcttgggggtttaccttcacatctgtaaatgaaggaaacattgactgccacagaacatacttcatgtgcatctatacagtagaaatgctaataagaattaattgtttatgaagtgtaatcactctgggacacagcccactcagaggcatcccttccagaacccgctatatagtaggagacatgcaaatagggccctccctctgctgatgaaaaccagcccagccctgaccctgcagctctgggagaggagccccagccctgagattcccaggtgtttccattcagtgatcagcactgaacacagaggactcaccatggagttgggactgagctggattttccttttggctattttaaaaggtgattcatggagaaatagagagattgagtgtgagtggacatgagtggatttgtgtggcagtttctgaccttggtgtctctgtgtttgcaggtgtccagtgtgaagtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattagttggaatagtggtagcataggctatgcggactctgtgaagggccgattcaccatctccagagacaacgccaagaactccctgtatctgcaaatgaacagtctgagagctgaggacacggccttgtattactgtgcaaaagatacacagtgaggggaagtcagcgagagcccagacaaaaacctcctgcaggaagacaggaggggcctgggctgcagagggcactcaagacacactgaaaacacggttaacactgggacaagttgctcaggaaggttaagggctggtttcctttcagagtctttgctgtttctgtatctaacagtttccccaggaaccctgtctagatttgcgatcttgatctgcttaaactgtctctgtgtcatttttcttacctgtgactttaggggagctgatcgtggacactccagtgtgtggagatttcctggtgacagcaattgtgtgttctgtctaagcatgtctagggccggtcatcaggaaggacaggaaggacaggctggaattcttggaaacagctgcacctgccatccaccagggaactttattgtcttctgttctgctaaaattaaatcaggcacaccaagtttaactagcactatcttcctagcttaagaaaattgatggcaggtttcaataacacctatattaaaccttcagagcaacacctacattagtgtctgatttgataattgagactatgttctagccaagcagacacataaaactggtgattgccatgcttagttcatatttcatatttatcaatagaatctggctggtgttataaacagatttgccaacacatgtgtgttagtgtttgtcttcggagaggcacattctatgactggattaagtttgtgtacaggttcctaaggaacctgttcatgcttttgagaggaaatgcagagggggtggaaggcggctggggaagctgaaggtatacgagggaagtcagtccctgagtgaaggagagagggaggagaactgggtagaactttcctaaacttctgtgctggtctaggaaggtccagcaagatcactgagtcagattcgtgtcaaagtttcccatcggggacccccgtgactcccagcagtggctctgctcagatcagcacagagctcgttcttctcctgagagtggagcagaggatgtggctccagcaccagccatggcatggacgtcagagagcagccccaggcacctgagtcgggtgcattgtgccccctgcaggtggacggagggaggtgctgactcagggcccacacgctgtgggttctatacagaacacacacttttacttcatttctgtggatgacatagaaacaaacatgcagtctattaacagcggtgattcctacatttgccccaattgctttattccttgattccgcagaatatcctgacgcagaattgtctttctctcgtggaattgcgacgtgtttaggacgtgtgttccccactttcagtgttctgctccatgaacagagatcctgagtagagtacagctgaccctccttccacactgttcctctcctccccacaggaagagcagataattacctgaggctgaatctgaggtgggatctgtcctctgaacctcagagcctgcagagacccccggctgcagattcatggagtcaggtgtttgtacatgtgggaaacttgagctgttcttttgtcagtgaacactccttagaactaattgtgggttcagaattaggacacccattgatctatcacacctcagctcattctgccactcagaatctccagaaattcaggaaatggttcaatttacatgtttgtgacacattgttctcatttcatttagttgtgagtttggtcagcaaaagtgctaccatttatgtgtcccaacctgatgaagctaacttgcttcaccagatgttgggagctcctgaattttatcctaagcccctctctctccacttcatgtgaaattcggtttgacctggaattctggtgtgttgatttagccagatttccccatactgagtgtctgattttcctggatatctgatcagtttccttgtccttcaccataacttgggtgacatctgatcaccctgggctaacttcaacaaaaatcctggcaggttgccttaagcaggatttacctcactcctgatgtttcttcttgattttccatcctttgccccaaccctgctgcatgcctataaatccccacgttctcactctgtatttggagttctgctgaatctctccctcattgcaaaatcccactgccctggtccctacacctatcatgagggccctggataaagtcttccttactgtgctgtagaaagtgtctttgtatatacattttttctttaacaaatctgcctttagtatttcctaattgatcaaggaacctcaaacattgaatgaaagtgaggttttccattttactaacatatgtgtatctgtgaatttcaatttcaatgtgtggtgtccagaagtcctgagcaccaacagttgtgcttctctgtccaattatttgattctgaaacctgggagtcatcccaacacaggtaaatatgtgattttttttttttttttggtttttactgtttagtgactgacttatttcacttacactgaagcttcatgaacacaatgatgaaaagtagagagaggacttgtttgaaaatgccagatttatggtagactttaccacccacgtgtgtctggaggtcttcttaaggttccaagaacaggacatttttcccacaacaagacaaggatgagaacctctgagctgtgaggatggaggacaggcagggccatgtgtggacaaggacgggctgctgctatgtccagggtgttctctactagcaaccactccatctccttcctcactctgtggtatttgtcagatgggaaacatgcctagaatttatctttgacatctggatggaagcccaggcaagaggcatttgacagcttattcgtgagcctacttctttaaggaatgccagatcccttgctctccttcctagttcttaacccctttaactcccttcccctcctgcacccatccactgcctatttacagccacgtccccacacccttcactgtagcaccattttcttgggctcctgggaaacacaacagctttggtttaactcacagctcaggcacactcacgggtcctttcagaggctctcaacttccctcctacagtccctcagctcctcctggggtcctaacttggccatctctatcctctctgctgagcctggccatacacaatccatcccatctggatatgtgtatagcagtgggttaactcagcaggcatgaatagttcaaaccctccacgttcctaaaaaggtaaataactaaaaaataaaaacaaaagtaaacctttgttcatttatggctgtctgttacctcctgggatgagatctccgagtccatgaaatcttacacctgataaaagtgtctgcagatgtctgcagccttgggacatgctgtacgagtttaatcacagtgatttatagtgaacgcctgcttttgttttgctggggagggctgtggtctgagtattgtggtcagttacccaggtgttccatagtctatgattcattccccaaacacagccctggacaagaaaactcaggggcactcccctgggtgttgacacttcacacatgtcatcttacctcatagctggagcattacacatgtgcagaaggctccacagtgggaggacccctgagagcttgtgcctggattctcctgagcttcactctttgtgccttttttttccatgtattttcaattgtatcattttgctgtaataaactgttcctgtgaatacgagttttcatgagtcctgtgtttttactgagttttgagcctgagggtggcagatgcaacttctcaatgcagttgtatcagaagaaggatttcctagagagatcctaagtgacacatggctgaagtattgttcagaaaacataagtattcaggtgtggaatggcaaaatctgatacttgggtggcaacagaattacccggtctgagacagcagctgaactgaagtagatgtctggagataaatgcaatttagaaacgataactcatactcccaaagagctggctcaatcgatacataaggaaaaataaaatgataaaaaataacctaaatatgcaattactatttgtgagaacatccgggagagtgattgcagggaaagtggcctgcgccgacctcagattttggccaatgtcatttctggctgatgggctccagggcactacctaagggagcaattatgctgcaatgacagacagaagcttcgcaagctctctccacccagaaggtggttcaggtggtgaagtgcggggactggtgagccacaaaacactgaaatgagggaggaaagtgagaaagtgaaaggcttttgagctttttctttagcttaataatttttgttaattattaacaaaataattggacaatgactaatgtaaaagtggaccgtgttttgagtcccttagaacggaggagaatgcagcggtcaatgttgtgcccagagattactatagaacaatagtaggtggttgaacatgctccaaacacaaagcctcttgttgctgatgggacagctgccctcgtctactgcacaacagcttctccaaagtgtgtttaccctgagcattgagattgcctttctcttgtaagtgaaaaaatcggaaaactccaaataaaggaggagttgtaacgctctatgtgtaagaaattctaatgtggatttatgataactgggatatgcatccacttatctttttatctgtaaaaattcatgggtgaaagtgcaattttgttacatggatatattgttcagtgatgaagtctgggctttgaggagagtcatcatctggatggtgtatattgtacccagcaagtaatttctcatcccacacaccactcccaccatccaaaccttccaagtttccaatatttattatgccacactctatattcatgtgtgcacattatttagttcttacttatatatgacatgtggtattcaactttattcttctgagttatttaacttaagatagcagcctacagtttcatccatgatactgtaaaatacataatttcattttttattattgagtagtaattaaatgtgtgtatatatattcacaaatatatataatgtatttgtgagggtgtgtatgtgtgtatatatgtgcatatatacatatacaacatgttttctttatccaatcattcattaaaaacacttagtttggtaccgcatatgtgctattgtgaataaggcaacagcaaacataaatgcagcatctatcgaatataaaattcatttttctttgagtcgataccaagtagtggatttgccgaattaaatattagttccatttaataagagaacttaccaacatctgtttcttgtttagtttagtttttatttttgactttttaataatagttattctgactggtttaatatggcttctcgttttgacttcaaattgcatttctgtgatgattaatgacattgattgttttttcatatcctggttgatgatttttatggcctcttttgaaaaataaatgtctgatatttgctcactttttaatgtggctatttgtgctttttgtgttgctttagtttcttgtagattccaaatattagctctttgtcagatgtagtgtttaaaaatatttttcgtcattctgtaggttttctgttaactttgttgattatttattttgctgatcagatgttttgcttcttatttgtattaagtccaaataacctattttggtttagttgtgtttacttttaaggtcatagtcatgaattctttgcctagcacaatgttcagaaaaacacttcctaggatttcatttatgactttcagactctcaggcctcccagtcaagtcttttatccatattggtgtaatgtttgtatgtagtgagacatatgggtccagttttattcttctgcaaatagctgttcagtttttcctgcacaatttattgaacaaggtgacattttcccagggtatgctttttgtctggttggtcacagtcagttggctgcaggcacatgactgtatttctggaatgtctattctgttccaagtatctatggttctctggttgattgttacttgtgtataaaaatcctactggcttttgtatgcttttttatcctttattctaaaacttcactgaattaattcatcaattctaggagtacttctaaagaatattagtttttaagtacaaaatcatattgtcagcaaacacacacaaaaaactgacttcttcttttccaatttgggtgcctttatttctttctggtgtcttatttctctggctaggatttcaagttctatattgattaagagtggtgaaagtgggcatccttgacgtgttctgagtcttaggaggaatactttcaacatattgctactcagtataatgttgtatgtgagtttgtcatatatgatttttattaatttgaggtatgttttccttctattctaattttgttgagggttttttatcataaagaaatcctaaatgttatcaaatttttttttctggacctattgacatgattatatgttttttgtttatgtggtggatcacagttattgagacatgaacgttgaactatccttgcatccctgaaatgaaacttagcagattgtagcatattatctttttgatatgtagttggacttgattttcttgtgtcttgttgaggatttttccatctatagtcatcagtgatattgatctgtagtattcatttttgggtccttgcatggatgtggtatcaggctattagtggctttgtagaatgagttagggagaaaaaccctctcctcgtttttttggaaaaagtttcagtagaattactagcagatctttttgtatattggacagaattcaccttttaaaataatatgctttacggctttgatgttgagatttttttaaattactgcttcgatgtcactaatttttgttggtcctttcaggatttttatttcttcctatttcaatcttgggagattatatatttccagacatttatctattcaccctaaattttctagtttatgagcctggagatgttcatagtagactatgttgatcattatatttctatggcatcagttgtaatcttttcttttttgtttctcattctgcttatttaaattgtctgtctactttacttgcctaatctagctagtggtctgtaagttttgtttatcatctcaaaaacccaatgttttattgtattggttctttgtatttcttggttcttaactttatctagttctgctctggtctttgttatttgttttcttctgctgtgtgtttggtttgatgttgtttttctagttatttgatacgtaatgttaggttgttaatttgtgatctttctttttgatgtggtcatttaacattataatcttatcccttagcacagcttttgctgtaaaccagaggttttggtatgctgtttctctatttttattcatttcacaacatgttacaatctttttaaattttatcattgacccaaagttcattcagttgcaggttgttaaattttcattgtgtgtgtagtcttgaatattcttctagggtttgatttctggctttatattactgtggtctgagaagatatttcatttttaaaaagttattgagtcttttatttctggcatagtatataatccatgtttgaaaatattccttgctaatgggaataatgtatattctgcagtcattaggttaaatgttctgttaatgtctgttaggttcatttggtctagagtccaatttaagtctagtgtttctttgttgattttctgtcttaatgttttgcctagtattatcatttgggcattgaaatccatcacaattgtattgttacctgtgttcttccttaggtctaatagtatttgttttatgaacatgggttttctggtgcagagtgcatatatatttagaattgtcatttttaatcaatcattttatcattatataatgactttctttgtctttacttactggtgtttatttaaagtttttttatatgatatagatagtcttgcttgcttttggtttccaattgcatgaaatatattttttcaccctcttgatcttgaatctacgtatttttaccaattaagtgagtttcctgtcagcagcataaatttcaaaactcttttttattctttccactaatctatatattttaggtgaagaatttaactcatttatattcaaacttaatacagatatgtgaggtctggcttctgttgtcatgttaattattaactagtggctttgtagtcttaattgtgtaatagttttatgagtgaattttataattttgtgttgtttatgatggtgagtactgacctattgcttccatgtctaggtctcccttgagcatttcttgtaggtgcggtctggtgtaaataaatgtccttggcattttcttaccttagaaatactttatttctccttcatttatgaagcttagtttagaaggatacaaaattaatttctgacatagaattttttctttttttttctttaagtagtctgaaattgggagtccaatctcttctatcttataactttatgctgagaagtacactgtcagcatgatagaatttcagataaattattagacacttttctattgtgaattttaggatttttttcttcctatttactttagatagtctgaggactatagatcttggtaatgtctgtcttccagtgtcttctcatgtagttttctgaaccacttttatctgcatatgcaaatatctagcaagactagtgatgttttcctcaattacttcatcaaattggtcctctaaaactttttactaattttctccctcaggaatatccatgattattggctaagttgttttacataatcctatacttcccaatgattttgttcatttttttgttattttcatctgactgggttaatgcgaaatatctgtctcttaggtttgatgttctttcttctttttagtgtagcccattgtgaaagttttaaactattttttgtaattaaaattcaatgaagtctttactccctgaagctttatttttaaaatattaaagtcttaagtaaatcttgaattgttctgatttttttttttttttttttgacacggagtctcatactgtcacccaggctggagtgcagtggcgcgatcttggctcactgcaacctctgcctcccgggttcatgcaattctccttccttagcgtcccgagtagctgggactacaggcacacaccatcacacccagctaattttttgtatattgagtagagacagggtttcactatgttggccagactggtctccaactcctgacctcgtgatctccgctccttggcctcccgaagtgctgggattacaggcataagccaccacgcccggcctgagttattctgatttatttgtgttggttctcaaatttcttttggatttaattgagattccttgaggtcaacattttgaattatttatctgacatttcaaatatatcatgttgtgtaaattctatttctggagagttaaggtgatatccggcgtcttgtaattgtgttttttcatacttccacaattgcttacctgcttgcttttcattggctaaactatctcttactgtttttgaattcattttgattttcatgaaaatttcattccctttagaatgtgaatataacgtatattatgtgggtcttttgatttggttcttggtttactcattggcaaaggctctgtaagagtttcttgtatatagatagtcattatttagtggctttctgaaactatggttgtagtaataatctactgggcctgtgagcaggctcactgcctcctgcaggccctaaatagtggaggcctcagaaaccatttcttatttgcaatgcacttgtttcagcacattttatattgggatgttaagttcacctacacattagtatgtgtccttacagatttgagctgactgtggtagaagcagatgagtacatgcttgatatctgtacacagggagaagctctctgttgcctcaggcgatggactggtctatgaagtgcacagtgacttgagttctctgatcagcccctgagtgggggatgaagctggacagagatgagccaccgagcctggcaagcaaaagcgccagccttgatggaaatggcgagctgaggggcatctactcagtgtggtttcttttgttattaagagctttagtgtggtggctttttcaaattcccgttgtagtagtaacatactgagcatgtgagcaggcccgcggtcttttgcggggttggaatcacagaagtattgagaagctaatctcattttcaactgctgtacactggtggtattgagtttgtatgaggtcatgcagtttgaacgtcaggccagtaggtggtgctcgcaggtaagagccggctatggtggcagcagaagggtttatgctttaccggtggttaaagtgggaaatttgtcatgttccagatcttagagaaaagacttttagctatttctcattcattataatgctgcctgaaagtctctcgaacataactttttattatgtcgagatgtgttctttctatacccattttttacattttttttcctgaaaggatgttgagtttcatcaaatgatttttcagcatcaattgaaaaaaactatatgtcgattaaagatctaaatgtaaaatctaaaactataaaaactctggataataacctaggaaatacaatttaggacattagaactggcaaagacattatgaagaaaatgcaattttaacaaaatcaaaaaatggcaaatgagccctaagtaaactaaagagcttctgcatagcaaaagatactatcaacagagcaaacaggcaacctaaagaatggaaaataaaatatttgcaatctatacatctgacagggtctaatatttatagcatacatgcaattaaacaaacatacaagaaaaaaagtgcccaaaggacatgaaaagacacttataaaaagacctacatgtggccaacaagcataggaaaaaatgctgactatcactatcattagagaaatacatattaaaaccacaatgaggtaccatctcacatcagtcagaatggctaatcttaaaaaaataataacagatgctgctaaggttgcaggaaaaagggaacatttatacacttctagtgcaagtataaattagttcaaccattgtggaaagcagtgccatgatccctccaataacctaaaacagaagtttcatttgacccaacaatcctacaactggacatatacctaaaggagtataaacgtataggttcattccagcactattcacaatagcatagacatggaatttacctaaatgcctgtcactggcataatggatagagaaaaatgtgatacatataaccatggaatactatgcagctaagaaaagaatgaaatcatgttctttgtaggaatatgatggaactggtagtcattactcttagaaaactaattcaggaacagaaaaccagatactatatgttctcacttattttttggagataaataatgagaaatattctctcagggcctgagtcttccatattcaaaaaaaaattctaaaataagtgttcaacaagttgccgacatgcctttaaatatcctgtttcatctggaccccttatatcactcaataaagccatgagaactatatttaaaagtgggattctatgataataaataacttaacagtaagaataggaaggatatggatggttttactaatttaatgggtacataactgtggtatacactatattcctatgaataagatattctgatttcagagctaagtattgtttcctacgttgtgtgtgtgacttggttgtgttggatttgagagtgtagcacgtgcacagaccatgtggatcagaaatccacatgtaaagatgacaatctatggatgtgaactacaagtatgtaagtacttcaagtaattctatttaatggagtttgaaataaaactcaaacttattcaaaacactaattacttggtatttattttgagatctatgagtttatcaagaaattcaaattcctatttctatttaaactcccgattcctactctcagtgggagggaaaactcacagccaatcacacatcacaggacaaatctgtaaacgaagagtcattcctctgaaggtcctgggtgttcaggactctcaggcaggtgctgaggaccctgtcttgggagtgcccagcagatctcagaaccctacatggggcctgctggacactcatgtgggataactagtcgccacttattcagagttaccagtgagctttgactgttccgaatgggaccagcatggagtcaaggtgcctgctcaatgtcagagacagcgatggtctcagaaacaatccaggtaatctctaggccaataaaatgtggattcacagtgagaagtacatcctggaggtggagcttgttcttcagtgggaagagtgctgtgcacagaaagcttagaaatggggaagggggtgcgtttcctcaggcaggattagggcttcgtccctcagcgtcccactcttgtatggctgatgtggcatctgtgttttctttctcatactagataaggctttgagctgtgaaataccctgcctcatgaatatgcaaataacctgagctcttctgaggtaaatataggtatattggtgccctgagagcatcactcaacaaccacatctgtcctctagagaaaaccctgtgagcacagctcctcaccatggactggacctggaggatcctcttcttggtggcagcagctacaagtaaggggcttcctagtctcaaagctgaggaacggatcctggttcagtcaaagaggattttattctctcctgtgttctctccacaggtgcccactcccaggtgcagctggtgcagtctggggctgaggtgaagaagcctggggcctcagtgaaggtctcctgcaaggcttctggatacaccttcaccagttatgatatcaactgggtgcgacaggccactggacaagggcttgagtggatgggatggatgaaccctaacagtggtaacacaggctatgcacagaagttccagggcagagtcaccatgaccaggaacacctccataagcacagcctacatggagctgagcagcctgagatctgaggacacggccgtgtattactgtgcgagaggcacagtgtgaaaaaccacatcctcagagagtcagaaaccctaggggagaaggcagctgtgctgggctgaggagatgacaggggttatcaggtttaaggcttttttgaaaatgggttatatatttgagaaaaaaataacaatagaaacaagtacacactctaattttaagagatatattcaattcaagaattgtagaagccgaattcacagtgggaaaggccacactcaataaagttgataaaaacattccaggaaggtgctactgtgaacaagttttcaaattagatgaataaataatttggagcaatgttatttgatcatgaggtgagacagtatgattcttaaaaagtggaaaaaattctttcaaatgtttctgccactctttatcataaaattaattttagagcagttttaggattacaatgaaattgcacagaaggcatgagaattcccatgactccctgccctacacaggcagagcctcctccactatgaccatccagcaccacagtcacaaatcagttacaatggaggaatctccaaggacatttgattctttcttttttggtgatgccctaatataacaagcctaatttatctcggaataccacaagttttgttcagtggatttctaggaatcatattagttagagggaaagttggtgaggctcttactatttgaactcattcttccaaaatccacaaaacatatattaatttaaagcttatcttacttctggtttacaggatccttcccagagagtaagatttttaagattttagaggcaggttcatgtctctaaaaggccagcaagttctggggaatcccataatgaacatcctttcatgggaattggagaccctggcaatgagagactccatgtataatgccctagagttggattagatgcactgtgagctcttgggtggtggttctgaaaaaggtggtctgtgcagtaaatgcaaacacatgcacgggacacaggaaggagcaaaagcttccctttacaaagtgtgtgggcacctggaagaaaccctcacaagggcacgtctcacccttaatgactgcacattagccaggggcatgatcatgattggtcttacaaggaaagagcaccactgaggtcataggttatgaaaatgtcatcctccagctgagaaattccatctgctggcatgtgcgtgtcaaccccgtggagggtgcactctgggagttgacgagatgcatagaaacctcctgtcatgaattatcgtctaccacacagtcagaatcaacctgtgctccagaaagagatacatgcctgtagaaataaacagagcttaaggattttcttacctgctgaatatagtgcccaaaaccacactttcaggaagattagctcagaaatgtttacaaagtgactgaagggcagtggcgggtgaggtgatgggacagcctcagggctgcacttgaggagggctccctctcccatgcaggcttttcctccaggagctgcatcaggaactcacagaggataagggagaattctgagaacatgctactgtggtactgcctagagaggaaggataaatgatgacaaatacatctctgagtaacatatgggcatttgttcatgaaaactgttttttctgaaagcttatgaaggtcttgaaatgcccctgattagctgaggacaaacatttaaaccctccttccacagggagttcaagcaggctggatgtgtcctgctatggatgatcttccccagccccttcctcttcccagctcatccctggctctctgtgtaaaaagttttcatcagtggaaggtggttgatgaagtgaggtcttcaatttcctcatcttctctgtggtcatgttattttcctcatctgaggtttaaaaactcacctgcatgcagcacatgacaggctaaaatctcttgtggacaaaacagtaacaaaggcacccaccatggttgagcacccgtgttgctgacagtgaccaccaagggtcaacgtcctcttcacaatcctgtgtcagagcagcacttgagtgatttcactagcaacttcccaggagaatcggcttaaaactacttgtcgcattttccatacagatataacacatctattttcctgaagaaatagaaagagctgaatgctgaatacactgtatgtctgctggttctgcaagtttgtgactatcactttctaatttctgatctgtgtggaccaccctccagatttttctcactggtgtgaccagccttctggatgtcaaatataattaactttttttcatataaaagtcaacacaagctcctcatggtttcggtgctcactgactactttaaacttacacaatatgtttctttattagttttgttttctggtatctctactcagcatcttcaacacacccatgttaagatgcttgtacaggtaattgttaattttaaatttactggtgtttagtttaattaaataggcaggcaatagcttagaatttagaaacaacaatgtaaaggaaaagtaaatgcaataaaatttaacataagaaaaccagcagctgaaaggaagggaaatctattctgccacctaagagggtatggtgacctcatagtacaacgaacttctgcagtttaatcgatactgctcacaagtgatagcattctctctctttatatcagagcattccctaacatgtacaataaagagtgagcagatacctccaaccagactgaccagtacctctccctgagtgcctcagctgatagagatagacatcacatttgtctaacaaaataattacaggctgtaaggatacccaccagtcatatggagataatttgaaaaacttagtcaaagcccaaaccttataggtagtcatttatacttagaagaattaactcttatcttcacatgtatttttcttaatcatagagaagctactagagtcactgtccaagttactgaatatcttattcctagaatgagacattgcacaatgtgttctgacatgagggaatgtagctatagttaaaggataggagatgtgatcacggaaacacgagtctgcgatccagcagttctttctccctcacatttgcccagaaacaaagaccccagcagaaaaatggaagggttgacttcagtctccaaagtatgatgtgagatatacgtcaggtatttcatgccattgttttatagtaggaaatttaatctctaaagaaggtcattttcaggataatactattctccaggatacttaaatgcccgaaaacagagagcgctacagtgcccagtgtccaggagctacctggcacgggtctggaaaccagtggacagaaatatcagtttctcttaccacatgtatgttggaaatttgaagaatgtttctttccttcttcgtaatcataggctgcaatggactggaggtcccagtacataagaggaaatgtgtctccagtaggaacacaattagtcccataaaataattgtgctcacactgtggtgcccacactgttggaccagctgactgagaaagtgttgtaagagctgcagtgtctactgattcctatcatatttggggctacattcgcagctaccaacggaaagagagagaagtaaaactggcttaggtagagtctatggatttgctttctttccttcaaactgaagtaaaaaaaaaaatcacatcaactaaaatggggacgatgatgaagtgatcaaggacaagagccactcagtgttttaggtgggttttaacctaaagtcccacaacatgtgagaacctgaactctggagtccggggcatctctggggagaatgtggaaggtgggcgggaggaaacagtgattcatgtctagggaaatttcagggctacctgctctgggggaaaggaaagcctgagcctctccgacagtgtcctctgttaaaattgttggctgacttattgtattcttcaacaccaatatttttttagtcctcttttaattttgtttttattattatactttaagttctagggtacatgtgcacaatgtgcaggttagttacatatgtatacatgtgccatgttggtgtgccgcacccattaactcgtcatttaacattaggtatatctcctaatgctatccctcccccctccccccacaccacaacagaccccagtgtgtgatgttccccttcctgtgtccatgtgttctcattgttcaattcccacctatgagtgagaacatgtggtgtttggttttttgtccttgcgatagtttgctgagaatgatggtttccagcttcatccatgtccctacaaaggacatgaactcatcattttttatggctgcataggattccatggtgcatatgtgccacattttcttaatccagtctatcattgttggacgtttggcttggttccaagtctttgctattgtgaatagtgacacaataaacatacatgtgcatgtgcctttatagcagcatgatttataatcctttgggtatatacccagtaatgggatggctgggtcaaatggtatttctagttctagatccctgaggaatcgccacactgtcttccacaatggttgaactaatttacagtcccaccaacagtgtaaaagtgttcctatttctccacatcctctccagcacctgttgtttcctgactttttaatgatcgccactgtaactggtgtgaggtggtatctcattgtggttttgatttgcatttctctgatggccagtgatgatgagcattttttcatgtgtctgttggctgcataaatgtcttcttttgagacgtgtctgttcatatccttcacccactttttgatggggttgtttgttttgttcttgtaaatttgtttgagttcattgtagattctggatattagccctttgtcagatgagtagattgcaaaaattttctcccattctgttggttgcctggtcactctgacgatagtttcttttgctgtgcaaaagctctttcgtttaattagatcccatttgtcaattctggcttttgttgccattgcttttgctgttttagacatgaagtccttgctcatgcctatgtcctgaatggtattgcctaggttttcttctagggtttttatggttttaggtctaacatttaagtctttaatccatcttgaattaattttcgtataaggtgtaaggaagagatccagtttcagctttcctcatatggctagccagtttttccagcaccatttattaaatagggaatcgtttccccatttcttgtttttgtcaggtttgtcaaagatcacatgcttgtagatatgcggcattatttctgagggctctgttctgttccattggtctatatctctgttttggtaccagtaccatgctgttttggttactgtaacctcgtagtatagtttgaagtcaggtagcgtgatgcctccagctttgttcttttggcttaggattgacttgacattgcaggctcttttttggttccatatgaactttaaagtagtttttcccaattctgtgaagaaagtcattggtagcttgatggggatgtcattgaatctataaattaccttgggcagtatggccattttcacaatgttgattcttcctacccatgagcatggaatgttcttccatttgtttgtatcatcttttatttcattgagcagtggtttgtagttctccttgaagaggtccttcacatcccttgtaagttggattcctaggtattttattctctttgaagcaattgtgaatgggagttcactcatgatttggctctctgtctgttattggtgtataagaatgcttgtgattttttcacattgattttgtatcccgagactttgctgaagttgcttatcagcttaaggagattttgggctgagacgatggggttttctagatacacaatcatgtcatctgcaaacagggacaatttgacttcctcttttcctagttgaataccctttatttccttctcctgcctgattgccctggccagaacttccaacactatgttgaataggagtggtgagagagggcatccctgtcttgtttcaattttcaaagggaattcttccagtttttgcccattcaatatgttattggctgtgggtttgtcatagatagctcttattattttgagatatgtcccatcaatacctaatttattgaagagtttttagtatgaagggttgctgaattttgtcaaaggccttttctgcatctatcgagataatcatatggtttttgtcgttggttctgtttatatgctggattatgtttattgatttgcatatgttgaaccagccttgcatcctagggatgaagcccacttgattatggtggataagctttttgatgtgctgctggatttggtttgccagtattctattgaggatttttgcatcgatgttcatcagggatattggtttaaaattctctttttttgttgtgtctctgccaggctttggtatcaggatgatgctggcctcataaaatgagttggggaggattccctctttttctattgattggaatagtttcagaaggaatgctaccagctcctccttgcacctctggtagaatttggctgtgaatccgtctggtcctggacttttttaggcaggaatttccttgtcctaataagcccaggagtgctacaggagaccagggcttatttcatccctcagcggcgaccgtaaaagacagccatcccgaaagcagccatttcagaggcctcccctcagggatgcattctctttctcagggatgttccttgctgagaaaaagaattcagtgatatttctcccatttgcttttgaaagaacagaaatatggctctgttccacctggctcaccagcagtcagagtttagggttatctcccttgttgcctgaacattgctgttattctgttcttttttcaaagtgcccagatttcatattgttcaaacctacatgctctacaaacaatttgtgcagttaacgcaatcatcacagggtcctgaggctacatacgtcctcctcagtttacaaagattatgggattaagagactaaagtaaagacaggcataggaaatcacaagggcattgattggggaagtgataagtgtccatgaaatcttcacaatttatgttcagagattgcagtaaagacaggcataagaaattataaaaggattaatttggggaactaataaatgtccatgaaatcttcacaatttatgttcttctgccatggcttcagccagtccctccgtttggggtccctgacttcccacaacagtttattaactttgtatgactaataatgtaaaatgttccccatatttttagcaatgttttacttatttgtgaaaggtgtgtttattaatttttcattttaaggtgtcacatttatctttcttgtttctgggatttcattctagtagatatagctgaatgcattttaacaattattgtaatcatctcacattttatatttggatttgcatatacattttattaagattttgattttgatataaaatattttcttacaattgtctcttttctatttttatgagataaaattaatgtatgcataattgcatacatcttcaatgtacagtttcagggtttctgacatatgtgcacacatttgtctccagcacctaagttaggatgaggagcaggtcagtctccacaacaagtgtcctcttcagtgcttccagtcagctctcacataaggatttttatttaatttcaagttttcattttcactaatcatcagagaaatgcaaatagaaaaacgttctggtttctgtcactacagttcaattttttcctgttttgggcatcacataaatggaatcaaatgttatagttcattttttgtaaggggctacttttgctatttgtgaggttcattcatgtatttgcatctaccaaggttttgtcatcatatatatacacacacacacttatatatgtactaatgcacatataggtatttcatatctcaatcagtccattacgttaataaatgacagtttattaagtaaatccattcattaagtgaataagtgacaaaaaatatatctattttcctgttgatggaatttagtttccaaaataaatatcgtaaacacatctgttataaatatctttgtacaagttcttctgcttatatctcccatttttattgataaaatatgtataaatataagtatgcattataacttttcagctttatggagctataactgacaaataaaattgtatgaatttaaggtacaccacttgaggtattgatatacatggggaaatattcatcgtgatcaaagtaattggcatgcctatcatctcagagaatatcattttatgcctttaatttattgtgagtctgtgatgaaaacacctaagatctactcttctggaaacagataagtttataatataatattcattagtatagttacattgctgtatgtttcatctccagaactccttcaacctgtgtatcagtccattctcaaactactttagagaactacctgagactgggaaatacatgaagagaagggagttagttcactcacagttctgcaggcttagcaggaacttatagggaggcatcaggaaaattacgatgattgtggaaagtgaaggggaagcaaggaccgtcttcacatgctggcaggggagagagagaaagagcaaggggagatgcgccacacttttaaacctcaagatcttgtgagaactctaacacaagaagagcaaaggggaaagccgcctccatgattcagtcactccccatcagacccctcctacaacacttgaggatgaaaatttgacatgagatttgggtggaaacgctgagccaaacagtatcattatacccggccactcacaaatctcatatccctctcacattgcaaaatataattatcccttctcaacagtctcccagtcttcactcaattcagcattaacacaaacttctacagtccaaagtctcctctgagacaaggtaagtttcttggatgtataaccctgtaaaataaaaaacaagttagttacttccaagctaatatgagatgaatgcactgggtaaatgttcccattctaaatgggagaaattggccactacaaatgggctacaggccccatggctagtccaaacactagcagggcagtcatcaaatcttaaagctccaaaaaaatttccttttactccatgtctcacatccaggacacgttgatataagaggtgatctcccaaggcctttggaagctccacccttgtggctctgcatgttagactccccatagctgctttcataggctggcattgagttgctatgtcttttccaggcacaccatacaagctgctggtggttctaccattctggggtctgaaggacagtggtcctcttctcacagatccactagacagtgcccaagtggggactctgtgtgtggaatccaacaccatattttccttctacactggcctagtagaggtactccattagagctcagcccctgcatgagacttctgcctggatatccaggcattatcatacatcatctgaaatctaggaggaggttcccaaacctcaactcttgcctcatgtgcaccagcaggctcaacaccacgtggaagcaaccaaagcttagggcttgcaccctctggagcaatggcctgagctggaccttgaccccttttagccatggctggcacaggacagacagggatgcaaggcgccatgtcccgaggctgcacagagcagtggcgtcctgggcttggacaaagaaaccatttttctctcctgggcttctggacctgtgatgggaggggctgccacaaagatctctgaaatgccctgcggacattttttcccaccggggtccttgttacttatgcaaatttctgcagccagtttgaatttctccccataaaatgaggttttttgtctaccacatggtcaggctacaatgttttatcaaacttttatgctccgcttcccttttaaacgtaagttccaatttcagaccatctctttatgaatgcacatggcttatgttttcagaaacagccaggtcaactcttcaatgctttggtgcttagaaatttcttctgccagatataccttaaattatgtctctgtagctcaacatttcacagatctctagggtagggggaaaatgccactagtctttttgctaaagcatagcaagtgtgaccttcactccagttcgcaataagttcttcaccttcatctgacaccacctcagactggacttcattgcccatatcactatcagcattttggtaaaacccattcaacgagcctctaggcagtttcaaacttttccacatcttcctgtcttcttgtgagcactccaagcttttccaacctctgcccattacccagttacaaagtcacttccacattttcaggtatcttaatagcagtatcccactcctggtgcaagttttctgtattagtccattttcacattgctataaagactacctcagactgggtaatttatgaagagaagagttttagttaactctcagctctgcccgctaaacgggaagcattattgggaggcatcaggacgaacaatgatggtggaaggtgaacgggaagcaagaaccttcttcacatggtggcaggagagagagagcaagtgagcggggaggtgccacacttttaaaccatcagatctcttgagaactttatcacgagaacagcgaagaggaagacaatcccatgaccaaatcactttatcttaggcccttccttcaacatgcagggtctacaatctggcatgagatttgagtcggaacacggagccaaaccatatcaaccttcataacgggaagtttttaccctttgaccaacaatacccaattttttcctcctcccagcccctgcgacctactattctactctgcttccaagagcttgaatattttatactttagattctatatataaatgagatcatgcagcttttgtctttctgtgtctggcttattccacttagcataatgttttctatttgttgcaaatataagaatttctttgtttttaaaggctgaataatactcagttttatgtaggtataagccacattttatctgttcattcgtagatggacattgactcgttttccttatctagactattatgaataatctcacaatggacatagatttgtcacactcagtttattttctctagatgtatgctcagaagtggggatgctctatgtccagttcactgagtaatcttcatgttgtttttcatactggctgtaataattcacattttgttccaaaccatacatggatacctttgtaccacatattcaggtctttgtgtaactcttgaatccatttttagctgatttctgtgtattgtgtgaggtgagttctatctatttcttctgcatatggatgcccgtttttcacaccactcgttgaagagactgtcctttctctactgtgtgtcttgggaacttgacaaagatcagtttattaggaagaaatgggttggtttccaggttgtgtttaatgttccattggattatatgtctgtttaaatgccagcattataccattttgatttatatagatttgattttgaaattatagattatgatatattcagctttgttatttatgcccaaaattactttggctatttgaagtcttttatatttttatataaattggagctttttaaaaacattttgtaaaatcatgccatggagattatttatttattttattggcatatagtagatatacctattttatgggaacatgtaatatattgatacatttataaatgtgtaaagattagtgtaagatttacatatctgtcacattaaaaatgtaccctttccttgtgctgagcacatttgaatgactcctttcgctattttaatgttgtgcattagattattattaactatagtgaccttactgatctatcaaacatttaggtcttatttctcctctataaatgtatatttgtatacagtaatcaacctctccttatctccttctctcttctatccatccaggattctggtaagcaacagtctattctatcttcaggcgatccagtattttagttttgatgtaaaataagaagatgcaatatttgtctctcttttattggcttatttatcttaacataatgacttccagttccattcatattatagcaaatgacagaatattgggtttcatggctgaataatatcctatcgcatacatagattacatttactctatccatttgtccacctacagacactgaggtgctttcacatctgggctattgtgaaagagctgcaaagaacatgggaggggacatgccttcatgaggtggtggtggttttatcttctttagaacatacccagaagaggatttgccaagtcataaggtatttctgtttttaatttattttggaatcttcatactactttgcacatagtggaaacacaaatggagtaaacattaaaaaagcagtttcggttttgatgtataatccagaaacaaataatgtttgaccatgattctcattaggagtctctaatggatctggtggaaatgcaggaagttttctaaccttgttcaggaaattatgagtttgcacctttttctttttgaggcttgaaattggcatgattcatgatgcatactgttgggaggtttcagaatgatatggcaaaaatcataatgaaaaggcaagacagagagagagggagagagagagagtcaggcctagaaagagaaaaaataattttctcaacaggagaaagtgctggatatctgtatcagtgttgagttttgctcatagacacatctgtaccgagtgaggaaccatgaagtcaagggaggggtctagaacttgttcaagtgaagcatcagcatatttctcacaggcaccaatttccaccacatcacaagggtgatgcatttttgaatgccattaaatatgagttcacagtcagtaatcatgtttccatgaaattcagttaaaataccaagggtgtgtccagatcactcatgcacaaatacacaaaatttgctttttcatgtgtggctatctagagacaaagtgcactgaggagacttcagcaggttacagagatttgcttaagtttggaaaaccatagaagagtgcctttaagtgaaggttggtatataaattaaataggtcaaaatcccctctatggagtagcgttccaattgtgtggaatttttaattccttattcagttgtaaaacataatccctaggactgactccgtggagttttactgctgtgttgacaaaaatatctaacaagcttccttccagtgtttcaagggaagtttttctctaaattttttccaatgtataaattttcctggctaaagatagtaaaaggctgttaaaaacacaactggaatggcagctttaatcttttgctgattgataggagtgagcataatacatgaatctctttgagtgttctgcctcatccaaatacaataggtcaaaggctagtactggaggtaagatttccaaatgtgtttttttccagctaccaagtcataggaaaataacagatacatccttgagacagaggaccataatgccacaatgctggtaggagtacatgtagacaagggagttcaagggtttcttaaaactgataattttaatgtaagaataccattcttttaaacttatgtggaagactgtgggaggttataacaatgccatattttagtatcagccctgcctcacagaatcattttataacagttcctttcatgagtgtgcttcactcggttcatgcaaaaacctggcagatcacaggctaaaaacagaaaatatagaagcttttaatcaactgaaagagctgtagcctttgtcaaggaattattggaagacacagagaacacagatagatgataaataaaatacattcatatcccgttaagtgtggaaattgaggaaagtttacataaatgtgtccaagtggcaaactgtttatttaatctggtaaccaatttttctataaattgtagagttgaaatgcaacaaatacatatttgaaatgatctggcacaaattaagcaaatatggtaactatgtattttcactcatttttatttaagatcagcggctcagcattgatatttttgataatatctgtgactcagcagctttaccttttgaggatatgatctggtatggcagttttcttagcttcaatgttacctctttttgcattgacttccacctttatatctgccaggaatctggggaaaaggagtgcctgtaaacgttccctaacttgcccattttggtgggttttccagaatgtgtgagatgctttttttttttttttcaaagcatcctgaacccatgcactgccctgaaacatgtttatttcctagtttaacaaattggcacttctaataaatgcaatctcttctgccatctgtgctgattttacatcagatagaggactgtgttctaaaggaaatcttatattagtaagagcaattttgtcattaacctagagttttattattgaggtgtgattcataacatataatattaggtagaggttctcagtggcagtgtctaaatctcttgggtgtacagtgtcttccccgttaacatgaagcatttacgagcacagtcatagtttccagccatgcttctccctgtctcacaatcaccacaaactaactatgaccacaactggaacttggtgagttattctttaataagttttaagtttgtctttaatctttatgcctctagattattatgtgagacataatctttatgcctctagattattgtgtaaagctatttcagaagaaagttaaaaagaacattttaactgactaaacaacacaggaaatcattaataaaatgcaaagtgtagatgtgagaggctccaggcctggataatgcaagagttcatgtatgcaggcagtttctttgcccaattatactgatacaaccagcatgtcagcttcatgccccatttgactcctattatgcaagcgcatggaaatgacatgctcaagggtcacacacagatatgaaaactggtgggagcaggagaggagacgactctgcacttctcctctgaaggaccaggaaagcctggacagaccatctccccagcctccatgactgcgcgacgtgcccacatggacactcatctctgacaagataagaagactccattgatgaggctgaacattttatgatttaaattactagagacttacattgaggtttcaataactaatttttataacccaaatttacttacccccatgttgttacctctttcttcagtgaaaaattgcttttgctgtaattgagttttaggaagattcccagtgttcacaactgagcttccaagagagtgttgagaacaaaaactgaatgagggcagagaaacccatctttactgtgttcaccactaaactcaagtggactcggcactgcctttgatcactgttgcttctctgcagagttcaggtttgtatttctcacaattctaacacagactctccctctcctcaaaggtttggcctccactggctgtaaggtcacactgttctgaatttcttgtctgaaccgttttatgagggtggtgatgagccatttaatggaaattttatatcatctcagcatgaatcctatgggcggtcacgaattattattctgattatggtaattgatttttctcagcatattcattactagtgatattcaaaaaccctttttatttaaatctttgatgcttcatttttgttgctatgacactttttcttctactgagtcttcccactagcattataacatgacctaatatccagggctcagttgttatataacaaccacatatgtcaaaagctatgcattcttttcacagcagacataattttctcttttctggagatgaacacacactggctgagctacccccactcacaagaacatatggaaaatcatgacatttttatttacttgactaataaattatgtcattctctcttcaaattctttatcccccagaatgccatgacaaactcttctgcatctgttcaaaccataaactcagaaaccacatggtgagtaaaagctcacttgattcgggatattgggtcaagctcttcccctccaatgtcccacagcattgggacctcagcccacctgtccaggttctatcaagagagtttagctccttcacagtgaaggaaacaattgagttaagagggaacctgcagaagatagacaatattgaaaaccattcatatgacaagggattactatcaagcatataaaataaactcaacccaactgcaaataataatgtggctaataatggaggaataacattaatacatatttctcaaaagaagaaaagaaaaagggcagatagatgatagatagataaatagatatattagtatgtatacatacatatatcgctagaaaacactaatattcaggaaaatgcacattcacaatgagatgtcttttcatcctttatctttgcttgagagtcagaaaatctaaataaataaataaataaaacaggagctggccaggattcatagaaagggaaactcttatagaccattggtggaaatggaaattagtgaagccatcatgggaaaaaatagaactaccatataattcacaatccaactgctgagtatgtatctatttaaatcattaaagtaaaaaactaatattgaagagatacatgtacacccatgtttattgcagcactatccaccatagctaacatatgaaatcaacatatgtgtccatcaacagatgaatggataaataaaatgtgttatatttacacaatggaatattgttcagtcttaaaaatgaaattctgctgttagaagcaacatggatggaactggacaccatcatgttgagtgaaacaagacagacacagaaaaataaatacagcattttctcagtgttatgtggaaattttaaaaagttgatcttctagaagtaaataatagagtagtggttatgagatgccgggaatgggaggagactgagagacaataagaggtttgttaacaaacgtataatttacaggcagataggagggatgtgctccagtgatctacagtgcagtagggtgactgctgttaacaatatagtgcacattttatgtttacaagtagccagaagacagaaatttgtatgttaccaacaaaaagaaatgttagtgtctaagctgatgaatttgttcattgttctgatttaatcataccacatggcacacatgcatagaaatatcacactgtaccccatacagttattatgtgctaactttaaaaaatcctttaattaaaacagattttatttgcatacattacaaatgcttcaacacagagccaggaataaataccatttttctttgaaatgtgaatttcctaacaacgtagttacattcatttgaaccaaaccgtgtatttgatcatggtaagaatagacaggcttatgcatagaatgatatattttaattttagacttctacttaataccataaattcaaataattttaaaacaactaagtaaaaactataaagttgaggaaatgtgtacgtggtgtgtgatgtgtgactttttccttgcgcaccactctgtccatggtggatgtgtggtgtgggtgtctgtgtctatttctgtttactctgcttgaggttctctgtgattctaggatctgtagttcagtgtctttcacaaaactgggaacgttcttagccattatttctttcaaatactgtctctgtatctacaatttctcctttcagatttaaaatgtacatatacaatactttttaatattaatgtttactttcttcactctcttttccttgcactttactctgtaaaatttctagtggtattttaagtgagtggtttcatttaaaaggtgagccagctctactgaagggtgtgcccaaagcttactcaatgtttatactgcattgcttttgatttcttatgcatttccatttgattttttcttagtattttcaactctcagttccctatctagtccttcattatgtatacagtttccttaatagatttttacatatgaattatagttactttatatatcttgtttaattagatagttctaagatccatatcatatagaagtctcattctgatcatttgtttattatgactttggtatttctcattaatatatgtaatctttgttgatagccagatattttaggttggacagttgatattggcttattacttcattttatgcattttctgcctgtatttgaccatactttatttttgccaggcctttaatgtggaaatgtttgaatcttctcagagctacatttgacgtttacttttgcagtagacgtcatagttgaagtctgttcttctgtgtccaccagagacttcagatcctccagtgataccttgtttttctttcctgcttggctttgtctcttcaccctgttccttcctccagagaatctctttcagctccttcaggtggattaagatattatattgaactgacaattgtgaaattggtggaaggcaatagaataaagggagattttctgacctttcatgggtctatatttctacgaaggcattgtgaccctgagtctgggtgtgacattgccggtgtttctgaacttctgccagatgagatgttggtctgtgtgttcttgctgttttccctgctgtggagtcctcttgttttccccagttgttccctcccacagctccaatgttctcttttggtgttatcagcttccagagttgatgacctgacctagagattaaggctctgattaaataagaaggaggggagatacttctcaatggaacttaggtgaagacctctttttccatctcagttcctaagggatggccccagtgcccctaagatcctggctttggtggcttgctcctgcagagtaatttcttagttctgcaatggggattaaggaggtgggtctgaatgcatttcagagtgtgggctctttttctctcccagacagacacattgggacaaaagatttttgtgactgtccccatttttgggaaaaaggtttcaaggtataggaaagctcttcagtatgtggtccctgagaaattcacgctacaacacatttaccacacttgacttcaccaattcagtatgtatgtatttttttctcttataatagcctacatttttatatgccagactctgcctcagttcaactcatacccatgcctttttactctctgcaagaacttgtctctccctaaatttcggatttgatgattatcttaaaacctccagtatttaaagtatattttaaaattggcaaaattccatctcctgtgtttatctgttatgttgatgctgtaaaacagtaagtaaaatatactcctcatctatgtacattttgaagctgagttgcaggttttttggtaagacccagagtcacagagaattcaaatattgttaagctgcttaatagaaaaacaaattatggtaaatgtgttcactggaatactacccatgatttataataaataaatgcctgacacacagaacagcagcaaaaccacacatgctcttattacagaaagtggcttctgaaaaccacaccgggcacgtacagctttgtcctggagttggtttagggggatgtcagagccagtgacgagaagcacagggccagatggcagcgttcactcatcccagacatgagctcctggatgcatacagagcccccccatgtgtgggtttacttccacttctgtaaaaggagaaaatactgactcctacagagcataatttacacattttttaaaaaatgtaatagggtgatcagggcaaagtgtttatcacagcacaatttcataagacagcatattttccaaataccatcattgtcagcaaacttctgcagagcaccgtcttcttatatgggtacagcctattcctccagcatcccactagagcttcttatatagtaggagacatgcaaatagggccctccctctactgatgaaaaccaacccaaccctgaccctgcaggtctcagagaggagccttagccctggactccaaggcctttccacttggtgatcagcactgagcacagaggactcaccatggaattggggctgagctgggttttccttgttgctattttagaaggtgattcatggaaaactaggaagattgagtgtgtgtggatatgagtgtgagaaacagtggatttgtgtggcagtttctgaccttggtgtctctttgtttgcaggtgtccagtgtgaggtgcagctggtggagtctgggggaggcttggtccagcctggggggtccctgagactctcctgtgcagcctctggattcacctttagtagctattggatgagctgggtccgccaggctccagggaaggggctggagtgggtggccaacataaagcaagatggaagtgagaaatactatgtggactctgtgaagggccgattcaccatctccagagacaacgccaagaactcactgtatctgcaaatgaacagcctgagagccgaggacacggctgtgtattactgtgcgagagacacagtgaggggaagtcagtgtgagcccagacacaaacctccctgcaggggtcccttgggaccaccagggggcgacagggcattgagcactgggctgtctccagggcaggtgcaggtgctgctgagggctggcttcctgtcgcggtctggggctgcctcgtcgtcaaatttccccaggaacttctccagatttacaattctgtactgacatttcatgtctctaaatgcaatactttttttgtcctttttgtttctttgtttttttgcaacaggagtacatatcctcagctccacagaagccagggtgtcactttgggggcagaaataatcgtttcgtggtcaacaggatgagagtcctgaggaatcccagggaaacctggagagtgttttccaattagactcagggcagagacctccatgggaatttctgattagaacgggctttgagctctgatgggagccaagagacaggctcacccagggtcggggtccttaaagcctgatggttttcacagctatcccccctcgtcttgtaaactcagactgattcagttgaccctttttctgctaatccattttgcttctctgtaggtttgattctcacagttcgctttcttcttctcttccctgagaacaaacgatgtgttttctgttttcagggaaaatcccagggctcaggtctgcaggacctgggtaggctgaggagactttctcactcaccattgtctggacactcctgttgtcttctgtgcatggaggcatttgggaaatgaagtggacattagtcattaagggaataatactagttttctccaattggatattgatgtagagctgaacttgtgcttctcacactgtcacagagtttggaccctcacctataactttgaggagagttgatgatggatagtccattgtgggtgagctctgggtaacagtaattgtagggtctggctaggcagcctaaggtcaatacttctggacctcaggaaagacaggctggaattcctgggaagacctgcatctgccatccaccgtggagtcccatcatcttctgttatgctgtgattgaatcagccccacctagtttatctagaacactcttcatgacttaggaaaacataatggcaagctctcctaacacctgtatcatgccatgggagcaacacctaagctagtgtgtgattgagtagatgagactgtgatctagtcaagacgacaggtaaaattgattgttgtcattatgatattttatatttggcaatataatcatgctcatattataaatacttttgctacattttttgagtgtgtcagaggctttggaactggaacaacttcatcttgaataggggctaggaaaaataagaccgagacctgctgggctggattcctagtaagttgatgcagtaagttagtcacaggatgagataggaggtctgcacaagatccaggtcataaaggccttgcagataaatcttacagtaaagaagctgggcaaagccctccaaaaccgagacagtggctaaaatgacctcagtttgtcctcactgttcattatactctaattataatgcattaacatgctaaaaaacactcccttccagcccccaagacagtttacagttgtcaaggcaacatcatgaagtttccttgtgtggtttaaaaaggaggggaggaacactcaacttcaggaattgcctggaggactcatgaataatccatccattgtttaacatataatcaagaaataaccataaaatggacaaccagcagcccatactgctgctccacctctggtgtagccagtctcattattttacttgcataagaaacttgttttcattttaatctgtggattttccccaaattgggacccctttctcctaatatttgtgctattattcgtgttctgagcagaaaaccccaagatggaatgaagtttccctacatttttataagaagtacattcacccctttgagcgaaaatgcacagggagtggaatgaggctgggaagctaatggcgtatgatggaagcttgtccctgactggaggagagagggagggaggattgggaggaaggttcctatatttttgtgctatgcaaggaagctgcaaaagataactgagtctcgtgtaagtcagtgctacctctcaggggatccctgtgactccaagaaagggctcttcttaggaatcactgtggagtcagtcctttcattagagtagaccacaggacatgggcctcagcacacgccatgccacagatgtcagaaagcagctgctgggaacctgatccacctgcattttgctgcctgtaggaggagggagggaggtgcattctcagggtcagcacactgtttgtgaatttttatagagaacccctgcttttgctgtatttttattggaaaatatatgaacaagtgtgcacctgcaaacaactgtaattttcacatttccttcagttgcattatttcttaatcctgaatgacgtcctgacacagagttgagtttttcacaggcattgttcgaaggatcgagatgatggcattttccacattcactggtttttctccatgtggcagagaccttgagtagagcacatctggcccttatccacactatctcttgtgtcccctgggaaagagcagagatttgcctgactgcagaatctggggtaggagtctgcacacctctgagcctgcagagaagctcagcgaagttttgtggagtcagagagctttccgtgtggggaacctctagcttcctcactctcggagattaatggtcagctgtacttgaggggttaagaattagagcaccttgggagcctgtctcatcacagttccattatgtaacttaccaccattagactgcgggtaataactcaatcttgatttttctgacccgattttttcatcttattcattactaattttgtttatggaaaatgttatgtttagtttatgattaaaacctcagaactttctgaacttatcaggaataatacaaatgtgtccagtttgggggaaatgtaaatgaatgtccatgcagtttgggtgtgtgtgtgtgcgtgtgtgtgtgcatgtgtgtttgtttgtgtgtgtgtggatatgtcagtcacttacaccacaatgaacatgattgctgaattacatagtcaaactaaaattagatttgctgaaaattgcctgcagcgatgtctgtgaagctgaccctgtcactttgctgtgaagaaactcagtgtacaggcgaggttgcacgggagagctaaaagcttctgcacacaggacaggctgagctcctgaactggagccaggcacaggactgagcacctgagaaacagaacccccagccctcctttatctgggctggatgggcaccagaggacccgcaggagatgctcagaactcacacaagacagagcctcagtgaggagcagaggcagcgaggaaccagtccagggagccctgtgaccgccacctcgggttgtcttattttgcttaacagcatccaaacctcaggagaccatttattacgttatttagacttccatgccctttctgtcccgaagtaaaacaaacataaatatgactctgcagttagctctttgaacctgggttatttttctgagaatgtcatcttcgtcatcaacatcatggtcatcatgtcaaaatcaacaggcaaatccagtcaccgtgaagacagtttcatggcatgattcatacacaatcattccattccacagagaatctctttcagattcttaaggtggattaaagtgttatatttaattgccaattgtgaaattggtggaagacattatactaaaggaattgtctctgacctctcatggggtcatatttccagaaaatcattgtgatcctgagtgtgagctgactttccaagtgttcccaaccctcctccagatgagatgctggtctgtgtgttcttgctgcttcccctggggcagattcctcttgttttccccagttgttccctcccacagctctcataatctctgttggtgtccccaacttccagatctgctgccatgacctgcagattaaagctctgattccgtaagaaagtgaggggagctgcttctcaatagagctttgatgggaacctctgttcatacctcaattcttaaggggctgcaccagtgccctaggatgctgattttcatggcttgctcctgcagggtaatatcttagttttgtagtggggatcagagaactgggtctggatgcatttcagaagtgtgagctcattctctcccagacagatactatgggaaaggaagatgttttgcaggggtaaatgattcaagagattagggcaactctccagtatgaggtcccttagaatttctcactataacatgcctaacacactcgacttcaagcaatccagtgtatatttgttcttcatcttgtaatagcctacattttatatgacagcctctgcctcagggaatttcatactctggcttcattactctctacaggaacttgcctctccctagatttcaaatattttgtttgttttcaaccctcaattatctgaagcattaagtaaaatttgcaaacttccatcttttctgtttatctgttattgttgatactattgttgtaagaatgaatatatgggcccggcgcggtggctcatgcctgtaatcccagcactttgtgaggccgaggtgggtggatcacgaggtcaggagatcaagaccatcttggctaacacggtgaaaccccgtctctactaaaaatacaaaaaattagccaggtgtggtggtgcgcaccagtagtcccagctacttgggaggctgaggcaggagaatggcgtgaacccgggaggtggagcttgtagtgagctgagatcgcgccactgcactccagcctgggtgacagagtgagactctgtctctaaaaataaataaataaataaataaataaataaataaatatgtgtgtatatatatatatatttctcatctatgtacatttttaagcttagcagcatattttttagtgagatccagaataataaaagaatccaaacatttttcagctgcctaatagagaaacaaattctggtaaattttttcactggaatactactcaacatttataataaatatatttctggtacacagaacagcaaggaaaagtatctaagtatttatgctgagtaaaataagccagacaaataagaatatgtactatattactccatttatgtaatttatttcaaatgaaaaaaatctaaagtaatatacaaaagatgagtagttacctgggaaaagggtagaataaaggaaggggaaatgtggaaacatacagaagaacaagagaaaatgttgaggggaactcacttgtccacctcagtaatgatgacgcttacatcatgttttcaattctacactttaaatacgtgaagtgtattatctgccaattaacactcacaaaatttattgcaagcaaacaaatgaaaaattagaccaaaagcggtggtataaagatacaaaatatccattaaaagtcagaaatatatgagaatttgcctcctgaaccctagttctctccttatttttaggtgaatgctagagtgccacaaaaatcactcaagttctcaatacaggaagtgggttccacaaagcacactaggcatgtccaattcttacctggagttggttcagggagtaactggggccactgatgtggagcacaggccaagctaccagggctcattcatctcagacatgagacacacacagcccctcctccgtgtgtgggtttatttcacatctgtaaatggagaaaccattgacttctacagaacataatttacacaaatatgtaaaaatataatagtgcaaaatgtttatcacaacacattttcataataagacagtgtattttccaaataccataattgtcacccaattcctgcggggccctgtcattttatctggggtctgccatctcctcagggttcccaccccagagctctctgtgtagcaggagacacgcaaatagggccctccccatgctgatgaaaaccagctaaaccctgaccctgcagctctggcagaggagcctcagccccgggattcccaggtgtttctgcttggtcaacactgaacatacaggattcaccatggagttggggctgaggtgggttttccttgctgctattttaaaaggtgatttatggagaactagagctattgagtgtgaatggacataagtgagcgaaacagtggatatgtgtggcagtttcttaccaggatgtctctgtgtttgcaggtgtccagtgtgagatgcagctggtagagtctggagcaaacttgacaaagcctgggtgtccctgagactctcctgtgcagcctctggattcaccttcagtagccatagcacgcactgggtcccccaggctccagggaagggtctgcagtgggtcccagttattagtggtagtggtagtaccatgtactacgcagactctgtgaagggccgattcaccatttccagagacaataccaaaaactcactgtatctgcaaatgaacagactgagggcagaggatgcagctgcatatgactctgtgagagatacggtaaggagaagtcagtgtgagcccagacacaaacctcccttcagggtacctgggacaaccagggaaagcctgggacactgtgcactgtgctgaccccaggggcaagtgcaggtgctacaagggctgggtttcctgtcttgatctggggctgccttgttaccaaattacccgagggaacttctctagatttgcaattctgtactaacatttgatgtctgtgactgctaaacttccctcacatatttgttttttgtttgtttgttttgttttgttttttgtaacaggaagacccatcctcacccctacagaagcccgagtgtcaccttgggggcagaaatgaccctgccttggtcacattgatcagtgtcctgaggaagcccagtggaacctggggagtgttttccagtcaggctcagggcagagacctccgtggaaatctctgattagaataggtttgggattcagacttgggccaagagggagtctcacccatgggagggtccttaaatcctgacagtttttacagctgttctccctcctctggcaaaactgtgcacatctgactcagaactgatccagctggcccttacttgctaatcaatttttcttctctctacacttcattctcatagttcccttttcttcccttcccagaaaacagagagtgtgttttctgtggtctaaatctcagggctcaggcctgttacctggaactcaggtgtggcccaggctgtggctcctgtgagacctggggaggctgaggggactttcccactcaccattgcctggacccgcctgctgtcttctgtgcatggaggcatttgggaaatgaagtggacattagtcactgaggggataatggtagctttctcaaatgagatactgatgtagagctgatcttctgtttctcacactgtcacagaatttcctccttcatctgtgactttggggaaagctaaggatggacactctattgtgctgtgagctctgggtgacagcaattggagggtctggctaggcaaatcctacagggtttcaggtcaatggagttggaatttctgggaagacctacactgtcatcctccatggagtcccatcatcatctcttatgctctgatggaatcagccccacctaggttatctaggacaatcttcctgacttaggaaaaaaatgatggcaggctttactaacacttatattataggatcagtacaacacctaggttagtgtgtaactgaataaatgactctatgagtcaaggggacacataaaattgattgttgccatgacatttatttatttatttatttatttatttattggaaaccagagttttattgttactgaaatgagtctcgccaagcattcaagaatgggattttttaaggatagcttggtgggttgggggcagccagtgagtcatgagtactgattgatcaggtcagagataaaatcatagggagctgaaggtgtcttgtgctgagtcagttcctaggagggggccacaagatcggatgagccagtttattgatctgggtgatgccagctgatccatcaagtgcagagtctgtaaaatatctaaagcattgatcttaggctttataatagtcattttatccccaggagcaaactaggaagggttagaatttgtagccaccagctgcatgactcttaaaacataatttctaatattttggctaattcgttagtcccccaaaggcagtctagtccccaggacgaaggagatttgttttgggaaagggcagttattgtctctgttttaaactataaactaaactaagttcctcccaatgttaggtaagcctacacccaggaatgcacaaggacaacctggaggtttgaggcaagatggagcaggttaggtcacagctctttcactgtttcagttgcagctttgcagtggtggcttcaattcctccctttgagttttgaccttatcgacttgttttgtttctctttaagtgatggttttataaccatctatgaaactctaacaggtgctctcacatgcagatttctgattaaaaactctgaagatggttacaatagtatagagataaaactatcaaatagaagactatcttttttgacttttcacttaaaatgttgcccaagaaaacttttcttttgagctatttatagctttcaacaattgagtatagtcctgtacataaaatttggagaatatttgtttctctctgtccactttctccagaatttggaaactctttgtgaatatccttaacttatggcaatatgatttttcataagtgcagtaagattttttttttttttgcaacaggacacaattggagaaactggttattttaccaaggctttgactgtaatggcgtgcttcaccttaagcaatcgaacttgacttatacagccaataagagccccttgggaaaactggcctgtaccttgtccacacagtctttgtacaaggttcctgaccagtggtaagtaaagaatgtcactttctaacaggcccaagaaccccatgttttcctgggaccccagaggaaaaataatttaccagacttacaggtatttgatggtaaaaactcatggctgggcttggctttaaaaaagtcttatctgagattccttatggaacagagttccaccaaagccaattttaaaagcctgtgtaaacaataattatttgtattgtgctttatgcaaataataaggccatgaataataagactaaagtttattttgcaaataaatcagtcctatcttgatttgttttaaataaaaatggggacaagagagaaaaaaattatgctttaaaaatatagtacacctgttgtttgctgttcttgtttttttttcttcagcagtttggacgaaattctaaattatttgtaggctacaaagccataaactaatgcgttcaaatctttacttttaaaactgcgaattgcactccttaccccagttctcattatgtactttatagtatgttgttccctccaatgtggtgctggaattatagatgacagcactgacagctttgccatgcaagccttggaaccccacgcaggcctgcgtgagtacactcagacagttgcaatgaggttccagtcctcttatcttgaggtcagcacctacccctactacgccccaggtcatcaataaaaagttgtaacagtcttggcccttcttacatcttcattatccaacaccatgatttttgttttttgccaaaacaattgccaaatatagtcataatcataggataaataattttgctgaaatatatgtgttattattggtcttttgagatggaaagtccaagactggattatgctttcatgcatttttcataagaagtacttccactcttttgacaggaaacgcacagggggtgacatgtggctgcagaagctgatggcatatggtagaaatctgtccctgagtaaaggagagatggacggaggattgggtgaaacattcttaggtttctgtgctgtgcaaggaaggtgtaaaacatatttgagtctactacaagtcaacattacccaagggggaacccctgtgactccagcaatgactctgcctcagaatcactaaagagtccttcctttcattagagtggaccacaggatctgggccatagcatagacgtcagaaagcagcagcttgacacctgatccatgtgcattttcctgcctttaaagggagggagagaggtgtattctcagggtcaacacactctttgttgatttttacacagaacactggcatttactttatttcattgaaagatatatgaacagatgtgtgtctgcaaatgattgtaattttcacatttattccaattgcataatttttaaattctgcttgatgtcctggcacacagttgtgttttctataggtatttttcaataaatcaagaaaatacattttccactttcactggcttttctccatgtgcagaggccttgagtagatcatgtctgactattagtctgttttcatgctgctgataaagacataccagagacttggaagtttacaatagaaagagttttattggacttacacttccacatgactggaaaggcctcacaatcatggtggaaggtgaaaggcacatctgacatggtggcagacaagagaagagagcttgtgcagggatctccctttttacaatcatcagatctcgtgaaactcatgcagtattacatgaacagtgctggagaaacccgcagccataattcaatgacctaccactgggtccctaccatgacactgggaattatgggagttaaattcaagatgtgatttgagtggggacacagccaaaccatattattttgccccatggcccctcccaaatctcatgtcctcacattgcaaaaccaatcatgcctttcctacagtcccccagagtcaacttgtttcagcgttaactcaaaaatccacagtctaacatctcatctgagacaaggcaagtcccttccacctataaacctgtaaagtcaaaagcaagttacttcctagaaacaatgggggtactggcattggataaacacacccatccaaatgacagaaattgcccaaaacaaaggggccctctgcaagtccaaaatccagcagagcagtcaaatattaaagctccaaaatgatcccctatgactccatttcccaaatccaggtcatgctgatgcaacagatggtttcccttggtcttgggcagctccacccctgtggctttgcagggtacagcctccctcctggctgctttcacaggctggtgttgagtgaatgtgccttttccaggcacatggtgcaagctgtcagtggatctaccacactgggatctggaggatggcggccctcttctcacagctgcactatgcaataccccaatagggactctgtgttggagctctgaccccatatttacctttctcactggcctagcagcggttctccatgagggtcccactgctgcagcaaacttctgcctggacacccaggtgttttcatacatcttctgatacccaggcagaggttctcaaggaccagttcttgacttctgtgtactcactggctctacaccatgtggaagctgccaaggcttggggtttgcaccatctgaagccatggcctgagccctacattggcgtctttcagccatagctggagtggctggacacagggcaccaactccttaggctgcacacagcacgggcaccctgggcctggaccacaaaaccacttttgcctcttaggcctccaggcctgtgatgggaggggctgccgtgaagacttctgacattcacaggagacattttccccattgtcttgaggattaacatttggctcctcattacttatgcaaatttctgcagctggcttgaatttcacctcagaaaataagatttcttttctactgccttgccaggttgtaaattttctgaacttttatgctgtttcccctttaaaactgaatgcctttaatagcactcaagtgggctttttgaattctttgctgcttagaaatttcttctgccagacaccctaaatcatctctctcaagttcaaaattccacaatttgctccagttcccaatgagttcctcatctccatctgagaccacctcaagctagaccttattgttcatataactatcagcatttttggcaaagcaattcaacaagtctctaggaagttacaaactatcccatattttctggtctttttctgagccctgcaaactcttccaatctctgcccgttacccagttaaaaagtcacttccatatttttggttatcttttcagcaatgtctcactctactggtaccaatttactgtattagtctgttatcacgctggtcccaagactggacaattcataaaagaaaggtttattggacttacagttccacatggcttgggaggcctcacaattatggtggaaggtggaaatcaggtctcacatggtggcagactagagaagagtgcacatgaaggaaaactcccctttttaatccatcagatctcatgaaactcattcactatcacacgaatagctcaggagagacccatgcccataattcagtcacctcccatcaggttccttccatgacatgtgggaattgtggaagttacaattcaagatgaaatttgggtggggacacaaacaaaccatatcactgaccttctccgcatcatctctcatgaccccagagaaagagcagagatttgtctggggtaggagctgctcctgtggaacttagaggctgcagacgaccccagtgcagttttatggagtaagagagttttcccatgtctgggaacttctagcatacccactgccagagattgctggttggctgttattgaggggttcagaattagatcacctggtagcctatctcactgcagccccattgtgtaacttaccaccaatggccttcacgtgaggactcaatgttaactgttctgacctcattttcttacctcctttatttgtaagtttggttacagatttttttttactttaatttcagggatatgtgtgctgaatgcgcaggttttagtttcttattcaagccttataattgctcaactgatcaggaataatacaacatgtatgcagttttggggaaatataaatgaacatccatgcaaaattttttgtttggatatgtccgtcagttacacccctatgaacataatagccggtcctcaccagaaattgctggtcctcaccgatctcaaaagcatctagatcttcaacttcctagccttgagaattcagaaaacaatgtttatgatatttctgagccacccatttaatggagttctgttatagcagctgaaacagactaaaccatttaccaagtctcagtaagggcagtgaggatccaccatgcttgagagacaagcattactctctcatttgcagctcaggatgacagaagcatgatcatgagctgatctgaaaagaagatgtggctttctctccctcggatctcagttgaagccatggtgtcacatctctatggtggagactaaattccagtctgtgatgtaatggatgcctgcctcctcccaccctcacttacgagacagagtttccatgccatgcgttattgaccaagaaccaagaaggactccaattattctcacccctgctcacttgtatggcagaggttctggggatattcctgggagaggcataatgagactatttaagtccacgattcccaaacagttttatgctcttaaagcaggagtatcactttgagatatatgaataatttcatgtgcactaaggtggaggctgttatatttttataggtaaagatgcatggcataaagacagagatacagcactctggaaattgtgtgactatgtttgcagttgactgtgaataatttttaccatgaagttatcctaaaacacataatatatttttactgtaagtaattaatgaaaagctgacagctccacaagagcaatatccacttggtttagcagagagaatgagaaatagcataatttaagaataatcagttagacactgtgccatgtgcctgtattttcaactagtgaggatgctaatgtgggaagatcacccaagcccaggatttcaaggccagcctgcaagatattgctagacccattttcttaaaaaaaaaaaaataacattctgggtcatgacaaacctcaaaaactgaccctctaaataggaacaaatttaattgcattaaaatgtggatgaatttttgacacaaaacagtgacagcatgccagcaatgagtacagaataacatccagttgttatgttaagagatacagactccgaaaaagagacatcaggtagaggctgtcaaaggcctcactgcctaatgactgcttttccattgatactgtgtgtatatcccggaatgcacctgtgaatgaggacatcatgtctttcatagtgtgagagaaagagacattactacccatctgacaaaggattgatcagaatataccaggatctcagacaactctataggaaaaatatctagtaatccgaataaaaagcaggcgatatttatttcttaaaataagactttcaaattgcaaacaggcatataaaatgtgctgtgtaacactgatcatcagaacaatgcaaaacaaaactacagtgaaatatcatctcatctgattttaaaatgatttcatccgaaagccagacagaaacaaatgctgggaaggatatggagaaatgagaacactcataacctgttggtgggcacttaagtttataaaaccactatggagaacagtttagagtttcctccaaacctaatagtagtgttgtcatataatccagcaatcctgctgctggcatgtactccctcccacaaaaaaaaaatgttgtttgcactaccatgtttgttatagcactgttcgtaatagccaaaatttgaaagcatcctaactgcccattaacagatgatggataaataaaatgtggtacatatagcatatggattaatattatgccataaagagaatgagattttttcatttgcaacaacgtggatgaaactggagttcattatattaattgaaataatcccagaaccgaaagacaaacttcacatattctcatatatttgtggaagttaaaaattaagacaactgaactcgtggagatagagagtgaaaggatggtcaccagaggctgggaaggtctatggtagatggggattattggggatgctcaatggatgaaaaaagtggttagaaataacaaataatacatagtatttgataacacaacagactaagtataatccttaataacataattatagattgtaaaataactaaaagtgtataaatggaatgttggtaactcaaagaattaatacttgaaaggatgtaggaaccattcatcataatgtgagtattatgcagttcatgctatatcaaagtcaggtaccccataaatatacacatataccatttacccacaaaaattcaaaattaaagtatttatgtatctcatcttctgtatctatattacattaaacctaagaagatactggtttcttcacactaccaagatccacatagacatccgtagcttctttctttgcctgtccataatctgacattgaaaaatgaggaaacctttcctatcatatgacattaatttacttagtgcacaatttcaaaatacacaaattgtgttagaattattaaactgacccttgttgaaaatatgtttatcgactagaataccgtgcttatatgcagcttatttatattttacaatcacaacatcaaattatttccaaagatacttgtttctgatattcatgcccccctttctgcagtgaaattagtacaaacctgtttatcattgttagatatttttatacagctttcattttattctgtgtttcatgaccagctaaatacttttgaagttgtatgcatttaggttaacactttgtctcaaaaaattatgagttttcacaaattatttatgccatgtgtttatcattgaacaccatgaaaatagtttcattgtgattaaaaagtgtgtgtttcacctaatccacacaccttttccccagattcctggaaaaccacaaaggtttactggatctatatttttgtctttggcaaaatagcctggctattctcttagcttcttctgcaaagcatcaagattcaccttcactgactgcagcatttattgggccctgatggctggaggagaggggctggagtgggtggtagccatgagtgacccaagtggaagttctcagtggtgctctgctccagcacaaagaagattcacagttcctggggacaacacttaacatcacaatctcccttaaaattatctactggaaagctgaggagtaggcagtgtattactgtgagagacacagtgagggacatatgggtgagtctagacgcaaacttccctgcaggaagacaagaggggactttgtggtaaatggtgctcagaaccactaggggacactcagaaccactaggagacactcaggatagcagaaggtgctcaggatgccgcagggtgctcaaaacactaggggtgctcaagaccagcagggggcactcaggacaccaggagacacttaggacatcagggggcgctcaggacaccagggggcgctcagcacaagcaggggccacagaatgacaagggtgcattccagaccaccaggaaacactcaggaccaacaagagattctcagaaaccaccaggtgtaacaggaccacctaaaggcccacaagacaaccaggagacactcatggccactgaagaacattgaggacaccaggggttcagggccaacagggagtgctcggggccaccatggggctttcagtaaccacgagggaatcaatcactcaggacaccacggttttcttaggaggcagctccacatcaggtgcctggggaaggtgacgtttgcttttagacctagctgattcctgagctggtcaagcaaaagtcttcccacgatctctcactatttcttccttgtaacccatggtttctttcacatacaaatcattaacttaggataggaattcaattcaacttttaaccttgcatatttttagaataataatagcaatagtaattcaatgtgttttgataataagaaattgtgtatgcctaattcaaactctggttccacgcatgggtttttgtttcttgtgctgtgccagtcacactacagtcaatgcttttctaataataactcaacaatgtcacggtgttaagtttcctttcattttgtctgccatttgtggagatgaaacaccactttcacgggtcagttcctccactttggttgggttctggtcttctgctcttcacactgtttctccaccttcccttctgtcaaatccttttgtcttcctcagtctcctggcaaagaagcaacaaatctatttattttgtctcctccacgtctggtgaatctgttcacttctcttcatgatcattgaacccaaccatgtttagaaggataacagttcaccttacaatatgctcatgtaggtcaggtgcagtggctcactcctgtaatcccagcactttgggaggccaagacgggtggatcatctgaggtcgagtttgagatcagcgtggccaacatggcaaaaccctgtctctactaaaaatagaaaaattagccaggcatggtgtcgggcacctgtaatcccagctactcgggaggctgaggcaggagaatcacttgaacccagggtgagaggctgcagtgagctgagataatgccacttaactccagcctgggcgacagagagaaactccatctcaaaaaaaaaagcatatgttcatctatccgcagactctctgacatcgtcacccttttctagggtcctgcagacatcaccccacaacatccagtccttttcctaagtaccacagagtgggctctgcagctcctgctgctctctgtgtgctcagcgctgaggctcaccagtgctttgatgatgaagttcaaatccctaatgtgtttgcaattctcagacaaccctctagcaagctgccattgtgagtgcattctggggatcctgggctgatttcaggtccatattgctggatgttctctagcatccaggcgtgttggcaaataaacatctagaatttgtattgaaaatttgtggaaaatcaatggtagaaaacaatcctaatttctaaataagaacattttatcctgactttataaaaacacaatgttaatttaaccaataatgtaataaaatgtgtttaaagtgatgtttatcttgttattagatgtattaataattggtattttaaagtatactaacagcataaatgacaaacaaaccaacacagcgattatacataaataccattgtacattaattaatttggcaagaatggcatttattttcatttctaccaaaccttgcctttaaatatgtttgttaattggcattaggatagtgaaacaatcacacagagcaacaacattttggaatattacattatactataaaatagtacattcgattcaattatataattaaaataacattaaataaattcatgttttggtttgatatttggatatgtgttcatttttgtattttctttttttgtatcttttgtagagatggggtttcaccatgttggacaggctggtctcgacttcctgacctcaggtgatttatcgggggaacccacccccaatatttcaatgtagggtctttctattttctgtaagtgtcggctggtctgagaaataaagagaaagagtacaaagaaaggaatgttacagctgggccaccgggggtgacatcacatattgataggtccgtgatgccccctgagccgcaacaccagcaagtttttattagggattttaaaaggagagggggtgtacgaacagggagtaggtcacaaagatcacatgctttaaggggcaaaaagcagggcaaagatcacatattccttccccagggtattaattactaatattccttgctgggaaagaatttagtgatatcttccctacttgcacatcagtttataagctctctgcaagaagaaaaatatggctctattctgcccgaccccgcaggcagtcagaccttatggttatcttcccttgtttcctaaaatcgctgttgttctgttctttttcaaggtgcactgatttcatattgttcaaacacacatgttttacaatcagatttcatattgttcaaacacacatgttttacaatcaatttgtacagttaatgcaatcatcacagggtcctgaggtgacttacatcctcagcttacaaagataacaggattatgagattaaagaaattatgaaagtattgattttgggaactgataaatgtccatattaaaatgaaatcttcacaatttatgtttagagattccagtaaagacaggtgtaagaaattataaaagtattaattttgggaactgataaatgtccatattaaaatgcaatgcctagggccaacaaaggagtcatattaatatgaaaaataatagctgaatattttggaaatgacacatgcagtaacaaatgtctatatgaaattaagaagatattgacacaaaattgagaaaaaattaacataattatgctcactactggtttataaaatgcctataataacactttttaaatcatattatagaaaataaaataactatataaatagcactctctttgcttgattttagtatttggtgcttcaaatgttttttatacaaataaacattggtcattttttgatggtaatttcaatattttcttccagaatacatgttcataaatgtaattgaaattgtataattttcagaaacttattttatcagttgtgacttgtatttttatgatagactttttacatttatatacttttgattcagaataattatagataaaaaaattataaagttaatacagtgtgttcccatctccaagtatctcctaagatgaatatcctctatcatcataagacatggtgttaacacatttacattgataagtgtaaatatattcaataccagaccttattttatttatcatttttccaataatttctattgtaaatgaaaaataaaattctaagcttcctcaagcaactaaatgaactcaaccctcagccaagggaatttcaaagtaaattctaaaacttgttccagcaatgatgggaaagtgagaggtcagacatgcctcattacatgctcctctctttggaattaaggcaccagtggccagcattagtactacaacaaagatcttaagacgggcaaaactatatttttgctgtaaacactttctatagcaaaaagacatcaaattacaacttgattctagtatagcatcacatgacaaatagcaaaacctaatgatttattctgtatgaaatctgctacctggaggcttcatctacataataagaactatgatctccaggaccccttatcttaatccagacactcagttgtaatgattgtattaccttacatttcaaccaattgccaatcagaaaatctttgaattctcctatgtcctggaaccctgtgcataaactttcctgcctttctagactgcataaatggtatagctcacatgtgttgattaatatctgcctgtaacttctgacccactaaagtatataaaatcaagctgtaatcaagccattttggacatgtgttctcaggaattcctggggtcgtgtcatgggccttggtaactcatatatatctcagaatgagccattttaaatatttcatagtttgtcccttttagtggatatcttcttttcttttttttgggacagaatctctctttgctgttgctttcgtatatttgtttgtttccagattccatcaaggccatcagtttgaattcagttgtcttgttcctttattctcttctggtaaatgacagtttgtatttctgaagttttctagttgaatattttatagataaaaatttatcaagtaggttgatagtgccatttgggactcttatatctttacctatttaatcattgcttgttttctcaatcacaatgagtgttgatttctccatgttctatacatgttagtctattttctgttccaaatccatttattaggtcttttaaaatggattttggaaaagttgatcctattattttatgcaatatttcacttgagttgcaaaggtattctttttatgattattttgtctgaaattaacatagctattcaagttttctttggtttatattttcatggtctatatttttccatcttatttcttctctttgtgaatatgttaagaagttttcttggagaaagataattgctgggtcttttttttttttagtcaactatgaggaattattttttaatgatattacccttttgtccaataatggttgttttgtctttttacaataatatgtattgtttctattaatttattatttaattattattgatgaatatcttattggttaccataaggataacaataagacatttctataattgaattctaattcaaaaatgtagtacttctttctctttcttatttctttgagacggagtctcactctgtcgcccaggctggagtgcagtgggacaatctcagatcactgtaagctctgcctcctgggttctcgccattctcctgcctcagcctcccaagtagctgggactacaggcacctgccaccatgcccggataattttttgtatctttagtagagacaggctttcaccgtgttagccaggatggtctctatcttctgacttgtgatctgcctgacctggcctcccaaagtactgggattacaggcatgagccaccgtgcccagcctacccctttatatatagaacagagatattataactatatatgtctaattcctcttttctatcccttttttattttatcagtttgtaattacataagctataaaaatgtaatattgacatttttataattgctttacacatttatgtaataaagaaaacacaaatgcaaaaactaaatttaaacctcatttttttcattgttgacaatctttatcttttggatacattcaggtattggatgtatatcatatggctgctcatctagaaactctgctaaaacgtctatggcaagattaatatgctgggaatagattttctcaggatttgtttgtccgacagagtatttatttgtctttgatttatcatctcaagagacaatgtcaagaagatgctgtttctgcaaatgggcaatctgcaaaccaaggacacgtcactacattactgtgcaagagaagcacatgaggaaaggccggtgtgagacacaaacctccaggaacacctgggctaatgagctgcagggggcgctcaggacccactgatcagtcaaccacagaggggagtgcaaaggttaggactgctttcctgcaagcattgaaaaaagaagaaaaaaactccgtctgacagtttctccaaggaacttctgtaattttagaattctgtgcctaccaatgacatctccaaatatttttttaaaatattgtgtttggaggacatactctcacatggacaaaacacaaattgacacagagatgaaaagccctcaaccatagtcaccaaaattggagacatgtagaagctcactgggacctgttgagtcttctccaatcacactcagaacagagaccttagtgggtctcccttagagtagtcattaaggatggtgataacagcctaaagatggtagaccatggtcagtgtcatatagaatatggggaccctcacaagttttttgtctgacccttctcctgacactaaattatgcaaattaataacactgatctggtgcttcttttgattctaatttattttatttttagttgtcgttctcacttttcctttggattttcctgctccctggaaaaggtaaatgtggtctccgtgacctcaattcaagggctgaagccctttccctgtagctcagctggggctcaggctgtggctactgcagccatgtggaagaggctgaagggactttcttcactctccttgctcaggaccatccactgtattgtgtataggcttctctggaaatgcaagtggccatttgtagtgaaagaaatatgtttgtctggttaaaatgggaggtggatgtagagttaattggctgctacataaactgtccttctccaccagtgcttttaggatgagattgtgaaatttgtaagaatcaaaatggagtcacatatgttaaaaccctgacaaatggattcaggaagtgtagggagaattcttacacacatatccctgacaacaagaactatcataaaatagttcttgcaaaaagaccaacatgacctcataatcatgacttctgcaaagacttctactcagaatctacttgcccagccttagattaatgccatctgaattacactgatcatgttactatcactggtcctcaccacagatgcaacaccctcctgagtcctgaaacctgactccatcccatagagtagggcacagatgaggggaatgcaaatctccaccagctccaccctcctctgggttgaaaaagccgagcacaggtcccagctcagtgactcctgtgccccaccatggacacactttgctccacgctcctgctgctgaccatcccttcatgtgagtgctgtggtcagggactccttcacgggtgaaacatcagttttcttgtttgtgggcttcatcttcttatgctttctccacaggggtcttgtcccagatcaccttgaaggagtctggtcctacgctggtgaaacccacacagaccctcacgctgacctgcaccttctctgggttctcactcagcactagtggagtgggtgtgggctggatccgtcagcccccaggaaaggccctggagtggcttgcactcatttattggaatgatgataagcgctacagcccatctctgaagagcaggctcaccatcaccaaggacacctccaaaaaccaggtggtccttacaatgaccaacatggaccctgtggacacagccacatattactgtgcacacagaccacaaagacacagcccagggcacctcctgtacaaaaacccaggctgcttctcattggtgctccctccccacctctgcagaacaggaaagtgcagctgagatacgttttcctgccagggcctgcatttcccatccccattagactcagagccctgtcttcctccttcttctttaataataaatggcatgactcctgttaatagttcatagaagcagaagctgagtcctgtttgtcaaacattcagcatgaaatgttcatgttacctgggccagatgcatcactggtatgtggccgccagtttaatgggctcatactactccaagcggccgaatacaaaacagcagaacatatgcctttattaaactgcaggaaatgacactggagaaaaatgtggggataagggagcaggaggaattgtgaaaattcagataatagcttttctcgtagagagaaaggtgcgttaataaaataattttataaaacaataaaacagatggaatgtgtccccatcacggagtgtctcacagtaacagtgcagaaataaatttctaaaaatgtcgtagggtaggtgtgatagacaaggcttatttccacacagggagcccataaatacccatgtaattaaaaatccagctcttagaaagggagtgcctcaacttgacatcagaaacccacgtcagtgagtctgaggagcaatgtggaaaagaaatggaaaattcaacaatacctttcttatgaaaatcctagctcacgtttcaacatgaaacataactgtctacaattttaggaaaaccatcccatggcaacaagtcactacactcaaaaggtactgagctaacagagttccagcagtgagcaggtcagtgctgaaatccccggagaatcaaggctctcaggtacgttgtacaaaacccagaactgagccacacaatctatggtcaagtgatctttgacaaagtcaacaaaaatatgcacggggaagaggccacgctcttcatgccatgttgctgggacaattggactgccatatgcagaagaatgaaactggacaccaacctgtcgacatatacataaccataagaaaatggactgaaggcttgattataggacttcaaaatataaatgtactcgaagaaaacaccaggagaactcctctggacattgggcttagtaaataatttaccacaaaaacctcaaaagcacaagcaataacatcaaaaatagatgaatggaatttagttaaactaaagagcttccacacagcaacagagtgaacagacaaattgcagaatgctaaaaaatatttgcacacattgcatctggcaggggactgataggcagaatttacacggaactgaaacaaccccaccacaacaacagctatgaaaaaacaaataacctcattaaaaattggcaaaggacacgagtaggaatttttttaaagaacacatataactggacaagtgctaaacatcactgattatcagggatatgcaaattaaaactgcaaagaggtatcttacaccagtcagaatggctactataaaagaagcaaaaatagcagacatcggtggcgatcaaaggcaaagggaagtctcagtcattgttggtgaggatgtagatgagcacagcctctatggaaaacaatgtggagatttttcaaagaaataaaagcagaactacctttgattcaatgaccccaccattgggtaactacccaaaggaaaaataaatcatcatatcagaatgataaccaaacttttgttttcctgcagaactattcacagtagcatagatatcaacctaaggaattaacctgtgtcttacaacagataattttatttaaaaagtcacatatatatacaattaaatactatccagccatattaaggaatggaatcatgtattttgcagctacatggatggaactctgggtcattattttaagtctaataaacgagaagtagaacagcacacaccacactttttcacttataaatgggagctaagtaatatgtgcacaggcccatagagaaaggaatgatggacattgcagactcagaaacatgggagagcagaagttgggagaatggtgagaaattacttaaagggtatgatgtacattatttggatcatggatacattaaagccaagacgactatgcaatatatatatgtaacaaaattgcagtcactccccgtaaatgtatacgaataaaataaaaaaaaatacaattgaaatgtgaaattattaacagttgatcaacaatcctgaaaattaaaacgtgtgatgcaataaatgaaaataattttagttgaacttcatcaaattttaaaacattttctattcaaccgactatcaagaaactgaaggacaagcttcaggggagaaagtatttgcaaatcatacatctaacaatgtaattataataagaaccctcaaaactcaacagtaaaaagaagcaatctgtttataaaataggcaaaggtttgtgcaaactttctatcaaagaagatgtacagatgacacatcagcatatgaatgtaattttccagtagagaaattcaaatcaagaccaaaaggagacacgactttaggctttagaatgaggaaaaataaagaagaaatactgacagtaccagtgtcagtgagcatgccaggccccgagagactaaaatattgctagtgcaaaatgaaagagtttctgggagaactgtttacagtttcttataaaattaaacatgtccttaatccatgacctagaactctcatccctgagtatgtcctacaaaggattaaaatcatgtgttcacacacacacgtattcagatgtttaacattgtgtgtgtgtgtgtgtggtgtgtgtgtgtgtgtgttagaaactaaaaacaacatgaacatctttgaaaatttgacacaaaccattacaggtgaactccagactttcttctgagtgacagaaggcctgcctgaaagatccccagagacacagtcatggatttcactgtcaccctcacatgtcactggcttgggctgggctctctctggctcttccctgaccaggaccagatgttgagctccactacctgcagttggaagtttatattttcaacaatgcactgagggctaagttgctctacagactgaaccaaacaaacatgggcgcctttgaacaaacagtgcctgacatttgtactgaccccaggagaactcttcccgctctctttcttcttggttctctcctgcaggccagcagccctgcagtttagcctggacctctcatgcatctacccatctcctcccaagtgcattttaccacagcctccactgtttttgtaattctccacactctgttgtaaatgaagtcaggtccttcgagaccagattcgggactctattttatgaccaaatttcagcctcacccccactcctgagacagagctcctaaataagattctgcaggtggagattaagagcgtttttcttcctcaatgtaggagatgagtgctcagtggagggatggggaggagctttccactttaccagcatgcagatcctgctggggtggaccctctgccataggagcagggctgggaaccaggcagccaatgtcctcctccttggtgctgcactcagggcagagcctgcatccatgagtggggctgtgtggaagaagtgagtctctggttctcagtaagtcttgtctagaactgagcctcagcagcatgacctgtgggcaaggtcggagggccaatgtcctggcccctggggaagagtgtgctctgctgggagctgggcagaaggaatcctgtctacttggctgcagccatctgtggtggaatttacatcatgctgagctcgggcatagaaggaaggaagagaatctttgatcaaatatcaatatcatgtctgaccttactgaggttttgtagattatctcgaataaatgttccttcactttctgtatgttgacagggcctttccagacccgttaatttttcaaaattaatctcaccagtttcatggaggcatggatatatcgagctccttataccgtcatgtgagatgtggaactgtttccttcactggttataaaataatgggttgacttttttcccaacactttacagataccatcaattgtcctattgcttatatggttataaccaaagcaatgctgatattattcatttctattctattgcaaggtatgccccctctactcgtctccaattgctggcatgtatttccatttgtctgtatgttttagtaatttgaatatgattcacctaagagtgtttgtgtgtgtgtgggtatgtgtgtgtcgtgtgtgtgtgtgttaagggcttatcctgctatttggtgttctctgacctgcactgatccatgacttacaatttctctaatttggaggaaaaaatagagggaaagtgagtttgagtccagacacaaacctcactgaagtgagcacaggattctaaccccaggggtgctcaggacacgctgatcacaagagccagcctcaggggcaggtgcagatggaggctgagctcttctttcccgtcagcactgtggcttcttctccataaaacatcttcccttgaggaatttatctgaattcatgattttttgcttatctccaaagtctctgaaatgaaaatgtttgttttaataaaagaaaaatcttctcacatgtgtaaaagacagtttcctacagtcgcttaatcttgtctttaaatgtcaattatcaatgcttctgaagtaaatcagctaaatctataaaagacactttgtttaactcaacactgcagcccagcatgacagcactgaaagggccagcaagcagcaggcaggatacggtgcatgccagacactggggcggaaggagttagtatccagtgcaagagaagaaagtgcccgtggtggtcactgtcaggacccaagctcacagctccaattgcaggtgaccccatgcaaaggaagagataccctcaccaatgtttagtgtggatgtcgagtctgatggtgccacattcacacaccacgtgaatatggaaagatttaccaactccattattgaggcgtctgctgagggctgcacaggcctctcaataaagtccaaactggctcaatagagcaggaaagaagctgcctcagggtttttatgatggtttggtgttgaaggaatggtggggcttcctactaaggggaaggagcttgtataatttgaacctaatactggcatccagtgaggacacttccatgattttctactaaatttcccatgtgtgggggacaaaagtgaaggaaaaggattaatcctgtcatcagtaatgaggcatcaaaatagagtctgatgacttattctacttagcaacttaagcaaatgagtgaaaaatgaggtaagtgttcactctgggtggacagcaaataggtctgcagaaaatagagtttttttaagtgtaagcacataacaaaaagaaagagaagaacaaattgaacagggatcttggaccaatgtcctgggtggaagctcttcactctgtgagatcatcagcttgctctgagggtctcgggtcaagtccttcttcaatatatctcaggccttacaggatacatgggaatgctcagcttggtgtccttcactagggaaaagaaagagaaatcagactgtcactgtgtctatatagaaagggaagacataagagactccattttgaaaaagacctgtactttaaacaattgctttgctgagatgttgttaatttgtagctttgccccagccattttgacccagccactttgagccaacctggagctcacaaaaacatgtgttgtataaaatcaaggtttaagggatctagggctgtgcaggacgtgccttgttaacaaaatgtttacaagcagtatacttgataaaggtcatccgcattgtctactctcaataaaccaggggcacagtgcactgtggaaagccgcagggacctctgcccttgaaggcggggtattgtccaaggtttctccccatgtgatagtctgagatatggcctcgtgggatgagaaagacctgaccgtcccccagcctgactcccgtaaagggtctgtgctgaggagggttagtaaaagaggaaagcctcttgcagttgagatagaggaaggccactgtctcctgcctgcccctgggaactgaatgtcttggtataaaacccgattgtacatttgttcaattttgagataggagaaaaaccaccttatggtgggaggcgagacatatttgcagtaatgctgccttgttattctttatgccgctgagatgtttgggcggagagaaacataaatctggcctacgtgcatgtccaggcatagtaccttcccttgaacttaattacgacatagattcttttgctcacatgttttttgctgaccttctccttattatcaccctggtctcctactacattcctttttgctgaaataatgaaaataataatcaataaaaactgagggaactcagagaccagtgctggtgcaggtccttggtatgctgagtgccggttccctgggcccactgttgtttctctatactttgtttctgtgtcttatttcttttctcagtctctcatcccacctgacgaggaatacccacaggtgtggaggggcaggtctccccttcgtacttgagcagccttacaactgggtgggtttatgaattaattcctcggttgcattacatgaaaaatcacacaatctacaaattttaaaaaataagcctttactttttataaaagattacagccatttcacaggctgggaagcacagccattggtgaagacgagagacaggcactcccaaggaggagcggtggggcagaaactttatgctgaacgtgttggctaaacagacataatcaacggattacaggaggggctatgcgtgttcataaaggtggtcatgacacatgaatatgggagcaaacatacacgtcacatgtgacccacttagcagtggggacttagcatttaaatgtgttacagttaggccctaagtgccaaaagctggagcaggggcacaaagaccctcagagcgcagcctccataaatggccagaaccaggccatggtcagtggtctctgatcaggagaaaattcctgaaatcaatctggtgtcccatccaagctggggttatggctgtggaatggggggtcagttagtcaggggatgagctgcagttggttaaatcgtgcttatctcaggatcagtgcttattttgctgctacagaagaaaataacagtttattctttaagagttggggtgagggatgtaacccctgcctggcatggccttaggtcttgtttataacggggcatcttattgccccggagaatctgttctgtcagtcttatgatctccattttaatgttagtgttggtccatgttgtctctgaaccacaaaagggagtgggtataatgaggtgtgtctgatctcttgttctgcccagctgggaactcagtttttaggtgtttttggtgcctccttggccaagagggggaaccactcaatctcatggggtgactgaaattttacttttagtttaaagtttataaatatggacctaagtattgacattctaaaagtcactcctttgttttggctaaaagtacttggcaagagtccttgaaatgaggttcaagagcagtattttctcatgactttatttgcaatagacacatgagagactgttgaaaagatgaagtaccaaagtagccttaatctgttggtgaatggagttggtataatacagaaatcactttcaatattttgtaacacatgcatgcatgcaataagacagcggtgagcactgagtgtaaagtctctaaaggtacgatctttcagccaccaaataatagtgtaataacggacatactctggaggagctgactataataccgtaacaccacggggagaaactttggccaaggaagtccaagattttcttttccttttcctttttttttttttttttttttttttttgttgttgttgtttgagacagagtctcactctgttgcccaggctagagtgcggtggtgcgatctcgactcactgtgacctctgtctccctgattcaagcgattcctgcctcggcctcccaaaagctgatattacaggcatgtgccaccacacccagctaagtttttcatatttttagtagagacggggttttgccatgctggccaggatgatctcgcactcctgacctcaagtggtcctcctgccttggcctcccgaagtgctggtattacagcgtgagccaccacacccagccgagattttcttaaagttttgaaaattttaatttaagggttacaattttttcaacatttccagaaagctgtagacagtattattctgtgttatatgagtgattgtagttccttccatttttagatagtattacaaacaattttagggctgcttgctttaaatagatagatgatagatggctacatacatacatacatacgtacctcgatagagatatagttgcaaacataaatacatagatagatagagttacagatgtattttagttattatgctacttttttctttgccttttcttcctatgttatgttagtcaggtctccaggacttaggagtgcatttacaatcccttcccttgtccattttgacgtgttctagacaatgcgagaatcctttgtgtgtggatcacttccaagtcatgcactacccttgcaataaatgtgtttgtgtatgtctttgccttactgacaagctctgctgagtgcagttatttctgccgtctgagctaactttacacttggtagagaaatatattctagatggaggcttccactattaatttaaattactaattcataacctccagcttaattattgaggtataatctatcagagatggtattagaacaaaggtttccaatgaaatctaacagaagggatgtcaaaaaattttcctaacttaggtaaaataaccctgagcccattcttagtatccagccatgtctcctatctatcacactgaatcccacactaactttgacctgacttgggacttgtaagcttcaaatatgaccttttgattgcaatgcctctaattcaggacgtgtggttattttagccaagagtaaagaaaaccaaatttaactcgctaaaaatgacaaagattaaaacctaatgaaatggaaactgggatatgagtggctccagacttggctattttaagagtctatgtgcccaggtgatttcttttctccattttacacacaggcaaacccaaaacgtcagcttcatctcccgttgactctcatcatctcgttcttcatcagcttgcttagaatgttgacttccagctgcatccatgttgccacaaaagacatgattttattctttttctgtgaatgcatagtgttccattgtatacatgtaccatattttcttgatcaaattcaccatgaatggacacataggttggatttatgtcttaggtattaagagtagcatagcaatgaacatgtaagtgggtgtattttttggtagactgatttattttcttttgtgcatatacccacatatgagatggccgggccaagtggcagctctgcttcaaatacttttcaaatctccagactgctttccacagtgcttggactaattcacattccacccaacactgtacaagtgtttcctgttctccgcagcctctctccagactgctttccaagattcctctcctccactttgacactttggtatatccatgtgtgtcctctctggttcagccagggacagagaaccaggaagacatcatgcattttctagagggagctggcttggggaatcaacgaccggagtagaaagtgcctttgtccatgcatcacaggcctgagggccctgggcaggaggtcaggaagagaggatgaccagacagctggggaaaccgggatgaataaagccagtttccttcctggtgaggaggggcaggtcgaagcctcgtgtccctgtagggatgaagcacactcacctgccactgctacctgccaatcaggtgacctgcagagcagcagctcctgagtcactgatggtgacttcctcctcctccaaaccctctaggatctgtgcttctcagagtgggaaccccagcaggtccccaagttttcaatggattcacctagctagtgtctctcctcagccccatccccaggctcctgccctggtgctgtgtacagtgtcacaacaggggtgacagtaacagctggtgcctgcactttccaggccaagaagtttgaaagaagcaagtcacagggccagccgggatatggggtaatcacacaaatttccttcttggaggaagtgctgggaaacatccttgagtcctcctcagctcacgtgcagctgctgctgttcatcccagtgcgggggacacatgagccctccccatgcccaggatggagctgtttcaatcacagcaggatgggaatgtgtcttctctatgggggcttttgaagcacagctctcctgttcctgagatttgagatttataaagacaagtcccacagagtggacctgcacaaataagacagtacaggatccccaggagagacatcccataagagaagggacaggcgggtcccatcacagacactcatcctcagaaaccctgaccggctactcaccttcacaggtccccagttcctgatcagtgcctgtgtctgctcctgagaagagatgaaaactcaagacaaatacttctcatgatcataggcttaaaaattctcaacgtaggaaatcaaatccagtagtttatcaaaaagttaacacactgcaatcaagtaggctacattctgcaaaagcaaggctgctttaactgctttccacagtgcttggactaattcacattccatccagcactgtacaagtgctttaacctatgcaaagcaataaatgtgatgctctactaaacagaatcaaaagcaaaaaccatgtgagtattccagcagatgcaggaaaaaagctttcaatagaatctaacaacgcttcatgataaaaaccctcaaaattatagacattgaaggagcacacctcaatctgatgagccgtctatgacaaacccatggccaacatcatactgaatgggcaaacactggaagcattttccttaagaacagaaacaagaaaaggatgcccgctctcaccacttctattcagcctagtactggaagtattcaccagatcaggcaagagaaagaaataaaaggcatccaaataaaagaaaaagaagaatgcaaaccctctgttttcactgataatatgattctatatgtagaaaatattgaaggctctgccaaaagtctcctagtattgatacattcgtttaggaatgtttcaggatataaaatcaatgtacgaaaatcacagtaacatttctagtcaccaacaacgttctggctgagagtggaatcaagaacatgctctcccaatagccaccaagacagtggaatacctaggaatagagttaagccaatgagatgaaatatctctaccagaaaaacagcaaaacacatgtgaaaaaaatcagagataaaacaaataaatggaaaaataaacattccatgcttatgaatttaaacaataaatatatgaaaaagttttaaaatttgtgattaattctacgtagcaatgccatttttttcaacatttacagaatattgttgctggtaatagcagtttagcatttgagtaatggaaacaccttacagaatcactttataacagttgcttcctgtagtgggttgcttcagttacctgatgaaaacatctgcatgtcacaggttgaaaacataaaatatgtctatcaactgagaaggttgtaggcttttgtcaaggaattacttcaagtcattcagaaaaacagcagacagtaaacgaaacttgttcaaattccatggagagtcaaagctgaagaaaatccaactagaagtgtccaaaggcccccaaggctcagttcctcggcaagtcccaccttctcaggttttccagaattttgtttttaactgatttacactgagtgaagtagattaccaggagttttccattattttaacataaaatcgggggctaagtgttgttattttataaagacatctttgaatctctcaggaaatttacctcctgagggttcagataagatcctactctaggttaagattacatgtttggcgcaatgaactggtacaaatcttactttagctttcatgttatctatttttccgcactgacttccacctttttattagtcaagtatatgggatggaagagtgcttctaagaggtccttaacttgcccatttcaatggattttcaagaagacatgagaaaccactttgtttgcaaagcatcccaaagccatgtcctgctccagaaacgtgatctcatttcctggtcgtttcttaactgacacgctctaatcagtgcatctgggccaatttgaaatgaggtgaagaaatgtgtcctaaagtaaagctaacattgtaataggaattcgtgtttaaaaacatttagttttattattgggcaggatccatcaacatataacagttgaagtttctcaacaggagtttaataaatataaggaatgtacagaagtgtttcctaatttaaataaaatgtagtgattacctaggctgtgagtgcaatcttggtaatcttctatgtccatgcccatcactctgtgcaccgcaaactaattttgacctcagcagaaacgggattaattttcaaattagtaatttttttccaatttaatttatttagatgattatgaatgactattttagcagaaagagaatcaaggaaacttgaactaaataaccagaatttaaaatgacaaacaattcaacaagatgccaggatgtgagtggctccaggcccaattaattcaaaactttatgtgcccaggttctgtattttcccaaaattacacatctccattccagcttcatgccacagttgactcccaccgtgtaagacatggcgacaccattcccaaaggtcgtgtgcaattctgaaaatggaataagcaaggagaggagatgatagtttatattctcctctgaggaggaagaattgcctcaacagaccacttctcctgcatctgtgactagaactatgtcacaggcacacatggagcaaaatccctcaaggggataatacggtaacattaatcagggtgatcatttttaatactataaaattcatagatgacactgcattccagcctgagggacagagcaagaccctgtctctaagaaaaaaagaacaaatcaatagatactgataccaacattttagataatgaaattttcataatgtaattttaaatacactcacatcattacataaatcttcccagaaatattcctagtcatgttgagtttcatcaacttttccagtgttcaaatctagaaatccaatagactcttgaggataaatcaaaatgagggcagtgaaactggtatctgctcagcacctgttaactcaggaggactcaatacacccttgcacactgctgcttctctgaatggctcacaaggactccagctcactctccatcctcctcaaacatctggcccccacttgccctaagttgactctctgctcttagtctgtgctctgaagtcttcccagaggtgaaagtgagctgtcagatggaacttccctctcacctcagcgtggaatttactgctacatttaactatcactctttccataatggttgatttcttggtctgttcattacagatcaaaggcatctgatttgaatctttatttctttgcatttgtctccatgacaattttgggaggttttaccgccagcactatgacacgatgtagtaacatgacacatttgtggttaacaacacctacaaattcagaagctcttcggttgtcttcccagcaaatatagctgcttcttttctgtgtatgaacacatcctggaaacacgtacacacccacatagatatatacatgcctatgacattttcttctctgtaagtgaaaattaacctcaatttcatacgaagttcatcatttccctgaaggtgaaggtaggtcgtttttcatctgttctaacaaatgctcagacaccagctagtaagtgaggagctaccctgcttctggatgttggatctgtctcttcccctttgctttaccacagaagattggccacttgtccaggtcccaagaagagagtccaggtttgtcctgataatatgactcatccaacttctgataactctactgttacacacattcatggaggtagcctattaattacataattcactaaacaaataccaaatacccacattgcaataccccatacccaagggtatgttcatgcattcagtgaaggaaaaggcttttcagagacagatagatcaggctagattggtcaatatatgggtgaaaacactggacttgaatgtatctgttttcccccatgtcacatgtgagacctgtcagacaggaccagggttccttgtgcactcagaggtgagggctcacagaattcctctctggtttccaggaaaggtaactgcagtaatcttggtaatgagaatatcctccagtgctgacctattatagagtttacatatgaaattttcactgcaattcacaatctactctttcacacagaagtgtacagaggtcaggacacatcctcagggtcacacattgagaatgatgaagatatgtcccacgagtttttcctaaggtctcagaaagaattccaggactcaaaaggtctcagagggcagctcccagtgccttagttaaaatggtggctcaggcctgtaatcccagcattttgggaggccaaggcaggtggatcacctgaggtcgggacattgagactagcttggccaacatggtgaaaccttatctctactaaaaatataaaaattagacggggggggttgtgcatgcctgtactcccagctactcgggaggctgaggcaggagaatcacttgaacccaggaggcggaggttgcggtgagccgagatcaggacactgcactctagcctgggcaaaggagcaaaagttcatctaaaaaatttattttaatttaaaaatttttaaaaaatggcccactccctagaacagagagattccctctaaacatgatggaggtcccgaactatacattaagtgaatcctggtgtgtctgaactcacatgattattacgttaagctgctgttccaatctacttcctcacctgggaaaagaggagccagggcatggctagttgaggccccaggaagagaactgagttctcaaagggcaaagcaagcatcctcatcccagggtgagcctaaaagactggggcctccctcatcccttttcacctctttatacaaaggcaccacctacatgcaaatcctcactcaggcacccacaggaaaccaccacacatttccttaaattcagggtccagctcacatgggaaatactttctgagactcatggacctcctgcacaagaacatgaaacacctgtggttcttcctcctgctggtggcagctcccagatgtgagtgtctcaaggctgcagacatggggatatgggaggtgcctctgatcccagggctcactgtgggtctctctgttcacaggggtcctgtcccaggtgcagctgcaggagtcgggcccaggactggtgaagccttcggagaccctgtccctcacctgcactgtctctggtggctccatcagtagttactactggagctggatccggcagcccgccgggaagggactggagtggattgggcgtatctataccagtgggagcaccaactacaacccctccctcaagagtcgagtcaccatgtcagtagacacgtccaagaaccagttctccctgaagctgagctctgtgaccgccgcggacacggccgtgtattactgtgcgagagacacagtgaggggaggtgagtgtgagcccagacacaaacctccctgcagggaggcggaggggaccggcgcaggtgctgctcaagaccagcagggggcgcgcggggcccacagagcaagaggccgggtcaggagcaggtgcagggagggcggggcttcctcatcagctcagtgctctccctcctcgccaggacctcagctgtccccaggcctcctctttctttattatctgtggttctgcttcctcacatcctcgctgcaggcaagaaagaagggagaaatttctctgtttaccattaaggttttaacagtcactggcacctttttttcaacaaattcccacaaggcccattttaccttcttgacaaagtatttcaaggcttctcaccatctcttgattggcgtcatcggctgcatcgtgtcctgctcttaaattcatgtgatgaaaccccaatcccagtggctctgtatttggagagagggattttaagaaggcaaataagttaactgtggccataaatgtgggaccctaatccactaggactcttgtccttatgggaagtggaagacatcagaggcctctctctccacatgcacacagaggagaggccatgtggggacgcgctgcatgagaaggtggccctttgcaagcctggaagtggcctctcaaaaaactaaccctttcttcacccagatcttggacgtcaaggctccagaacaataagaaaattaatatttgttatttgaaacaacctagtctgtggtatcttctgatggaaagccaagcagattcacagatacaattgtgttagctccgtctcctggagggagaagcagcccaccgaggctgacacatctctcagattatttttataaagaaaaatagatccaagatgaaaaccccaccacatttctgctgagtcattcacttagcaggcttctctgagatcagccctggggggctgtgttctaggtcatgtctctcactttccactatgagaatccatgtagatcatgagaaccagccagatggagtcctgatcccggcccaccttctgctgctccccaagtatcccaaagaaaaccactccagcgtcacccctgtgtcttctactctctaaaatcccactaaagctgaccttaaaccaggagatatttggggccgggctcttgttctcttcttcttagtcttccataaggtccaggtgctgagtaaagcctcagtaaagattgagcttcagttcccctaacccacatcattcccttacatccttgtcatgcatctgtcctctgtgggcactcagggcaggttacacaggaattgcctgaagctggcctcaactgatgtgctgagaccacgggtcatgcacatgtatgattccgggtcatgcacatgtatgattccaggtcatgcaggctctactgcaggacagacctgtgtcctgtggggcacagacagctgctgaccccgggtctcctctaataactcacacacctggtgtttgtgtgtgtccagatggccccatgagcacagcacactagggtggccaaccttacaggtggggccgtcagatggaatggacaggctggtcactcccatcatcagtgatttcccagtgaattttaaataaattaaacaaaattaacaacaaaggggaaggatatgtacctgtctctgggaggtatacagggtcccagaactgtgctgggagtgggtgtgaaacgcccttttgtgtggaaagccctccagcatgagtgaaagctgaaggaatgatcactgtgcaggtggaggatgataggcagctggcagggtacatttcctgaagctgttcctgggtgcatgatggttggatggcccatggtgttgagggctggactcacataggaacaaggaaattatcccatgggaatggcagaaaagaaaatggagatggacacccctggagacagcttattagatttggtggaggaaaaatagaaatttattccaatgaccccagcattttcagctaaataagagttgcattaatagacagaattatgaaaggaagggagaaggagtttatggagggaaaaaaaaagaagataaattaaaatttaaaactatgcaaatctatcaattggcagataacagagtggagctgatgcagctacttccttgttctggaaacctgccagagacacttagcattcctgtaaggccagtctagtggtgatgaacttgtccactttttacttttttggggaacttctcaaacctcctgcattattgaagaaaagctttaatccatgtaacgtatttatttggaagtttcttggctttgtttttattttcagcaacttgaacagaatcatgcacatcatgatatttcggtgaacaacaggccacctacaggacaaaggtctcattagattataatactgtattttcaccgcatttttccatgcttagatatgttcatctgtataaacatctaccatggtgattcagctgcccacagtattcactacacttacatgacatacagatttgttacctaggagcactatgctatcccacgcagcctgggtgtagcaaggtatttcatgtaggtttgtgtaaacacactctatgatccttgcacaatgacaaattgcctaaggacacattgttcagatgtattcctactgtttttcatttttttttagatggagtctcactctgtcacccaggctggagtgcagtggcacaatcttggctcactgcaacctccgcctcccaggctcaagcgattctcctgcctcagccttccgagtagctgggattacaggcatgaaccaccacgcccagctaattctttttttctattttttagtagagatgggatttcaccatgttgccctggctggtcttgagctcgtgacctacatgatccacccactttgccctcccaaagtgctgggattacaagcgtgagccactgcgcctggccaatgtatccctactgttaagccacaaatcatcgtatctcatttctctcccttttttgtccctgttaatattttcatgttgtgcgtgcattcttctcctagctcagtgaacatatttataaggtttactttgaattttctgctaggtaatcaatgtatctccttttaatttgtgtcagtttctagtgctttttttgttaaataatttggaccacttttttctgttttgtgattattgttattattattattttttactttctctgttgctttctcctcattagaagaaaaagctaccgtaatcactcttcacagaatatgcccagggaaaatgccatcacctatcaacccaggctgtcattgtggcatctcttaaaacttcataatggttgaaattttttgttgttgttgttattagtggcactcagacctacagaggattttaagttttgctcctactctaaattaggtggcattgaaattcatcctgcaggcagtctctgataaagtggaggaattgggcagttttgttatgcatatggttcataaaaataatatgagtttaaggttttctcagccaagtgctatatcctgatattttataatcacttctttgaatctctcttgggtttatcttttgaaaatttagatcagaatataaaccaggtttgaggctttttgtttggtgtaaacatctcctataggtcattgcgtgaaaaggcacagagtctatctgaggaggagaactcagggaagcctcacaacaacaggggagacaaaaccgaggtcactaaaaaaatatgaagcttctggctcctgcagcctccagacatgccccacaccctctcattgcacagaaatgaattcctttctctttcctgagtgatctttgccaagattcctctcctccactttgacactttggtatatccatgtgtgtccattctggttcagccagggacacagaaccaggaagacatcgtggcttttctagagggagctggcttggggaatcaatggttggagtagaaagtgtctttgtccatgtgtcacagccctgagggacacgggaagaaggtcaggaagacaggatgaccagacggctggagcaaccagtatgaacaaagccactttctttcctggtgaagaggggcatttggaagcctggtgtccctgtaggggatgaaccacactcacctgcccactgttacttgccaacgaggtgacccgcagagcagcagatcctgagtcaccgacagtggctgcttcctcctccaaaccctccaagatctgtccttccaggagtgtgaacctcagcagatccgcacgttttcaatgggtccacttagctagtgtctgtcctcagccccatccctgggatcctgtcctggtgctgtgtacactgtcacaatagtggtgacagtgacagctggtgcctgcactttccaggccaagaagtttgaaagaagcaagtcacagggccagcctggatttggggcaaacacacaaatttcactctgtggggaagtgctgggaagcagccttgagtcctcctcagctcacgtgtggctgctgctgctcatcccaggtgggacacatgagccctccccatgcccaggatggagctgtttcagtcacagcaggatgggaatgtgtcttctctatgggggcttttgaagcacagctctcctgttcctgagatttgagatttataaagacaagtcccacagagtgaacctgcacaaataagacagtgcaggatccccaggagagacatcccatatgagaagggacaggcaggtcccatcactgacgctggtcctcagaaaccctgaccagctactgaccttcccaggtcccctgttcctggaacagttcgtgtgtctgctcctgaaaagatgcccatcaagagtccccagggttctgcccccttccttgatgtgcctctgggagtggggctggctgggctgtgggtctggcgtgaccctctccacaggtcagcggctcagtgcaggctgcaccgactcggtggggctgggctgtggctgaccctcccagggggagcctggactcttcttaggggtatctgcaggatcccaggttctgggagaacagggaagccacagtgtgtgcagggccccatctccagtaaagtgtttgctgtcgctctgttgacaagggcatatccccaggcctaggggcactgtgggcgcacgaccaatgcgcgagacacagggagtaaggcacagttccctcccattactgtgaggacactagacacagtgtgtgtgtgtgtgtgtgtgtgtgtgtgtgtgtgtgtgtgtgtgtgtccattactgtggggactctaaccaccgtgtgtgtgtgtgtgtgtgtgtgtgtgtgtgtgtgtgtattaggagttttgcagtggcctctgagacccatgatcttgcaggtttagaaattatctgatgagatgttcatccacaggaaccgacaagagattaggtgttctcccaaagcccctggaagctcctggactcactgtgagtgtggactgatccagtgcttccagagctccacagaaggggctccctggtggtttcatagaatccttgcttggggtgtttctgcagagttcactggctttcctacgaccaatttaccattgcaagcgatggcgtcagcagcacatggtgtcacgtgtcactaaaggagcattctgagccaggacacagccacttcatactggggggaaaatgctctgggagcccagacaggagcctctctgcagtgcaagggctgggctgcagggggcgctcaaggcccacccagcacaggctccagccccagagcaggtgcacaggaggctgcggatggagtccccttaagatctgtgtcattcttctaaaaaaatctaaaataagtatttgacaaaaactgctgaagagtccataaatatcctattcaactgcaagaatttatcaatttacactggagatttctaaccctgctacatatcttaatagtaagcatctggaggtcaattaagcttttattttatataaataagtgcaacttttggagaaacacactcatcccccaaataacacattcatgtattaaagcctagaaatattttaaattacctctgagctattcaagtgtgggttcccagtgaagtcctgttctagggaaaattgttctccagtgggagaagctctgtcaacatacagtttagggatatggcagggcacacatggcctctaaggggattatagcttgaacccttagcatcctcctgttgggtaatccatgtgtcatctctccactctttctcatgctgtgttaggtatgaaatagcatcgctcatgaatatgcaaataactgagatgactatagatatctttgtgccctgagagcatcacccaacaaccacatccctcctcagaagcccccagagcacaactcctcaccatggactggacctggaggatcctctttttggtggcagcagccacaggtaaggggctgccaaatcccagtgaggaggaagggatcgaagccagtcaagggggcttccatccactcctgtgtcttctctacaggtgtccactcccaggttcagctggtgcagtctggggctgaggtgaagaagcctggggcctcagtgaaggtttcctgcaaggcttctggatacaccttcactagctatgctatgcattgggtgcgccaggcccccggacaaaggcttgagtggatgggatggagcaacgctggcaatggtaacacaaaatattcacaggagttccagggcagagtcaccattaccagggacacatccgcgagcacagcctacatggagctgagcagcctgagatctgaggacatggctgtgtattactgtgcgagagacacagtgtgaaaacccacatcctgagagtgtcagaaaccccaggggggaagcagctgtgctggcatggaggaaatgacaaagattattagattgaagactttctcagaaaatgatattaagtcattaaggaaaaggaacaatataaacgtgtatttgagaaattttaattatttgagagatttttcatacaatatttattctgcaagcaaatttcagggattgaattaataaaactgatacagaacttcctctgtaggtatctgtgtaaacatcaatttctgaatcagtgttgtaaatattttggaacacacacacaaatcacattttatctctacttttatctctatttttaaaaatgccaaaaaaactcattttgtgcatgtagcattttgaattcccaccatcaatgcatgatagttcttggttttccacattcatattgccatttatcattatgagaattgtgtgttttaaccattctaataggtgagtaatggtatctaatttttagttaaatgcacatttccctaataaaaattcacatttaacaattttcatataatttttgccaagatgcctcttctcatatttggttcatttttaactgcattgttttcttttgattagttgtaagtttacttgcatattgattataaaatcatttaacaaattaaaagaattcatttaacaaatatgtgacttggaagtattttctccaagtctgcggctgtcttttactcccttatcagtatgtattgcagaaaagtgtgtgtgtgtgtgtgtgtgtgtgtttatacaaatttagatttaaaaaatgtaaaatgttattcatccacagatcatgtctttggtattatatctgaaatctcattataaaatacagtaatagcaattactttttccacgtctctaatctcaggctacaatcaactcatgagtgtttaagcttcacctacttgattagaggactatcaacctaacatatttggaatacttctgtaaaaagatgtgttcctcttcctattatttctttatttgatcacttattaatatgtgtattggtttatggatgtctatttcatactctgaagaagatccatgctacattattcattttatttttcaaaccaccacggctttattatgtgctgggagctcattgagtttggatcctgcatccttacagctcacctcatgcttttgtttttgaacacttccctgtttcctgctattataataaattctaaactcattttctatattatctttttcatacatagaatcagccatttttctaaagattgcttgcttctgatgttaaagaatagtatttaaaaaattgtaatactgggtatgtgcattgttaatgtggtataagtacttgcaggacctctcaaccaactggcctagtaaactatgtatctaaccttctgtaatgtgattacattaaaaatgagaacacactggtctctctacccaattatgctaccacatggatctttctagccttccttccttgactgtctataacctctcactgcaaaatgaggaaccccatccaaccatatgccattttattacttagctgcacaatttcaggacacatgcatagcagtatcagaaatgtaaagctgtacccttgtaggaaacatgtttatctactagaatagagtgcttatgttcagtttctttacactttaaacttacagagtttcctcattttcaaagttccttaggtcagcaacttcattttccactttcttcagtgaggtcatttcaatgacactgtataatttgatttatttgaaattctataaaagccaaaactgtagtcaagtgaacaacaacatatagaggatattcgaggagtttagagactggtataaaataagttaaaaagacactgtttaagaagattaaaattatttttagtgatatgcaatggttcagatatgacacaattaatttgtctaagcacatagttttgtgatggaaaatataaacctaaatatatacaattaaaaaaaaatttagcagttcattaacccaaggatcaaatgcagattgtataaaattatctcattacttattttgtgagggtggagatttcatgagatgtatgcaacaaagaatgaggtaattttcctgatttgcatataagatgttgccattcactaaagacctttaattttttaaattgttttttttttaaatcaattttctatgtgacccaggtttttttctcttgacaagcaaataacccacaggattattttctttccttggttgagaaatatttccccaaacttcagctcagttcaggcatacactgtccctgaatgggcatttaccctcagatgggtacacacacctgtcaacatgtggactcttctgtcagacaaacgcacctttactcacgtggattcttctctcagacaaacacacatgtccccacgtggactctttcctcagactaccacatatgttcttacatttactctttcctcagaaaacagacatttcctcatgtggactcttgtctcagacaagcaaacatgtctccatgtgaactcttcactcacataagtacacatatgtccacattgactgtttccttacacaagtacatatatccaatgtcgaattgttctgtggcaaaatgatctcaagataatgataatcataaaccccctccctgacaaggcatagatctgtatttttttcattgcaacctaactttgccttattgtcaagaacagtagtttgcagctctaaatataccaattagagacaggtgtccattttctctggaaacgtatttttatgttcttactggacatatttgttgataatgtttgctattatgaagataccccaacagtgtccacattagagaataaaaaatagtaatgggcagattaactctgtgcatccagacccagaaatcctttgaccttgacttccctgaaatgtagacacagaggatggatgagcaatgctgagcagtgcacccatgaccacaaaaagaaagacgtggaaatgtgtcccctccacttctcatgaaaggcagctcatcccctgttccctcaggccctggcgaggagccaccccatgtctgtgcccttcctcagtgtccacaccgtggggtctgcattgatctggattctcttctcatccccgtcaatattagtgtccttcgtaaatcaggtccagctgtggcttctcctcacggggctgttctcagtctgtttgctgtgttcacggaagtcctgtgtgaagtttactgatggagtcagagggggaaaaaatttacagcccagtggtgagactctcctgcaaagcctctggtttcacctttactggttacagcatgagcttggtccagcacgcttcacaacagggataggtgtgggtgccaacagtgagtgatcaagtatgaattctcagggttactttccatgagtacaaataaattaacaatctcaagcaacacccttttaagtgcagtctgccttacaatgaccaatctgaaagccaaggacaaggtcatgtattactgtgagtgacacagtgagggaaaccctgtgtgagcccagacacaaagctcaccgcagggagacaggaggggactatgtggtagatgctgctcagaaccaccagggggcatcaggaccatcagggagggtgcacagaaccaccaggaggggctcaggacaccagggggcgctcagaaccaccagggggccctcaggacaccagagggtgctcagaaccaccaggaggcgctcaggacaccagggggcgctcagaacactaggaggtgctatgaatcactagggggcgctcaggacacaagggagcactcagaaccaccagggatagctcaggataccagggggcactcggaaccgccagggggcgctcaggacactagggggcgctcagaaccaccagggggcactcaggaccatcagggagggtgcacagaaccaccaggaggggctcaggacaccagggggcgctcaggaccacaagggggccctcaggacaccagggggcactcggaaccaccagggggcactcagaaccatcagggagggtgcacagaaccaccaggaggggctcaggaccaccaggaggtgctcaggacaccagggggcgctcagaacactaggaggtgctatgaatcactagggggcgctcaggacacaagggagcactcagaaccaccagggatagctcaggacaccagggggcactcggaaccgccagggggcgctcaggacactagggggcgctcagaaccaccaggaggcactcaggaccatcagggagggtgcacagaaccaccaggaggtgctcaggacaccagggggcgctcagaacactaggaggtgctatgaatcactagggggcgctcaggacacaagggagcactcagaaccaccagggatagctcaggataccagggggcactcggaaccgccagggggcgctcaggacactagggggcgctcagaaccaccagggggcactcaggaccatcagggagggtgcacagaaccaccaggaggggctcaggacaccagggggcgctcaggaccacaagggggccctcaggacaccagggggcactcggaaccaccagggggcactcagaaccatcagggagggtgcacagaaccaccaggaggggctcaggaccaccaggaggtgctcaggacaccagggggcgctcagaacactaggaggtgctatgaatcactagggggcgctcaggacacaagggagcactcagaaccaccagggatagctcaggacaccagggggcactcggaaccgccagggggcactcaggacactagggggcactcagaaccgccaaggggcgctcagaagaagcagggggtgctcagaacaccagagggtgctcagaagcaccagggggcgctcaggacaccaaagggcactcatgagactgtggcaagggggtgctgagaaccacaggatgtgaccaagacaccaaggggcactcagaactgccagggggtgctcaggacaccagaggattctcagaaccaccaggggatgctcaggaaactagcgggtgctcagaaccaccggaggacactcagaaaaccaggggatgctcaggaaccaccagggggcgcccacgacaccagagggcagtcagaaccaccggggcatgctcagaaccaccagggggcgctcaggacaccaggggatgctcaggacactaggggcgctcaggaaccaccaggggacgctcaggacactagtagggtctcagaaccaccaggggatgctcaggacactagggggcgctcaggaaccaccaggggtcacccaggacaccaggggtcgctcaggaaaccagagggtgcccaggaaaccaggggaggttcaggaaccaccagggggcactgaggacaccaaggggtgctcagaaccaccagggggcgctcaggaaccaccagggggcgctcaggacactagtaggcactgaggaaccaccagggggcgctcaggacactagtaggcactgaggaaccaccagggggggctcaggacactagtaggcactgaggaaccaccagggggcgctcaggacactagtaggcactgaggaaccaccagggggggctcaggacaccagaggtcgctcagaaaaccagggggtgctcagaaccaccagggggcactcaggaaccaccagtgggtgttcaggacagcaagaatggctcaggacaccagggagcactcaggacctccaaggggctctttggaggcagctccatatcaggtacctggggaggatgaggtttccttttccaccttggtgattcctgacctggtcaagcaaaagtcttccccaggatctcttacgatgtcttccttgtaactcatggtttctttcacctataaaacattaacttagaacaggggttcaattcaacttttaactctgcctattttcagagttatactagcaatgatatatctcagtatattttttttaattgtgtatattcaatccaaagtctggctctatgcacaatttttttgttttctgtgctgtcagacacactattgtaaatgcttttctaacaactcagcatatgcatggggtccagtttcttttcctttcatcggctgtttgtgcagatgaaacaccactttaagggctcctgtcctccactttggcccctggtgttctgcttctcaaactttctccatcttctctttttctgtcaaaatattttatcttcctcagtctccatgcaggaaacaggaagtccttttacttcctgtcctccatgtctggtaaatcagttcacttcttttcatgatcactgaagccaaccaagtttaggagagtaacagttctccttagaatacactctacctgcagaccctctgccctcatcacacttttctagggtcctgcagacataacccccacccattcctctttttccctaagtaccacagactaggctctgcaacttatgctaccctctgtgtgctcagcccaggggctcagtagtgctttcatgaagtccaaatccctaatgtgtttgcccactctcagaccaccctccagcaagctgccattgtgattgaatcctgcaaagcatgggctgctttcagtttcctattgctggatgttctttattataaaggcatattggcaaataacgactagagtttgtattgaaaattaacgccaaaaagttttttaaaaagtttttcaaatagaaaagttctatcctgcctagtttaaaaaaatacaatgttactttaatcaatgatttaataaaaatttaagtgatgtttgtcttattagttattcaatttattaataactgactgatatttaaaaagtaaatactggctgggcgcagtggctcacgcctgtaatctcagcactttgggagggtgaggtgggtggatcacctgaggtcgggaattcgagaccagcctgaccaacatggagaaaccccctctctactaaaaatacaaaattagctgggcgtggcggggaagctgaggcaggagaatcgcttgaacctgggaggcggaggttgcggtgagccgagaacacgccattgcactccagcctgggcgacaagaccaaaactctgtctcaaaaaaaaaaaaaagtaaataccattgtacacttaagtaatatatttggcaagaatggcatttacattcattcaaaaatgaaactgcaaatacgagttacattcaattaaataattaaaataatatagaaaaaaatgggtgtgttgttttggtgtttaatatacattcatttttgcatggacgggtatatgtgtcattgctgggctgttgtgtatgtgtgcgtgtgtgtgtgtgtctgtgtgtacaactatgaagtttaaaatatattattaaattacgtagttatattaatccaaatttatcatgttaaaatattaggaaaaaaacaccagtagagaaattacagagaacatcagcaatgcctacagcatttacaagagtcacattaataacaaacaaactagttcaaatgtttagatatgacacatgcagtagaaaacgttcacatggtattaacacaaaaatggtgcacaactgaggaaattataatacgttcatgatattggctacataaatgcttatgatagtaatgcttttcatccatcaaatgcttatgataatgcttttcatccatcatattatagatgataaaacaactctataaacacttccatcactagcgtttaatatgagatgcctcacatctttttctgaaataaataaacatctgtccaccacttcgatgatcatttcaggattatcctctgaaataattatccataataattttagtaacaatattattttcagaagcctattttataaggtctttgaactattatttttatgattgttactttatattttacacactttttatttggaataattataggttatcagaacaattgtaaggaaaatacagtgtgttcacatccatctccaagttttcactaaagttaatatgtcaaaaaaaacatgggacatgggactaatatatttacattgataagtttctgtttattcagctctgggatttatttgaattttgccaatttttaacagtttccttttttcctttttcttttctttttgagataaggtgtcactttcctattgctttttgtttgtttctttgttcaacccacgtaaccacatcaaattcagtcaccatgttcctctcatatcttctggttaatcacagtttgggttcctgctgtcttcccattgaatattctataaatgaaactagtcaaataagttgattctggtcacttatatatttacctattttatcacgtttgttttgtcaatcacagtaagtgtcgaattcgctatctgttatagatgttagcctattttctatcccagatccattggttaaatctttggtgatgccttttagaaaactgatccctttaccctatgtaatatgccccttgattcctgaaagtcttatgtctaccttgtctgaatttaacatagctaagcacgctttcttttcgttcatattttcatggtccatgttttcctgtatttaacttttctatgtagagcaaatttctgtacagagctagtagttgggtcttgctttttaaatcaactataataattctattttaaaactggtattactatttttctgttaatttctgttttaatttggcattttatgatcatgtttatttctctattaacttattgtttagttcatcttttatgaatattgtattggccctaagatatacaataagaattgtgtataatcagattctaattcaaataacgtaaaacctcttcataggttgtagagctattataacttattcttctaaacactctttctcatccgttgtcttagtttattctcagtttgcacttatatgtgctataaaatataatatgtgcatttttatcattacatagacatatattagaacaattaaaaatataaaaactacatttcaacttcattttttcattcttgaccacatgttttatttggatagattcatgtttcggatgtatatcatatggctactcaccctggcagaaaatttgccaaagcacctactgaaggatgaatgcactagcaataaattttctcagaatcgatttgtcttacagggtattcatttgactttcgctttaaatgaaatttttaatatatatagaattccagtttgactttaatttgtaatttattttcttgtactcatgtattcattattttcttcctgaagatggtcacacattccattctgctgggccttcattatagatatttgtgtgtatctattcagggctatatttgcaatttatggatgccacaattatcagagttgaagtcagcttctgctgtccacagagatttcaagttcctcccatgatacttgcttttgtgtccctgtttgatcctgggtctttatatttagttttccccagggaggctgtctgtttcagctgtggaaagtgcaccctactgacagtttaaattgatgactgtgtggtgaaggaggttggacaaagcgggacttcctccaaccttctgactgagtctccttcttatgcaggagtagtaagcatagttctggggagtggccttccacattgtcctgtccttaactctttccccagggctggaacgtcttttcccagacacaactgtttttcaccagtgtccccagctttttacccactatccttaccctaaagagtaaggatttctttcctgaggaaggagatgggaggtgtttctggatcaagtttccttggtgtcgtctgtttccttttgtttctgttgacttcaccacagctcatatgacacatgctttggtggatttcccctggaggtagtggaggtgcattcaggcattccacaggagctgctgttcttttccccagtcaacaccacaagacaccagatgaggaagttgtccgtggatttttcaagttctctaggaaaagcttgcaagcactaggccaatctaacaccattagtacatgcatactaaaaaaaaaaaagtcattaagtatttctaggttagtctgtttctatctcaaatgccatccagtggcacctgccctacgtacactagcaggtaggtcctggttctctctgcaggctcctatcttctcagatttcagttttcttgtttgcttggtgaaatcaactcagatatgttgaatgttttttctctcttttatttgtagctgttcagcttcgttgttaatgaggtcagaataaaatcacagttttctcatttttttcacattcccacactgaatagctgctttccgtataaaagccagaaactgagagaacacattgaatatccattacaggtgaatgttaaacaatttgagatatgtttgtgtactggaataaaatgctgcattacaatcaagtcatcactcattcacataaaacatggccacattctcaaataatgtagggacctgagtgcccctccatctactggcctctcctggggccctagcctggccacaccttcttgcagggcagtcttggacgccctgggatcccgcaccaaaatttctgccctggcagaacatgcctgactggtggagagctccaatcgggcagccctcatgtgcacacaccagcttacacacttcctccgaatactgtaggttcacccaggcccacgtaacttcccacatcactttgcagtcacatgtctgtataggtgggttttgcttttcttgtcccaccattgcgtggagtgcagtcccctccccccaccccaaccaccatggcagaggaagctttggtggggaaaaagccagggccgctcctgtcagcgtcccgcacttgcgctaattctgcacagagaatagcagatcatctcacacattcagaaatcactcctgcttgtggggcatgaatacggcacccgggcctgtgcccacaagtgtcccatccctgagccaacacctcctccagtgtgaccttgaacacagtcaccaacagggccccacagacgcaatgcctctgccactgtggcgaacacctgcagggaggcaggcacccagacacccactagcactctgccacagctgccacacctccaacagcccaggacagtggattcctaaccttaaggagccggagaaccaagtcagggactagtataacttcccccagagtcagagcacacagtctaggtgttgggagctgagcactggccacctaaatttttccagaaatgaagccagttggctgaatccaccttataccacaatcaaaccctcaaggtcatccaatagggtaaaagaaaataaaaatgtatccaaaggtcagcaacttcaaagattgaaggtggataagcccacaaagatgagaaagaaccagtgcaaaagtcctgaaaacaaaaagggcgccctctttcctccaaacaaccacagcacctcttcaacagcagttctgaatggggctgagatggctgaaatgacagaaacagaactcagaatatggagagtgaaaatgtagatgaatacagctatttatggagaatactataaatgttcctcaaaaaataaagaaacaaaatctactgtagaatccagcagtctcactgctggctatgtatccaaaggaaatgaaatcaacatgtcaaagagatatctgcactccatgttcacgttcattgcagcattatttaaaatagtaaagatatggaaacatcctaaattcccatgaatggatgaatgaataaagaaaatgcatacagacacaacagagtaatgttcatccttaaataagaaggaaaccctgcctctgtgacagcatgcatgaatctagaggaccttatgccaagtgaaacaagccaggaacagaggaagagtcattcatgatttcactgtatatattaaagcagtagacttgcagaggtagagtagaatgttggttaccagggcctagaggggtggactgggaaagggagatgtgggttaaagtgcacaacgttccagttagaccggaggtataagttatgcctttctaatgcacagcatgtcaactatagctgataaggtagtatatatttcaaaattactaaaaaaataaacattagaatttccccactaagaaatgataaatttgtgaggtgatgaatataagcggcttgagttacccagttcataatgtatacatgtatcataactaaacaacatatgtcataaatatatgcaaaaattatttgtaatttataataaaataagtttcatatttaaataattacattaagaaaatgaacagaaactttcagatttcaagaatattttatatatatatatatatatcttaaaacaaacttgcaacagaatatagaaataagttttacgactcaatggaaaagaacagaattcaataaaaactggctaaaagaaacaacagctgcatcattatagaaaattctggaataatcagccatataaagattctcactctcttagaactagaattccgtaggacttgtaattcctcctgacctgggtgggaggcaaaaggaagaacagctaatggtgattcagtgagttttatacctgtgtgtacttctgtgctcactcagcagaaagaaaagaagaaaagaaagaaagagagaaagaaagaaacagaaagaaagaaagaaagaagaaagaaagaaagaaagaaagaaagaaagaaagaaagaaagaaagaaagagaaagaaagaagaaggaagaaggaaggaaagaaaagaaagaaagaaagagagagagggagagagggaaggaagggacagcagaagtcattgtggtgtgtgtgaaagcacaatccttgggctcccccacatccatctctactccagtcccatcaatgtccagcaaatacattttctaagatgaagtattttaaactttctaaatcctgctagaaaacccctcagctctttcagttttgctctatcacttgaattattgaattaaatctagtttttgtgggcctatcaataccataagccaaaataacacatgaagaaattgcactgagacacatgaaaaccttctgaaagctccataatttcagatctgcattcttatttccccgaacctaaatcactgaatagagactcagaacgagttgatcttgttcctgaacgtgcacagagccaaggacatcctgtctgtctggaacagctcaggtttgttcctgtttctcctagaggatataaaatcttgagttagggaaaaacagccagggacaccctgggctttgttcttctctcccctggaggcaggatgtccttcagagctttgtcccagtgggtaacacagctgctgaggtgtacaacccacgtggcctcgttttggtcacttttgcatggtgagcctgctttgcaccatggcctacaatatgcgtgtgtaactaatctgtctccatcttcaaaatgacattattccacatcaaatctagtgcaggtgcctcacacagaacattctcaattacctccatcattcataaaattgatgccattaatttcaagtatacatacatcagactcatttaacgtattgttattctcattgtttgaaacataacttttagatcaaataattaacaataataaaaatataaattttgaagtcaggtaatgtgatttctctagttgtgttctctttgctcagaatggcttgggctgttctgcatcttttgtttttccacatatattttaggattttttaaaaatttctgtgaagaatatcattgttgttttcatagggattgtactgagtctgtagattgctttaagtattatggacattttaacaatattgaatctttgaattcataaacatggaatattgttccatcttgtgtcctctttatttcctcaatgttttatagatttattgtagtttttttttactttgttcattacacattgtatgcctgtaccaaaacatcacatatacccaacaaatagaaatatatatactattatgtgcttataacaattaaaaattatgtatgtatattgaatctattcaaaatcagaaactatttctttttactgtttgtaaggtcttgtctctaggctataaaaagaatttgtaaaactcaacagaaagcataatataaacagaattctaaaatgagtgaaaatctgaacaaacacctcaccaagaaaaaatgttatctgaaaataagaatatataaaattgttcagtatcaattgtcataaactgatactcatatttaccaaatacaaaagtaaacatgatgtatttcaacagaattgattctcaaatatttgtatactcatacagtggaatactatcagtcataaaaactatgggttattaattcagaagacaacattttaacattttttctaagtgaaggaagatggacaaaagagactaagtattgtacaattccattcatgagacctgctaaatacagtaaaattaaaaggattttaaaaacaggtttgtgataggcagggcttttggggaaagacaagagactgacttggcaaagctcaggggatatttttagggtaaaacaaactgtgtgccattgtgatatgcctaatttcttattatatttgttcagagttaatagtgtacgtttcaaccaactcggtgattttatattttctatttgctgatagagacatgttcatttttgtcaatcactttgctaaatgtggctgagaggctgttgaaatgaacgctgagcaaatgtattcaccaaatctacaagagcaaattatttgccaattgctgattgagtggggtctataatgtatttgagattgggtgtggggatgttattgtgtgagatcatgatgtttagaccatgacactctctggtgagggatcactcattcattgcacatttaatgaaaggcaggtaggaggagcagaaggggatgagtcacactcctgaccacagccacaggttattgaaggcagaactgatgtaatcccctaaggtagaccactgcccctccaaggtgaccttatcctagagttgacacacatcctgggacaccagagacaactccttctctcccctttctctgcacttcagctggaagcaactgtctcaccgagcaccttgtgttaaggaatgagagttcctgttccaggtgtgagggcccaggtgcatccacttgatccagcacaagagcaagaacagccttccagaaaatgacatcgcctgaggtataaccagctctcacctgctgcagcttcctctgaataaaaaggaaactgttgaaacttcctcataagtgtcctgctgtgccattccctttgtccccacatgttcagttgtgtctgtccagatgtcacttttgtgtagggagattagggttctgcttccagtaccagaacacacatgacctcttaggggacttcagggttttgctgacatatgtgatgatcttaaaagtcattagctccatttctacatcaaaaaacatctgaaccaaaggagcacataggctcaggcctgtaatcccagcactttgggaagccaaggcagaggaatcacttgaggtcaggaatttgagaccagcctggtgaacatggtgaaaccccgtctctactaaaaaatatatacaaaaattagccaggcgtggtggcactagcctgtaatcccagctacttgaaaggctgaggcaggagaattgcttgaacccaggaggtggagattgaagtgagctgagatcgcaccacttcactccagcctgggcgacagagtgagcctccatctaaaaaaaaaaaaaatttatatatatatatatatatatatatatataataaatatatattatatatcatatatatattttatataatatatatgtatatttttatatattatacatacatatcaatatatgatatataatatgtatatataatatataatatgtatattcatatattatataatatgtatattgatatatattacacatatatattttgatatatatatatctccaaaccatctaaatatcaagtattttttaatccatctaagagctgaaattgctgaaaaaactactccctccaaaagctgtagagacaggcacatccacagtcacagcagagacttgctgacttggaagagaagctcctggagacacattggtgagaacatttacctggtgattatgctgaatgtctggaggacaaatgtggactagggggagggtgagcactcctagaggctgtacaccccacacttgtgtggacttgccctccagggccttcaggttctcgtggaagcaattaaaatagattccctatagccatgaactggggaggagtaatcacggagaaaagatgcacaaaaagacttttctagaaagctcatccaagggaaggtattctccaaaatcttagtttatgtgggggaaggaaatacttccaaattacagacccctcctcctcagccttcctctatcacgcaaatgataaaattagccaagaggagtcagattcaaggcggtagccctgggtgcagcatctgcagaagggaggaaagagagaaaatcagctgtatcactggagattccttgtgaaggtcactgctcaggagaagagggcaaccaaaccagggagagtcaactgtaagaacataccatgctcccctgccccacacattacctcctcaacagcatcattaatatggattaaagagggcagtgtgattgctttagatctgtttgagaaagaaagtcacatactgaggcctagggtcagggtcggcggcacttcccgtgagtaagatactacgaagaaggaaaaattaggggtccataactgtgaaaatcagccacagtgtgtgtgagaatgtttgtgtttgtgtttctgtgtgtttgagtaggagttattggaacagcggacgtggagtgagctttaatccacatccatctgcagcttcaggtattctcagatgcagtattcatctgcaagagccgaaatgagaaaagagccacctccaacccccccagagttttagcctccctttgtttccagtgatccagtgcatctagacctccaggaagtggactccctggtgattttagcgattcttctcttggagccaccctgaagaggacattgggtttccaaaggcccattcactatttcaagaagtggtgccatcagctcatgttgtcactgaaggagcattctgagccagggcacagtcacttcctagtgagctacagaggctgagagaaaaatgctctgtgagacccaatgggaagctccctgcagtgcaaggtctgggtggcagggagcgctagggcctcgcccagcacaggctgcagccctggagcaggtgcaagggaggctggggaggggttcctcccagggtctgatgtcttccttttctcggacaaacatgctttaataagttaaacaagactttagtaaagactattgatgtgtctttgtgtctttcagtatacagttctatttgtaggatttatctaacctaacaagtcaatgagaatcacatgtaaaaggagaaatttctaggattttcagatatcttaataggtaggagatggagaaaagggatggttttattaattcagtgcttgccaatcttaacagagacagtagtaagacatgcagaaagcaaagcccagaaaagtatgaaggtgtcaaagtgccatttaagtatgggttcacttggaggaccatgttctgcgggaacttgttttcagcagacaatctattttagcagagttctgggcatacaaggggacacacatcattaaacaaggattgggacagggacttcagcgtcccactgttgcatggcccataaattatgtgtgttctctttctcatcttggatcaagtctagagctatgaaatagtatccctcatgaatatgcaaataacctgagatttactgaagtaaatacagatctgtcctgtgccctgagagcatcacccagcaaccacatctgtcctctagagaatcccctgagagctccgttcctcaccatggactggacctggaggatcctcttcttggtggcagcagccacaggtaagaggctccctagtcccagtgatgagaaagagattgagtccagtccagggagatctcatccacttctgtgttctctccacaggagcccactcccaggtgcagctggtgcagtctggggctgaggtgaagaagcctggggcctcagtgaaggtctcctgcaaggcttctggatacaccttcaccggctactatatgcactgggtgcgacaggcccctggacaagggcttgagtggatgggatggatcaaccctaacagtggtggcacaaactatgcacagaagtttcagggcagggtcaccatgaccagggacacgtccatcagcacagcctacatggagctgagcaggctgagatctgacgacacggccgtgtattactgtgcgagagacacagtgtgaaaacccacatcctgagggtgtcagaaacccaagggaggaggcagctgtgctggggctgagaaatgaaagggattattatttttaatgttgtttacagtatgtcattaataaattgaaaaaaagtaacaatagaagtatatactctaattatatgggaactttgttttttcagttttttcatttttttttttttttttggtttgtttgtgacagagtctcactctgccacccaggctggagtgtaacggcacaatctcagctcactacaacctccacctcccaggttcaagcaattctcctgcctcggcctccagagtagttgggattacaggcacccgccaccatgcccggtgaatttttgtatttttagtagagacggggtttcaccatgttagctaggctggtctcaaactgctgatctcaggtgatctaccctcctcagcctcccaaagtcctgggattacaggcgtgagccactgcgcctggcccaattatatgggaattgtttatataattatcaccctataagcaaaattcatggaggaggaaaagctctactgaagaaagctgataccggcattcccatgaaagtatctgtgtagaagtaagtattaaaatcagttgaataggcaaggcatggtggctcacgcctataatcccagcactttgggagaccgaggcaggtggatcacaaggtaaggagttcaagatcagcctgcccaagatggtgaaaccccttctctactaaaaatacaaagaattagctgggcgtggtggtgggtgcctgtaatcgcagctattcgggaggctgaggcagagaattgcttgaacctgggaggtgaaggttgcagtgagccgagatcacgccactgcactccagcctgggcgacagagtgaaactccatctcaaaacaaaacaaaacaaaacaaaacaaaaaaacagttgaataaagtaccttagagtcatctgttcaattaacatgtttaactccaaagaaatactgaaaatattttccaaaaaggaagtgccattttacgttcctaccaacagtgaataagattttcttttctggagccttgtcagtattcactaatgctttgctgtgcagccgttgtaatattatagtaaatgagtagcagtatttaatggttgttttaaatatacatattcttaatacaaagtcttgatgaacacttttttatacattgttttatgaggtgtgtgttcagatctatgtatgccagaaatgcctggcagcgttaatttaagcacactgtgagaatgaccctatagtttatgaagaatgtatgttcagagctctgagctaagaaatccaggagctgtcaacccagaagtttattccttgtctgtgaaggacatctgaatccctggcctatcccttggaacacaggatgtccaggtgattgatgctctttgttaaatctggaggttgctaggtagagggtgctaagtgaaaatcataatataaactacacgtgttttacaaatggtagtggttttcctgtccaacacacttttcctgggccacattgtatgcaagtcctcaatacaccctaggtcttgttcatgggctccaggtctcctcttcagccttttggacatggtgccatgcctattacagtcaataggggtctagcatgacaactggtaggcccagaacaaggtcaaagaaaatcctgcaagctcttagacaacagtgtcaaggaaggggagacctgtggggaaatcccaggcaggccatgcacatctctgtgggcccaacagctgcaatccttgatggatggggcccgctgcatgtgtacggggatgcctccaaaatgccaaaagttctggaggacctgttgcctgaggtggatgtgacaatgtgacaaagtgacagtcagattcctgagctgtggcagctgttggccactcctgactgcactctgagcaaccactgaggcagagctcattgcacaggctagggtgtgtcagccacgagaacagttgtaactataatgagatgccgcctgtagggataggatagcaaattggagaccattgtttatttggtaggccatttaaagtgttgctgactgccacaccaatgcattaggactactatgactacgtcatcctgggagcctaagtcctggcgtccgatgtagagctccagtgggaaggagatgaaggttaggatgagtccataaaggttcttgctctgcagcccctgctttgctgtctcacttggtgaacagagaatgggaggtcaatgcggacaaagtccagggtccaggcttatcagtcaaatacttggtgtcatctggttacataagactatagttattccatatttcatcatagataagataagatgcaggtctactcatgtcccaccacaccaaagcagttggaaacctcccaaggcctcctgggacattggcgatcctttattccccatttcggcaaaccccttgggcccccatggcacttagacaagaaggtgccccactgcgactgttccaaaagggaggatgagggctctgaagaagctgaagtcacagtgaaatgaatacaaaccttgggagttctagtgcagggacagccctgtgaattggatgtagtcagttaccctgaggggtttaggtggggactgtgttaaaggcaaggacataagtgtgtgtccctaagaccctggtctcaaagacagaaggaagctgaagtgagatatactgtttaggagtagcaactgcactacatgtcatgccttacgagtgtaggatgtgacaaagagggccactccacatccggaacaacctttagcaggctggctaaaggatgccttccagacacaaaagccttggaatgccaggacacagtctgtagccaaatggtacttgtggtggtcaccaccaacataaaagtgggccaactgtgccagcagaagttagccccacagaactttcccccacctaagagaaggcagtgcaccacaatgcggaattccaccactgtggaattgggggagcttagaattggattcagacacaaggggagagagtggatcacagggtggcttctctatgggatagggggtggagagtattatactctctggactcaagatgagtaaaatgacacccatcacaaaccatccagccctatgatggcacctttatggtaagtggttgcaggctccaagggggccgggtccaatgaggaagatgcccccacagctcgttctcaatggcagactatagaagagttgcaggatatcttctgggagtcgagatgaggcatgctaattatgctgagaattattgaagtcccaacaatgaattgtttactgcaaaataaaagctacagttatgtattcagtgcctacccaatggcatggtgcactgatttccacgttaagccccctgggagggcagccaacatttcatgtgccccaggtagttgctgacttaggagaaaagaagaaactgagtaagcaagggatgcaccctactgtgatgaagaacaatggcaccaaaggaagagagacagccaaggagccagtcagggtggccagacaacgaatgtgctctaactggcaacacctaccagttctctgggcccatagcggcaataggtggttatggaagggccacggaagtcagaccggttgaactagtgatacgacctgggggactgccacccagaccctgtgtagtatacacagcttccatcctagaacacatgagaatggatatcttcttaggcgtgaccctccaaacaacggccagggaattccaacggagagttagagtggtgatatgtgtgaccaagcagaaggcaaactggatgccagtagagctgccaacccatggggagtcccacagctggagcaacaccacccgccctgggaggggaagatgatccaatcatgaagattgttaaggagctagcccaggtaggcattaggaggccactgcatggttcctacaacagacctgcatggcccatgcagaggccagttgagacatggagaatgacagtagattactgggagttaaataaggtggtctcccgagtgaatgcagctgttcctaatatctcctccagtctgacgagaataggagaggtgttagccacgtagcatttccttatcagtttagtcaataccttcttcagcatttctgttgccccagagtcaagatcaatttgcattaacctaaaaagaacaatggacttttactgtcttgttccagggatatttacacagcccaaatctcacagcctagtgacctccaacctcagtcgatgggctgacccaaaggggatacatgttttccactacattggtgttatcatgataacctctgagtcttttttcagcttataaattacagcccctgtcttgctgtctcacttgctgaatagaggatgggaggttaatacagacaaaatccagggtccaggcttatcagtcaaatagttggtgtcatctggttgggtaaaactaaagtcattccatctgccatcatagataaggtgcaggcctacccacgtcccaccacaacaaagcagctgcaaactctcaaggccttctggagcatcagtgtccttttattccttttatttgacatccctgaaggaggctgctaggggagactgtgtccctcctaaattcatgtgctgaagtcccaacccttggtccttcagaatgaaatcatacttggattagtgtcctttaaagaggtgaataagttaaagtgagattcctggagtggggccctaatgcaatctgactgttgttataagaagaggaagcaggagggagggtgcacaggccccgagggacggccatgttaccacagaacagtgagaaggcgccatctgcatgccagggagcgagacctcagaggaaacccacccagctggcagcttgatcttaggctttcatcctccataagtgtgaggaaattggttttgtattgtaagccatccgatctgtggtatttcgttataaaagccctataaaatgaatacagtaggtaataggagagcttctatacattgaaaaagtcggatggccagaaaaacctagacactcctgttcagacctgagcagggtgatggacctgctttgggacaggagaggggaagagatgaacccagcacccagacccagctgagcccattcctcagcaggccgtccctgggccggagcttgcacaggtgtgaaagagcctgtcttggtcttcaggggctcatggagttggacggagaatggtgtagactcaagaacacgtcatcggtgtgcccgtgtttatctgaatgggatgtgtttctagggtgtgctcatccccaaagaagaattaatcaggtctcttgggctaaaaagaggttgtggcatttgtgtgtattaataactgtggtcggacagtaaattatgttaaactgcttatgggaaggcacaatggaaagaaacactttgttacagaaggaaaaaaaaggtgattatttaaatgaggtgcctttgaaggtcaccatgccaagaggagcccatcacatgatagtgctggctttcatgttcaggagatcaggagggtccgtccgctggcttttatgacaccctagacagagctgagagtgtaatgtatgaatggaggggaagtggagagaggggaggccaaatgtttggtgggaatggagggtcactattggagccattaggaaatacacaagcatgaattatgctggaggacagaacagtgttcctggggaatattgtgttgctttgggagctgctgaacatacaggagtttcactgttcctagttctcaaattctctagactctctggacaacccagttttaaatattgggaatataggtaagacacattcgttattaaaaattattaagagaagatgtaggaagaaatttaaagtaatccatttggttatgaaaatttagttacagcgaactgtgatgtccgtttcttacttggaataatggaatgtaagtcattagtcatctcaacggttcatttttccataaccatcaattacaaaactgctgagtaatttcctgaattgcccaccatagaaactgacctcacatttcctcaatgagaaactgccagtcccgttgatccagcctcgttcttcccatcagggattttgtatctctgtggacgtgtggcacagtgctgcatatccatcggcatatggcctcaggaaaggcgccagcctatccatgcatgatgaagcttacttaggggatgaagcccgcatgctgggtgagccagtgccaacagctgaaagaatcaactgcctggtgtatgatgcttttatgaaaacaagcccagggcctcttgcattcttctgtattagattctctggtgaagatttttattcatttctgcctgaaattgccacatataattacctggaagcattacaataaactgatttggaagttaactgacttcctggtgaggttaaaatgagtgtcaggtgcatagtgagacagaccggagacatggatgcatagcaaacttgtgctcaccatggtttctatcttagttagggaaacttctgtaccttccttagatgttcaggcactccattgaggaccctggcataacattatttattgacagaccatagctcaaagtatagaactggatactaccaaggaggatatactattactattttatctttatcttaaaatatactcttccatctgaggtgaaaattaatccagatggtagaacttattgcagttactacagcattttagcaaatcaaaagccgcagaacaaacatatggacagatggcaggtatgttttcggaatcgtaaacaagttcgtgatgactgtaaaaccaaggggtgtctcacgagggctggaaacctctcacaatgaaacaacacaatgaggatctttgaaaagtactctgacctcctggtgagctggctgatatggaggctgagctccatgtagaaagccaaaggaatttctgcaggacgtcatcatgccaagcacagccgtaacctgggtcccagcccttttcacacgctcaatggttagatcttgggagggaatcaaagaagccatagtaaaatatcaaaatttaaaccccgattttgaatttaaaaagtgttaaaatatggttgtggcctacactcagaaaatctgtgtccttcagatggtttctcagtggcaccagatggtttcaagtggctattcattaagtttctcagtgaaattaccagacatagaataaataaattgtcactgtcttaaatcaacccatgggaaaggaaaactgtgtaaatacagcagagaggaaacattgctcaagggaaaaacaatctccagaaagtattgttaaagaaacagaggccctctttccagccagcgccgagcgatgggcacctctcgggacaactggcacaagggccgcaaagctgggggcaagagaaggccctgccacaagaagcggaagtatgagttggggcgcccagctgccaacagcaagactgacccgtgccgcatccacacagtccgtgtgcgaggaggtaacaagaaatactgtgccccgaggctggacgtggggaatttctcctggggctcagaatgctgcgctggtgaaacaagggtcatcgatgttgtctacaatgcatccaataacgagctggttcgtaccaagaccgtggtgaagaattgcatcgtgcccatcgacagcacgccctaccgacagtggtacgagtcccactgtgcactgcccctgggccgcaagaagggagccaagctgactcctgaggaagaagagattttaaacaaaaaacgatctaaaaaaattcagaagaaatatgatgaaaggaagaagaatgccaaaatgagcagtctcctgggggagcagttccagcagggcaagcttcttgcgtgcatggcttcaaggccgggacagtgtggccgagcagatggctatgtgctagagggcaaagagttggagttctatcttaggaaaatcaaggcccagaaaggcaaataaatccttgttttgtcttcacccatgtaataaaggtgtttattgttttgttcccaaaaaaaaaaaagaaagaaaaagaaacagaggcatcacacttactagaaaaacatattctatttcatatattatggggatatgacgtgatgttttgacatatgcgggcattgtgaaattattaaatcaagtaaataaacatgtccatcacctcacatacttattttttatggtgtaaacgtgtaaaatctactctcttatcagttttcaagtatatagtacattagtatcatggaagtcaccatgctgtgcaatagatcttcaaacgaattccttctatctaaccaaaactctgtaccctttcaccaacgtctcagctttcacatgcccctgacgccagcccctggtaggcaccattctactctctactctgagttcaacatttttagattgcatgtgtaagtgagatcatggagtaattttttatacctggcttatttcactcaacataaagagtcaaatgctcaacatcactaatcatcagggaaatgcaaattaaaaccacgataagatatcacctcacacatgttacaatggcttagtctcagtctgtctttttgttactataaccgaataccagagactgggcaatttctaaagaaaaggaatttatgctttatggtgcttgagtcagagaagtctaatatcaaggcactggcatctcacaagggccttctcactgcctcatctcacagcagaggtgggtgagcaagagaccatttgtccacgagagaaaagagaccatcttttattagaaattcactcctataataactaacccactccattgatagtgacagtaatccattcatgaggacagagccttcatgacttgatcacataataaaggtcccacctctcaacactgttgcattaaagattatttccagatcctaaactttgggagacacatttaaaccatagcattccattcctaatatcaaaatttatgtccttatcacaatgcaaattacattcattccatcccaattgtctccaaagtcttatccagcatcagtgcaaaagtctgaagtccaaagtctcatctaaatcagatatgagtgtgactcgaggcacaatttagcctgatataaattgtttccatctgcgagcctataaagtcaaaacaagttatctactttcaaatacagtgaacaatggggcaggtatgggatagaaattcccattccaaagctcagagagaggcaaggagaaagcggtgcctagttcaaaacccaacagggaaaaaaacattaagtcttatagctggaaaatcatcctctttaacggcatcttgtgcacactggggagggggatgggcccccaaggcctccggcagtcttgcctctatatattttctgggttcagtccactcagccgctctcacaggtgggactctcaggcctctagctctcctaggctgactggaaactctttgtggtacctccaaacccacatttctgcttggcattgtgctaagggcccagtgtggtgactctgtctctgcaacaagtcactgcccgagaccttaggctgtccttaggctgcccgagaccttaggccgtccacagcattctttgaaatctaggtggagaaagccatgccctcgtggttcttgtattctgcacacctgcagaattaacaacacatggatgccatggaagttgatgacttgtaccattaaagtgatggcttgagccacacctaggtcctcctgagccacagcatgggcagccaaggagtgctgtgcctggacaccgggaacagagtcctaaagtgcctgctagaagtcaggccatagatttccttcaaatttctcccaccatataacctcgttcatggctctgaacttccaccttacagaaggacctagggatgaacacaattcagccacgttctttgccactttatggcaaggatggcctttgctccattttccgatgagctattcttctttttctcctgagacctcatcagaacggcctttattgtccacggttctactgacattctaatggtcatcacctaaataatctctaagaagtttcagaatttcctcacagctctcttcttctgagtcctcaaaagaatcacctctagtgttctattcagggcaatccagactttttatagtctgatcctccaaattattccagtctttgtgcattactacatccacttctacattttggggtatttgttatcgcaacagccccacctcttgatactgatttttcgtcttagtccactttgtggtgcaatgagtgaataccacacactggctaaagtataaggaaaagaaatttattttctcgcagctctagaggctgggaagtcaatatcaaggtgttagcatctggcaagagccttcttgctgtgatgtccatgtggaaggcaggagagcaggtgcgaaggatggaaaggggtttaaactcattttttaatgaggaacccaggcctgtagtaactaatctgctaccacaatgagtaacctactctgacgataatggcattcattgcttcatgagggcagagccctcatgacctaatcatttcttaacattcccacctctggacactatggaatttgggattaagtttccaatacacatcctttctaaacagcaggggctttttaataggttgaccacccaaggctgcaggaggctctgaagcagtggcctgaggttggctgtcctttgtgagaatggagagaagtgaactgactcatggagacacaagtagatgaggtaaaggcattcattgcttcattacatggatggtgaggtcgattgaaggcattaacggattaaagatggtggcaaaaccgtctgaggtggagaccacggggagtccatcagaaatggaggacacgtcccaataaatggtgcttcatttccctgcaaagcagaagaaagcaaagaacaaaacacaacatcatagtgtacactgagcagtggattgagagaagagtttcctaaggcataactgacagagtggagaagacacacaaatctttgcatgatgctaacatttggactgtggcttcattatttcttattaatattttactgaaatatcgctagaaggagactgaaaatgaagtgtgaaaagttaaatgggatttctgctctatgtccttttcagatgagaggaactagggaattccagggaagaaacaataatagctgctgagcaaggcttttgcagggcaggacaaggaatccccaaagagaaaacggaaacctcagcttcactttgcatctgctcctgagccaggtcctgagcgacccctgtaggtcctgagtgcccctccgtaggttctgagcatcccttggttgctgggcgccctctggtggtgtctgagcccctctggtggtttctgagccccccgccttatgtctgatcctccctggtggtgtccgagtgcccctgctagtgtctgagccccctggtggtgtctgagtccccttcttagtgtctgagccaccctattagtgtctgaggacccctgatggtgtctgagcccccagttagtgtctgagccaccctattagtgtctgagcccccctggtggtgtctgagcacaggagagctcctctgaaggaagggtctacatggggacaggcgtgcttgtctcagggaagggtccatgtggggacaggtgtgcttgtctgaaggaaggttccacatggagacaggtgtgcttgtctcagggaagggtccacatggggacaggtgagcctgtctgaggggacagaagtgcttgtctcaaggaagggtcctcatgtggacaggtgagctcttttgagggaagggttgacctggggacaggcatgcttgtctgaggtaagggtcctcctggggacaggtgtgcttctctcagggaagggtccacgtggggacagaggtgcttgtctaaggcaagaatccaagtagggacaggtgagctcgtctcagggaagggtccaggtggggacagttgtgctcatctgagagaagcgttgaagtggggacaggtgtgcttgtctcaaggaagggtccatgtggggacaggtgtgctagtatcaagaaagggtccacatagggacaggtgtgcttctctcagggaagggtgcatgtggggacaggtgtgcacatcggagagaatggtccacctggggacaggtgttcttgcctcagggaagagtccaccttctcagggaagaagtgtgctcctctgagggaagggtgcacatggggacaggtgtgcttgtctcagggaagggtccatgtgggaacaggtgagctcatctgagggaagagtccacgtggggacaggtgagctcatctgagggaagggtccacatggggacaagtgacctcgtctgagggaagggtccacgtggggacaggtgagctcgtctgaaggaagggtccacttggggaccggtgtgctcctctgagggaagggtccacgtggggacaggtgtgctcctctggagggaagggtccacgtggggacaggtgagttcatctgaaggaagggtccacatggggacagttatgctcctctgagggaagggtccatgtggggacaggtgtgcttgtctcagggaaaggtccacgtggggacaggtgtgctcaccttggggaagaggacagatgagctcatctcagggaaggggccatgtggggacaggaccaagggttgggacttcagcacaagaatttaggaggaacacagtcttccctagcagcctccttcagggatgtcaaatattttccttctgttccctgtgaaagccttaaaggggtagggaaagggcgttcaacctgcacactcgtagaggggaaaccagcttcattagtaatcgttcatctgtggtaaaaaggcaggatttgaagcgatggaagatgggagtacggggcgttggaagacaaagtgccacacagcgcagccttcgaaacacaccacggtcacgttaagtttaaatggagtgaccacattcgccaggaaagggaaatatttacacttttgaagaaacagtaatttgtgtttctgattatgatctggccttggattttccctcccctcataagcaatgacagaattggcagaaatatgtgaaacgttagttctcagacatgagacacccacagagggccccctgtgcccttccctgagagctgatcagctcctgcatctgaagaaatgaccaaagaccaggagagaaccacacagaagcatcggagggacagcacctggggctctgatggggtcaggaatagcatctgttcccaatagatggactaagtaaaaagtatcataattcacaagagttttacatagcacagaagaaaaagttaccctatatcaactgttgatcttgtgaatccaggaactctggattcaaggtggtcgggcacatcttgatttacgcatttcagggacacatgagacatcagtcaatataagtaagaaggacattagttccatccagaaaggctgagacaactcaaagcaagtcctccccacttagggcttccaggtcacaggtaggtgagagacagatggttgcattcttttgagtttctgataagtgtttgcaaaggaggccatgaggatatgcacctgtctctgtgagcagagggacaactttaaatagactgggaggcagatttgtcctgagtggtttccagcttgacggggcccaagatattttcctttcacaatctggtaacttcaaacaaaacttcaaagccacaacaaaacaacacaacaacaaaaagaataagacatgggtacttattaagagtagaaaaacattcagtccccaaggaaaatattggcagtgtctacctccacatgacaaaggagtaagcagtgtgagccacagaaaggagcactattaacccacagagcaaccgagaataacacgggtgatgcgagggcattggacgcacatcattgcattttgtagattcagaaagaaacggaaaagattgacggtggtaaaagagacagccctgcttccctctcccttttccctccccgatgaggcctcacagccatgaccctcagcctcatcccgcagtgcagcagctgccgtcctgtccaggcccaccccctgccccgccctgggactgttacctcattccctcccggagtccaggtgccccccggggtgtggtgcgggagcctggggaggccctttgttctctgtcagggtctccctgggagggacgcagccaccgcagctggttggggcctggcttcgcccaggacagtcctttcctttcccattgtctttggatgactatcgctgggctgggacatgaggcgggcagaggcgcgggtcacccttaggacccccctcttgctgctggggctctgggcgctcctggctccggtccggtgttctcaaggccgtcccttgtggcactatgcctcctccgaggtggtgattcccaggaaggagacacaccatagcaaaggccttcagtttcccggctggctgtcctacagcctgtgttttggggtcaaagacacgtcattcacatgcggaggaaacaccttctttggcctagacatctgctggtgacaactcaggatgaccaaggagtcttgcagatgggtgacccctacatccctccagactgctagtacctcggctacctggaggaggtgcctctgtccatggtcaccgtcgacacgtgctatggggacctcagaggcatcatgaggctggacgaccttgcgtacgaaatcaaacccctccaggattcccgcaggtttgaacatgttgtttttcagatagtggccgagcccaacgcaacagggcccacatttagagatgatgacaatgagacagaccccctgttctctgaagcaaatgacagcatgaatcccaggatatctaattcgctgtatagttctcatagaggcaatataaaaggccacgttcaatgttccaattcatattatcgcatatatggcaatattacaacttgttccaaagaggtggtccagatgttcagtctcattgacagcattgctcaaaatattgatctgcggtactatatttatcttttgaccatatataataatcgtgacccagcccctgtgaatgaatatcgaattcagagtgcaatgtttacctattttaaaacaactttttttgatacttttcatgttcattcatccacactacttattaaatacgtgccacatgaatctaactatgaacctgaaaggtataacttctgttcccgtatagccctgttacacattggtactccaggcagacattatttattggtagccgtcataataacccagacacagatgagaagtattggtctggagtatgatgataactactgcacatgtcagagaagggcctcctgcattatgcagcgatttcctgggatgacagatgcgttcagtaactgttcttatggacatgcacaaaattgttttatacattcaggccggtgtgtttttgaaacacttgctcctgtgtataacgaaaccatgacaacggttcgctgtggaaacctcatagtggaggggagggaggaatgtgactgtggctccttcaagcagtgttatgccagttattgctgccaaagtgactgtcacttaacaccggggagcatctgccatataggagagtgctgtacaaactgcagcttctccccaccagggactctctgcagacctatccaaaatatatgtgaccttccagagtactgtcacgggaccaccgtgacatgtcccgcaaacgtttatatgcaagatggaaccccgtgcactgaagaaggctactgctatcgtgggaactgcactgatcgcaatgtgctctgcaaggcgatctttggtgtcagtgctgaggatgctcccgaggtctgctatgacataaatcttgaaagctaccgatttggacattgtattagacaacaaacatatctcagctaccaggcttgtgcaggaatagataagttttgtggaagactgcagtgtaccaatgtgacccatcttccccggctgcaggaacgtgtttcattccatcactcagtgagaggagggtttcagtgttttggactggatgaacaccatgcaacagacacgactgatgttgggcgtgtgatagatggcactccttgtgttcatggaaacttctgtaataacacccagtgcaatgtgactatcacttcactgggctacaactgccaccctcagaagtgcggtcatagaggagtctgcaacaacagaaggaactgccattgccatataggctgggatcctccactgtgcctaagaagaggtgctggtgggagtgtcaacagcgggccacctccaaaaagaacacgttccgtcaaacaaagccagcaatcagtgatgtatctgagagtggtctttggtcgtatttacgccttcataattgcactgctctttgggacagccaaaaatgtgcgaactatcaggaccaccaccgttaaggaagggacagttactaaccctgaataacactaattcagcctcccgatccctgtaaagatacagagaatataacagcaaaatctatgaaacaggatcaggggaagggatggcaaagctcaagtccacatttcttgaagtccacaggaagcacagggtcctgtttcacatcacagggaaacgggaggcattggcttctgtcccaggttcttgtaggtcgctgatgctcactctgaaataaatcttcaaaaacacacattggtgccttccacattttcttagactcctctgggagcccaaacttggccagaacctcttgcctggagagacatgaatgagcatctggctcttgtcctgaggtctctggtcccagaattaacggaagttgccaccagctccttacagggaacattcatgacatttctccagaagagagctccagagcaatgagcttcctcattccccaggtaatctgtccttctctaaacccgaagtcagtttagggtgatccagggctactccctgttccctgtctgttcctcacgggggtgctgtgggctttgcagtgagagggacttgggttcaaatcccccaccaagcaaatccccctacctggggccgagcttcccgtatgtgggaaaatgaatccctgaggtcgattgctgcatgcaatgaaattcaactagaaaaataggtagacgtgaggggcaagctgtctgtcatttagtgtgagctctgtgagtggcagctgccccctttcttcctgcccccacatttccttgaactgaaacaggaagggaagctgagtaagtcgtgatgaggaagagaaaccaggcttgtagcagcacaggctggtccgggtggaaaacagggctaggtgtatcactgagttattgtaaaggaaaatggaagttaaatgtataaataactgaatgagataacattttattttaacttaaaattcacactaatattgacttttaaaatgcagtgtagatatgtcagagagaatttcaaaggcaaagcccaccgacggaagaaatcacccttcccataccatccacagaaaactgttggtattctagggtagtactgagatctagcatttttctgaatacatctgtggttctagatgtcctgcttccatagatattgtttagaattcccacccctttctccaaacacagcttgatatcctttctctgaacctgttagaaatttcctccattcagctgtcataaagatgcgagcaatccattcctgtgcctctgtcagtgtgttctattattttgtggctgaacgctaatggacagttaagtgtgaggtcagtgaatacagtgccctccctctatgtgtccttcgggtgtgaggggttttgctgatagagcagcaggccccatcccaccctttatgcatctccgccccccacctcacgctccagctgacctctcccctgtggcctggggcgttccccagggggaatgacctctcctctctccagggcccacccactcagtgcccgtgcaagaccaccacgcttggcacggccccacctcgtgtcagggcctgtgtcccctgccccaccccctaaacagatgggaaccactgggactctgctcagggcagggggcggaggtatgtgtgaaaggaaggcaaatgtgcactctgttggagaaatattataggtagtttgagcaaaaaatctaatgccatgggaacttttagaatgatacgtattttaacaaagaacatgaccaatagagtttgtattgaagccaggaaaacactatttagagcaacagcaatatcaaaaacacaagccaacagttcaccaagaaaaaccaccattaaccccatggaaatggtcttccaagagcatcggcacttaaatcctggaaatctgcctgcctcagcacctgttgtcctgacctgccctcctgtgtgtcctaatcactcccaaacacggggcctgcactgtgggagattcacactgtgccaggtggagggagcaggacaactgctaacaggttgttggtgtggatgccgaggccacccaagcaggtgtaaactcccacctgtggggcagggaagagtgcacgggagacatgtcccgggcatagggtgagggagagctgtgggggctctgggttctgaagtgggttctgaagagggttctggcctggcagggataagaccaaccagcatgtgaggccaggctggagtctggacctctgaagctgcaagggtcatgggctgcttggccccaggggctgtcctggttctctatggagtactttcaaacattctttcttcttccaatccccctccttctctcccaaagcctgcatctcccaaatcctctttgtcggatcctcggcttcactctgcatccgtcctgagcatcgatcttccaattccatcctcttctcttctgctatgtctaagctgctgtgaagccacctgctgtaatttactgctttatatttaatattgtaccgtacatctgttctgtttccctcatcataaatgcttcatttcatgctcagcatctgagaacacaaggccttgtcagctgtcacctccttccgttctctgtttccttcctcctatccccatattgctcatcatgtccagtctcctgccatcctgaatgcttctgatggaaggtctgagatgtctcatgagcactgtgaagattctttgtaatgtgagcttgttccaggcaggaattctccttcacccagccctggaagccaagtataggcagatggccatgctcaatcaaagactgagctaacttaacagtggctttggttttaaggtttctccaatccccagggcacaggatttcagggaattcaggtgagagtctgggtgttacccttcaggaggctgtaaactccatttcacctagtctacaccacagactatggaaactatatatatatatagttctgtccctctagagaaacctaatatgtatatatacaatatataatacgtattatatattatatataatacgtattatatattatatatattatatatatattagagtttattgaggagtattaaactcacaatcacaaggtcccacagtaggccatctgcaagctgaggagcaaggaagccagtccgagtcccaaagctgaagaatttgaagtctgatgttcgacggcaggaagcatccagcacaggagaaagatgtaggctgggaggctaagccagtctagtcttttcacgtttttctgcctgctttatatcctggccacactggcagctgattagatggtgcccacctagattaagggtgggtctgcctttcccagtttactggctcaaatgttaatctcctttggcaacaccctcacagacacacccaggatcaatactttgcatgcttcaatccaatcaagttgacactcagtatcaaccatcacaagtccaccccttgtcaacttgaacccatacaaatctcctgagatcatacataatcttcaaataaagacaataataaggtcataattacacctaatgtaatacaactatcttttgtacaaccagaaatgcaccaatccccaacccaaatgctattatgtaaagttaagaacacttaaatgctgatatgaagtcaataaattttatgtcacatgataaaggaaaaaagaaatgaaggaattttcttagtacaagtgtgtacatgcacaaacatgtttttaacaaaagaagaaggaaatactgatgacaattacagtcctcatttctgcaactgatcacgtggttgtagctggtattgatgactaccttcttctactacccattctgtattccctttgccttcagcaagcatcacagcaggtagagttttttctcctagtggagtgatgcaaaccttcattcctgaagggtctgggccatttgtagtcctgcctggattgggctgttgtagtttcccgttgaccttaatgacagggcatggtaatgttaagagacgccctaatggatctcctgtattccatacatattcttccttacctccattgtggagtaatagactgattgcatcttgatagtccaggtcaatcagcccagccaacactgtaactcccctcttagcctgtggacttaaaggtaggaggggcccaaagtggccaggtggaaatctttacttccagtttaatggaattgttgttgtttctcctgatggcagcattattcccactggaactaagacctctaggccaacagaatgtaatgtcatgggaccaggaagcaaaaattttgctagtggatcactaggggtgatggtgaatggtgccatttccacttccaccccttgattcctggatccatgaattatggctatgggagaaagagtaccatatattggatgctgatttggagcatacatggccttttggagagctttgccccagccctgcaaagtattggagcctagttgacattgtaattgtgactttgaaaggccattccattcttctatcaatccagctgcttcaggatgatggggaaaatggtaagacaagtgaatcccatgagcatgagcccactgccacacttctttagccgtaaagggagtgccttggtcagaggcaatgctatgtggaatactgtgacagtggataaggcattccatgactccacagatggtagtcttggcagaagcattgcatgcatatctgcagtaagtgtctatttcagtgaggacaaacctctgccctttccaggatggaagaggtccaatataatccaacctgccatcaggtagctcactgatcaccctgaggaatggtgtcatttgggtagagacccagagccaaaccagatcacgccacccaacccctcccaaatctcatgtcctctttgcatttcaaaaccaatcatgccttcccaacagtcccccaacatcttaactcatttcagtattaactcaaaagtccaaatccaaagtcacattggagacaaggcaagtccctttcatctatgaacctgtaaaatgaaaaacaagtcagttacttccaagacaaaatgggggtacaggcattagatacatgctcccatttcagttgggagaaatgagccagaataaaggggcttcaggtcacatgcaagcccaaactccagtggggcagtcattaaatcttaaagcttcaaaataatctcctttgactccattcctcacattcagggcatgcttatgcaaagtgggggctcctacaaccttgggaagctctcaccctgtggctttgcagctctgaccccatggctgctctcatgggctttgcagagttcagccctcctggctgctctcattgagtgcatgcagcttttccaggtgcacagtgcaagccgttaatggatctaccattctggggtctgaaagatggtggccctcttctcacagccccattagtcactgtctccagtggggactctgtgtgggggctccaaccccacatttcccttctgcactgccctagcagaggctctccatgaaggctttgcccctggcgcagacttctggctggacatccagtcatttctataaatcctctgagatctgggtggaggatcacaaagctgaactcttctcttccgcacatccctaggcccaacatcatgtagaagccaccaatgattggggctttctgaagcaatggcctgagctgtacattggacttttttagccacagctagacctggagcagctgggacacagggcaccaagtcccaaggctccaaagagaagctgggccctggacccagcccatgaaaacatttttccctgataggcctccaggcctgtgattggaagggctgctgcaaagatctccgacatgccctggaaacattttccccattgtcttgattattaatattcatctcttcattacttatgcaaatttctgcagccaacttgaatttctccctagcaaatgtgtttttctttactaccacatggccaggctgcaaattttccaaacttttatgctctgtttcccttttaaaaataagttcctatttcagatcatctctctcaagggcaaagttccacagatttctagggcagggacaaaattccatcaagcttggttttatacattttagagaggcatgagacatcaatcaaatacatttaagagacacattggtttggtccagaaaggtggaacaactcaaagctagggcttccaggctataggtgaatttaaatattttctggttgacaattggttgagtttgtctaaagacctgggatagatagaaaggtaatgttcaggttaagataaagattgtagagtccaaagttcttttgaagtcttatagtggctgcccttagagataataggtgacaaatgtttcctattcaaatcttagttgaactctttaggattgggaggttctagaagaaaaagatctagctatgttaatagagattctttacagatgcaaattttcccccacaaagaacagctttgcagggccctttctttctttctttctttctttctttctttctttctttctttctttctttctttctttcttttttagatggagttttgctcttgttgcccaggctagagtataatggcacgatcttgtctcaccacaacctccacctcctgggttcaagtaattctcctgcctcagtctcccgagtagctatgattacaggcatgcaccaccacacccggctaattctgtatttttagtagacacagggtttctccatgttggtgaggctggtctcgaactcccaacctcaggtgatccgcccacctcagcctcccaaagtgctgggattacaggcatgagccaccatgcccggcctgcagggccatctcagagtatggcaaagaaacatgttttggggtaaaatattttgattttcttatttgtctcataatgttatgccagagtcagtttggaaagtaaatcatgatatataggtttaaataaaacccatctgatgagaatttatgatttgtagagcatgcctccccagactctttagataggaatttgggcaagatgaaaaaaaaatcagagtttagtcctcactacctaagaccagctcagcttggacttcactgttcatgtcactatcagcattttagtcaaaaccactcaataagtctctaggaagttccaaactttcccacatcttcccttctcctttcaagttctccaaactgttccaaccgctgccaggaggtacccagttccaaagttgcttccagattttgagttatctttatagcagttccccactcctggtaccaatttactatattagtctgtttccacagtgctataaagaactgcccgaaagtggttaatttgtaaagaaaagaggtttaattgactcacagtgctgtgtggttagggtcggaggctcaggaaacttgcaatcatggtggaagtggaagcaggcatgtgacacatggcagcaggtgagagagagaaagagagagagagggaatgaaggaggaaccaccatacatggataaaaccatcagatctcatgagaactcactcactatcaggagaacatgaggacagcatgggggaaaccacccctatgacccagtcacctcccaccaggtccaccccttgacacataaggattactatttgagatgagatttgtttaatgacacagagccaaaccacatcagcatgtgacaaaggtctaatatcaagaatctatgagggggcagttccaaaatggctgaataggaacagctccagtctacagctcccagcatgagctacacagaagacaggtgatttctgcatttccaactgaggtactgggttcatctcacgggggcttgttggacagtgggggcaggacagtgggtgcagcccaccaagagtgagctgaagcagggcgaggcattgcctaacccaggaagtgcaaggggtcagggaattcccgttcctagccaagggaagcggtgatggacggcacctggaaaatccggtcactcccaccctaatactgcacttttccaacggtcttagcaaatggcacaccaggagattatatcctatgcctggcttggaggttcccatgcccacggaacctcgcttattgctagcacagcagtctgagatcaaactgcaaggtggcagtgaggctgggggaggggtgcccacaattgctgaggcttgagtaagtaaacaaagtggctgggaagctcaaactgggtggagtccactgcagctcaaggagacctgtctgcctctgtagactccacctctgggggcagggcatagctgaacaaaaggcagcagaaacctctgcagacttaaatgtccctgtctgacagctttgaagagagtagtgtttctcccacatggactttgagatctgagaatggacagactgcctcctcaagtgggtccctgacccccgagtagcctaactgggaggcaccctccagtaggggcagactgacaccttacacggctgggtgcccctctgagatgaagcttccagaggaattatcaggcagcaacatttgctgttcagcaatattcgctgttctgcagcctctgctgctgatacccaggaaaatagggtctgcagtagacctccagcaaactccaacagacctgcagctgagggtcctgactgtcagaaggaaaactaacaaacagaaaggacatccacatgaaaaccccatctgtacatcaccattatcaaagacaaaaggtagataaaaccacaaagatggggaaaaaacagggcagaaaagctgaaaattctaaaaatcaaagtgcctctccccctccaaaggaatgcagctcctcgccagcaatggaacaaagctggatggagaatgactttgatgagttgagagaaggtttcagatgatcaaacttctccgagctaaaggaggaagttggaacccattgcaaagaagctaaaaaccttgaaaaaagatcagatgagtagctaactagaataatcagtgtagagaagtccttaaatgacctgatggagctgaaaaccatggtatgagaactacgtgatgaatgcacaagcttcagtagccgattcgatcaactggaagaaagggtatcagtgattgaagatcaaatgaaagaaatgaagggagaagagaagtttagaggaaaaaaaagtaaaaagaaagaaacaaaccctccaagaaatatcagactatgtgaaaagaccaaatctatgtctgattggtgcacctgaaagtgacagggagaatggaaccaagttggaaaacaccctgcagtatattatccagcagaacttccccaacctagcaagacaggccaacattcaaattcaggaaatacagagaaccccacaaagatactcctcgagaagagcaactccaagacacataattgttagattcaccaaagttgaaatgaaggaaaaaatattaagggcagccagagagaaaggtcgggttaccctcaaagggaagcccatcagactaacagctgatctctcagcagaaactctacaagccagaagagagtgggggccaatattcaacattcttaaagaaaagaaatttcaacccagaatttcatatccatccaaactaagcttcataagtgaaggagaaataaaatcctttacagacaaacaaatgctgatagattttgtcatcaccaggcctgccctacaggagctcctgaaggaagcactaaacatggaaaggaacaactggtaccagccactgcaaaaacatgccaaatcataaagaccaccaaagcgaggaagaaactgcatcaactaacgagccaaataaccagctaacatcataatgacaggatcaaattcacacataacaatattaacctttaatgtaaatgggctaaatgctccaattaaaagacacagactggcaaattggataaagagtcaagacccatcagtgtgctgtattcaggagacccatctcacatgcagagacacacataggctcaaaataaaggcatggaggaagatctaccaagcaactggaaaacaaaaaaaggcaggagttgcaatcctagtctctgataaaagagactttaaaccaacaaagatcaaaagagacgaagaagaccattacataatggtaaagggatcaattcaacaagaagagctaactatcctaaatatatatgcatccaatacaggagcacccagattcataaagcaagtccttggagacctacaaagagacttagattcccacacaataataatgggagactttaacaccccactgtcaacattagacagatcaacgagacagaaagttaataaggatatccagcaactgaactcggctctgcaccaagcagacctaatagacatctacagaactctccaccccaaatcaacagaatatacattcttttcagcaccacaccacacctattccaaaattgaccacatagatggaagtaaagcactcctcagcaaatgtaaaagaacagaaattataacaaactgtctctcagagcacagtgcaatcaaactagaactcaggattaagaaactcactcaaaaccactcaactacatggaaactgaacaacctgctcctgaatgactactgggtacataatgaaacgaaggcagaaataaagatgttctttgaaaccagtgagaacaaagacacaacataccagaatctctgggacacattcaaagcagagtgtagagggaaatttatagcactaaatgcccacaagagaaagcaggaaaaatctaaaattgacaccctaacatcacaattaaaagagctagagaagcaagtgcaaacacattcaaaagccagcagaaggcaagacataactaagatcagagcagaactgaaggaaacagagacacaaaaaaacccttcaaaaaatcaatgaatccaggagctggttttttgaaaagatcaacaaaattgatagaccactagcaagactaataaagaagaaaagagagaagaatcaaatagatgcaataaaaaatgataaaggggatatcaccaccgatcccacagaaatacaaactaccatcagagaatactataaacacctctacggaaataaactagaaaatctagaagaaatggataaatttctcgacacatacaccatcccaagactaaaccaggaagaagttgaatctctgaatagaccaataacaggctctgaaattgaggcaataattaatagcttaacaaccaaaaaaagtccaggaacagatggattcacagccgaattctaccagagctacaaggaggagctggtaccattccttctgaaactattccaatctatagaaaaagagggaatcctccctaactcattttatgaggccagcatcatcctaataccaaagcctggcagagacacaacaaaaaaaaagagaattttaggccaataaccctgatgaacatcaatgcaaaaatcctcaataaaatactggcaaaccgaatccagcagcacatcaaaaagcttatccaccatgatcaagtgggcttcatccctgggatgcaagtctggttcaacatacgcaaatcaataaacgtaatccagcatataaacagaaccaacgacaaaaaacacatgattatctcaatagatgcagaaaaggcctttgacaaaattcaacaacacttcatgctaaaaactctcaataaattagatattgatgggacgtatctcaaaataataagagctatctatgacaaacccacagccaatatcatactgaatgggcaaaaactacaagcattccctttgaaagctggcacaagacagagacaccctctctcaccactcctattcaacatagtgttggaagttctggccagggcaatcaggcaggagaaggaaataaagggtattcaattaggaaaagaggaagtcaaattgtcgctgtttgcagatgacatgattgtatatctagaaaaccccatcgtctcagcccaaaatctccttaagctgataagcaacttcagcaaagtctcaagatacaaaatcaatgtgcaaaaatcacacgcatttctataacccaataacagacaaacagagagccaaatcatgagtgaactcccattcacaattgcttcaaagagaataaaataccttggaatccaacttacaagggacgtgaaggacctcttcaaggagaactacaaaccactgctcaatgaaataaaagaggatacaaacaaatggaaaaacattccatgctcatgggtaggaaggatcaatatcctgaaaatggccatactgcccaaggtaatttatagattcaatgacatccccatcaagctaccaatgactttcttcacagaattgggaaaaactgctttaaagttcatatggaaccaaaaaagagcctgcaatgtcaagtcaatcctaagccaaaagaacaaagctggaggcatcacgctacctgacttcaaactatactacgaggttacagtaaccaaaacagcatggtactggtaccaaaacagagatacagaccaatggaacagaacagagccctcagaaataatgccgcatatctacaactatctgatttttggcaaacctgacaaaaacaagaaatgggaaaacgattccctatttaataaatggtgctgggaaaactggctagccatatgtagaaagctgaaactggatcccttccttacacattatacaaaaattaattcaagaggattaaagacttaaatgttagacctaaaaccataaaaaccctagaagaaaacctaggcaataccattcaggacataggcatgggcaaggacttcatgtctaaaacaccaaaagcaatgacaacaaaagccaaaattgacaaatgggatctaattaaactaaagagcttctgcacagcaaaagaaactaccatcagagtaaacaggcaacctacagaatgggagaaaatttttgcaatctacttatctgacaaagggctaatatccagaatctacaatgaactcaaacaaatttacaagaaaaacaaacaaccccatcaaaaagtgggcaaaggatatgaatagacacttctcaaaagaagacatttatggagccaaaagacacatgaaaaaatgctcatcatcactagccatcagagaaatgcaaatcaaaaccacaatgagataccatctcacaccagttagaacggcgatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggattataaaacatgctgctataaagacacatgcacacgtatgtttattgcggcactattcacaatagcaaagacttggaaccaacccatatgtccaacaatgatagactggattaagaaaatgtggcacatatacaccatggaatactctgcagccataaaaaaggatgagttcatgtcctttgtagggacatggatgaagctggaaaccatcattctcagcaaactatcacaaggacaaaaagacaaacactgcatgttctcattcataggtgggaattgaacaatgagaacacttggacacaggaaggggaacatcacacaccagggcctgttgtggggtggggggagtggggagggatagcattaggagatatacctaatgttaattgatgagtttatgggtgcagcacaccaacatggcacatatatacatatgtaacaaacctgcacgttgtgcacatgtaccctaaaacttaaagtataataaaaaaatttttaaaaaaagaaacacctgcttttttctgttttccatttgcttagtagatttttctccatccttttactttgagcctggggatgtcattgcatgtgagatgggtctcttgaagacagcatacatttgggtcttgcttctttctccaacttggcaattctctgccctttaattggggcatttagcccatttacattcaaggttaatattgatatgtgcatatttcatcctgttatcatgttgttagctgctcaatatgcagatttgattgtatagttgatttatagtggcaatcgttatgtacttaagtgtgtttttgtggtggccagtaacgttcttccattatcatatttagcaatcccttaagggcctcttgtaaggcaatctagtggtgatgaatacccttagcatttgcttgtctgaaaaggatcttatttctccttcacttgtgaagcttcatttggctagatatgaaattcttgcttggaatttcttttctttaagaatgctgaatataggcccccaatctcttctggattgtacagtttctgctgaaacctccattgttagcctcattgggttccctttgtatgtgacctgaaccttctttctagctgcctctaatattttttttcctttcaacctttaagagtctgatgtctgatggctatatgtcttagggatggttgtcatgtataatatcatgcagaggttatttgcatttcttgaatttgaatgttggcctctctggtgaggttggagaaattttcatggaggatagcctgaaatgtttttcaagtttctttttttctctttctcttcttaagggataccaatgtgtcatagatctggtctttttacataattgcacatttctctgaggttttatgccttcttttttattctttgttctttatttttgtctgactgagttaattcagagaatcagtttttaagctctgtgattctttcctcagcttggtctattctgctgttaatacttgtaattgtattctgaaattcttgaagtgagttttttagctctatcaaatcagtttggttctttcttaaaatggccatttcatctttcagcttctgtatcattttactttatttcttagctcccttggattgggtttcaacattctcctgaatctcagtgatcttctttcctgtgcatattctgaattctatgtctgtcatttcagccatttcagtcaggttaagaaccattgctgggaaaccagtgtgattatttggaggtaagaagacactctggattttagagttgcagagtttcttgcattaattctttctcatctttgtgggctgtttctttaatctttgaagtggctgtcctttggatgtttttgtcttttttgttgttttttggtgtgtgtttttgtttgtttgttcatttgtttgttttttgctcttatcttctttgatactcttgcaggtttgattgtggtataaagtggattcagttagctgtgtttcttgaaaatcttagagggtccaggctcacctcagcactcttgtggtgtgttctctgctctgggactgggcccctggctttattctctggccccttgagtttagaaacttgctgcattggaggggctgaggtgttcccagtccattggccacaacactatagtagggggtgccggccaaagcacttcattagagtggtggcagtgggatccattcttactcatgggtgccagcagttgtggagtcatggcagggtgcacatgcatctgctggggtgggggtactggcaggagcagagtggcagcatccctacataggttcctgctggcagtcacagcgcagtgaggtgcccgtgtgttggcagggacagggtggtggggcacacatgcacatgcttgctggtggtagagggagttgtgatctgctgtgcactcatgccagcaaagcagttgggaggtactatgggtggactggtgcacatcagcagaggctggcctgctggaggtctccaatggttaggcatggtctgctggcaaaggagctatgatgagggcccccaggaaacaccctggttgggcttccaaggctgtactgcaagcaggcacagccagcctggggccccaggagaggccagaaggcaaggaaattctcatttcagatgggccctgtcccatggacaagaccaccctgctttattcaggtcccatagtcactctaaggttaaaatctcctagaggaggttggtgagccttgggggatgggtgtcccctggctgtgctccactacagccattctcatgtcaaacactctgggctttacacagactggagtcctgcccctggcatctctctaagcagctgtcccttccagcacaagtgtccatgggggtcatggggtctcctgctgctaggattctggaggcccatggcaacagcaggccactcctcacctgttcaactcaacctttccccaggagttgctgggagccaggaatgagtcctggtgcttggcatccccatgcagggttcccatcttcctccaccttcagctcagcatctgtgtcctcccccgtctactctcaatccactctcaatgcctccccttcaaagatctgcttggaaagcacccgtcttcctgatgtctcactccctccatggcagatattcctcctggctgcatctagtcagccatcttgactcgcctccaaagtctttttaattaccacttcggttaaattagtaactatcattttacaatggcctgtgattctgttttgatcaaatattttgagccttttagcatctataacaaatgttctcaaaaatcaaaatcctaaatcaagtctctgccttagtcttatttctggggcttattaaggctataaaaattaatcaccataaggttgtacaagctttttacagcttccagtcaggctatgaactccagtatcaccacctccagcctgataattacatatattggaagaaaatcagttaaaggactccctctagacccttgaaagggtgtgagagacaacatggtttcgcctgccttcatgtgtcccagtccatccctgtggctgcctctgtccacctcagcttgcccactgtctttccttcccaactgtctgccctgctgacttctggcctcagtgacagatgcaaagacaaggcgacagccccacatagaccgtttaaccagtcccacatttgcataagctaaatggtcatgtcacagtctgttgcccaggctggtctcaaactcctgggctcaagtgatccacccaccttgacccccaaggtgctgggattacaggcttgagccacagtgcccagccaagaacccgtttttgagtgggcaccttggcacacacctgtaaacgcaacactttgggaggccaaggtgggagtgtggcttgaggccaggaggttgaggttgcagtgagctatgatggcaccacctcactccagcgtgggtggcagagtgagatcctttagaaaaaaaaaaaaaaaaaacttgttttctctgcagccgggctccgtgaccaaacacaaacacaaacttcccctccagagggtccaggaggggctgggctgcaggaggtgcttagggcctcttagggaatggtaagtgaccacccaacgcaggcactcagccccaggggcatatgcagagagagggtccaggaggagctgggctgcaggaggtgcttagggcctcttagggaatggtaagtgaccacccaacgcaggcactcagccccaggggcatatgcagagagagggtccaggaggagctgggctgcaggaggtgattagggcctcttagggaatggtaagtgaccatccaacgcaggcactcagccccaggggcatatgcagagagaggctgggaggacactttcagtgactggggttacaaaccccaaccataagacattgctggctctgtgagccgccacctccagaaatctcccacttagttcttagcacttatccactcttcccttttcctactctcaattcctggaggatgccctcctttctcaggctcagaccaacctaccagctccactctagacctgaacacatgactcctccctctgtctccacctggaaatctcatcagtgcctcacatttacactcctgaaaatcaggtcctgcctacccaccctcttgctccacctgattcctgccctgtttcagccagagaccttgcagtctcctttaactctcaaacccacccatgtcgtgtgagcatactgactgtgttctatgcaagaaagagcagtttcttggtggtcctgcggttttattagtccagaggcaaagcgttggcagagctggtttcttctgaaccctgggagggagattctgttttcatgccttttccagattctagaacccatattccttgctctgtgtccccttcttccatcttcaaaggccatcctctcatctctgtgtccatcatcacatcacccttcccctgactctggttctcctgcttccacttataagcacccttgtgattacatcatacccacccagacaatgcagggccatattctcccctctcgagattaatttaatcacatctacaaagttcctcgtgccatatgaggtcactaaaccacatgttctgggggtttgaatgtaaacatttgggggatgcattattcagccacccacaagcactgctccccactggccacacactatgcacagccgagatcatgcaagtgaggcacgttcatcaacagcagcttcagcaggaaactatatgctccactttcctgccatttgtatctggatttttttttcgctatcattgtagaaagagtggtattgtaaaattaaagatggattattttctttctagaacactttggcaatctatccaacattatttatccccttctgagtgtcaagtgtgaggtcattctttcattgagagctcaatgcctacaattatgataatgcatattgggtactttcacacatcagaaagttcttctttcttaaaatctgttcttgaattattcattcttctctagctttttgttgatctattttataattttagaaaaatcagaaagtaacttgaagtatctgtcatctctacaggtttacctccctctttgtggccttcagaatgtcatgacacgcttttcccttgctcatcacatggtttctatgtatgagacctcatcacaggagctgtggtcccccgggagcaggcatctgtggatggtgccttgctcctggctgctgggacctgtgtgctgccagtggcactccacgacagtgatttcccagctcagttttgcagctccagatggtgggtgagacactaggaccactttgtgaacagcgagggcttggggtttgcttttctaccatgtccagggctgctgttcatgagggaatgtttctaacctgacatcatggctgaagccaacttagaacctctctagccgtatggggagtaggtgagtgatacagatgttaattagctcagtggagccactcccctatgtagacatgttacaaaacattatgctgtacagaataaatataggtcatttttatgtgtcaatcaaaagagaaactaattatttaaaaaaaaaaaaaaaacctctctactcaagccgaaacctcagctccagtcccacaagtcacacaaggctgctcccgtcctgtgtatgttaaacctacctcagaaatgcaagggggcattcaggtttcattctcaattcaaatgccctttttaattttgtctattcctagcacctggcaacttccagctctttttttcggggctcattcattatttaaagcacgtataatttttcacccacattctaacacatgtagtactgtagagaatccttccctaggaggatctacagcattagaaaagaattaagaactccaatatttacaagaaggaaaaagcaaaaagagatcaaaaaatgggcaacttctagaaatagaaaaccctcatgagtatgatgataaatcgctggcacacatgtgaatagttacttgatgcttatagtgatgtctgggaaaataacatgaaatacttataatctgtttctcacacatgtaattcaaaagaatagagagaagatgatttgaaatattcttaagtttgtaggaaaaaagctacttccatatgcataattgcatgtattttgatactgccattattaagaactatctaagagggtccattaaaaataaaatttcttggctgggcacagtggctcatgcctgtatcccagcactttggaaggccgaggcaggtggctcacctgaggtcagaagttcaaaaccagcctggccaacatggtgaaacgctgtatctaccaaaaatacaaaaattagctgggcatggtggcatgcacctgtagtctgagctacttggggggctgaggcaggataatcgtttgaacccaagaggtgtaggttgcagtgagctaagatcataccaccgcactccagcctgacagacaaagcaagactctgtctcaaaaatattaaaataaaatttctcattcctattacagagtaatttaattcattaatgccctgccctgttacaaaactcatttgtaaaatactaattgtaattgtgaaaaaatggcaattgatactaattttaaattctaaaaacagggcacccatattaaagattattctgcagtaagagaattagctataacattttgtaataaggtggagaaaacattctccaacttacaatggttggtgagaagaaagtttccagcacggtagatggaccctaagagcccttgttgaaataataagacaaaaagatatacagagagatgagccagatgaagggagacagagagagagagagagagagagagagaggcacagaaatgagagatacaaagtgaaagagggcaacctgtggggtcatcagatatttgttttctgttttgtttattctaacataaaggcagtggtgggtcatcgatgtatttagagtttgcacaatcactgtggaacacagacagacacaggggaagaggagaaacacagggcggtggcttgcccttggactgttcttagttcctcaaaacgtaacagctttgcccaacctaagggaactttcagcagctgctcttctgccataggcctctttcctgccttgttttcatgtggctgactgtttctgttcctgcaggtcttagctcatcagacaggcatttattacctctgtgtcaacagtgggagcttccattactctctagcatgacactccccttcctcttttaggaaatttaacatggaagtgagtttgccatcggccttctccccacagtgttaacagtggtgaggaagccagcctgttccaccttgcccctcccatgattccaacactgagttcagacttgtcacatggaacttatctttgcatgtttgtggcacagacagatggacccaaccatggattagtggatggatggatggatggatggatggatggatggatggatggatggatagatggatggatggatggctgagtaggtgtgtggatggaagagtgaaaagatagatggatgcatgtatgggtggatgggtaggttgatggatgcatggatgggtggatggatgggtgagtggatgaatgggtgggtaggtgggtggctacatgcatggatgagtacttggatagataagtgagtggatggatggatggatggatgaatgggtatgtgaagggatggatgtattagagtgggtagttaggcaggcatgagctgatagtcaagtgattgttaaactgcctctctaaaataataattggtctcggctggacgcggtggctcatgtctgtaatcccaacactttgggaggctgaggtgggcggatcacaaggtcaagagattgagaccatcctgaccaacatggtgaaaccctgtctttactaaaaatacaaaaattagctgggcgtggtggcgtgcatctatagttccagctactcgggaggctgaggcaggagaattgcttgaacctgggaggaagaggctgcagtgagctgagattgtgccactgcactccagcctggtgacagagcaaagctctgtctcaaataataataataataataaataataattgatctcagccagcgccaagaaaaggcagtctcccaatagatagaaaacacccgaaactggtcatcagcagcttcctgataagatctcaggcattgggtgagtgggctcaagcatatgcactaagaggcaaagtggcagagtttaactggcacataatcttcctctaggaacactctaatagtaagagaaggacacctcaaatgagcatgtgcacatttcattaaacccactgtgtatgcagcccctcccaagtgctggcaggccactgtacatgtgggcagcccactccaagggaagaatcaagggagaagaaatacaaatcccagaaccatgtcaatgtataaaaccccaagtcaagggccggacagagcacttagatctctcaagtcgcccacttagccctcttccaagtgtactttacttcctttagttcccactttaaaactttaataaacatttactcctgctctaaaacttgcttgggtctctcactcttctgtatgccccttggccaaattctttcctccaaggaggcgagaatcaagttgctgcagacctgtatggattcgctcctgctaacagatagctggatgggtggacagatgcatgaattagtggatggacgtttggatgtgtgggtgggtgggtggattgtgggatggctggatgaatgcatggctggatgggtggacagatgcatgaattagtggatggatgtttggatgtgtgagtgggtgggtggattgtgggatggctggatgaatgcatggctggatgggtggacagatgcatgaattcgtggatggacgtttggatgtgtgggtgggtgggtggattgtgggatggctggatgaatgcatggctggatgggtggacagatgcatgaattcgtggatggacgtttggatgtgtgggtgggtgggtggattgtgggatggctggatgaatgcatggctggatgggtggacagatgcatgaattcgtggatggacgtttggatgtgtgggtgggtgggtggattgtgggatggctggatgaatgcatggctgggtgggtggatggatgcatggataagtggtggacggatggacgggtgagtggatgggtggatgtgtgtgtggatgggtggataggaaagccctctaattgattacagggctcagtgtgtgcttcaacatcatgatggcatcatcacattggtccctgtatgaagcagtgggggaggagagtgtaccaggggagcaggaatgacttttctccagaatcgacctctcccaccctgcagcctgggctgtgcaggccacattggagaaggtgcggtcgactactcctaaatgttgttgtgtccaatggcttgttgacgttgatgtaggaatgagcctacatctccaccatagatggaactgtttgggtccccaaagcagaaagcctcttctgttgcaggtgctgaagtttccatcttcttctgcttatacggaagctcacgcatcccttggatggcaggcgtcaggttcctgtgcgcactgagttccccccttacatgctttggacagaagtgtgagacacacaagattgctgcaggaagtccacctgtggggatgctgcgacttctccagcaagaacacgagtctgctcattgaccatcaccacacataacaaattaagtgtcccttttttgataacacgtcattgtttcacagagtattcttttaaagtgtataagttgactgcagttattattttttacttctgttactaatttactcataattaggcacaatttacacttaagaaatttcttaatagttttttcctccttaaggtgaactacagtcagataacatacttatcaattgtctctagctcttgtcagaaaaacatatagatgtgtgtgtgcgtgtgtcttggcctttccaatgatgaattaagatgtgcattgagaaggcattcactttatttgacgttaaggaagtaccaagaagacgctctccacagaccctgggaaagccagcagctgcaccccgaggctgtgccaggcagggaacaaggaggcagcaccacctgctgggcagggaaaatgtcctcccagtccctgccgcttctctgcagaggcacaaagagctgccccttctcctgggccttctcctgggctgatgagattgctccccgatatgccaaatcagggttgtgcatctgaggctctgtctagactctcagctccttcctactcctgcaaagtgaagaaaacaatgccaaggggtcctggaggcgtctctacccctggagagttttgactctcttcaatagtctccactaccctgccctcactccatgtcctccgtttctccctaaagcggtgcccagtctgattgcactgtggcagggataacgaggggccaggacatcaggggagagaagtttctacctgagtcacagcagcggctgccctgcagactcctgaagacacaagacacatttccatcccagagacccagcgaaatgcaacctcaggctagagacagccagttattttttcttgttctgtcctggagaggccactgagaaagtcgagccccttgttgaggaaaacatgagatctctgtgtgtcgtcctctgcctgatggctgtacctccatgtgagtgtctcagagatttcagaacgggggctgtgggctgtggtgtccgcttgtgactcatctctttgcttcttgtccctgagtgtcctgcatcagatgcagctactggagtcatgcccagggctggtgaggtcctcacagacctctgggcctggacccagcagccctctgggaaggcgctggggcacctcagctccaggggcagcacacacttcagcccagcctttctgggccaactctccatctgtagagacacatccaaggcccagttatccctgcagctgagctccgtgatggccaagggcagggccgcacattcccgtgggagacagaatggggacctcagcgtgagcccagacacaaacctccctgcagggaagcacaagaccaccaggcggcgctccagaccacacagcggccccagaagcaggttttagggggcggggcagacgtgtccgcgttgagtcaggtcattggttttactttccctgagcaaacggcctctgccaaggactcactgcacctctcaccttcacagttgttttttttttttttttaatcaccctgtagagttttgctagctaatttagatattgaggagtgcttcatacttccttgggcctctgcttgcagaaacatagcaattgtaaggaggcacgtgggaaagccccggctcggtgacccgggggatgctgctgtggccctggcaagagggcgtcgggccgcagtaacaaaggtgcagacggctctcagcctgcgcccgcggagtacaacacataagggctgtaacctaacgaaaaaagaatcgcagtgcaactgtcctgcatttgagtttgtgatcagttttgccctttgtctttaacaggttctaacataaaattttgaatgttggttcaagccctgtgggtaaaatgcacttacccacattccttaaacaaatagaacactgaggtggaaatgttttgaaaaagtagttttcagacatttggaaacaagcatcacaggatcataacccctgagaaaagaaaaacaaatgaacgaatcctgctattgcctgaaagcagctgccaggacacacggaaaggcttagtgagctgagcggacagagagcagagttcaaggcagcagcagcccgaggggaggagcaccggggagcaggctgctgtgcagccaggatgggccggggtggggcggggggagaacagctggagacttgccgcagggagggggatccctcaggtttggggctgagaactgacttatgcctgacttatgcctgcatgaaaagaaactactcgatatcagggggaaatcaccagaaacctgtggacccaaaactacacagagcctacacaaggaaagcattgtttgtgttctcccagccagggtggaaagaccttgagatatgtaaagcttcaagcaatcttccgaagtaatctcgtgagtagtggtgccacattaattcaggactaaaggctgctctgaactgaacctaagaaatgcttcaagtgtagcctggagcccgggtgcagtggctcacacctgtaatcccagcactgtgggaggccgaggcaggcggatcacttgaggtcaggactttgagaccagcctggccaacatggcaaaacctgtctctactaaaaacacaaaaattagctgggcgtggtggcagatgcctgtaatcacctcccacctggacccttccttgatacatcagaattacaactagagatgagattggggtggggacacagagccaaaccgtatcacataggaacctaaaaggataataaagtaggaaaacttcccacatcagtaaccctttatccgatagtaatcccaatctgcaaagtaaaactgtgtgattttactaagataacggaatcttctctacagaaggactttccagtgcaaaagctccccaccctcaccatgaaatgcacgtgaccatttccaatttgtgtaaagtcctcagttagtactgagacttcggaaggttagaaatccctttgctcatgctgcatggtccggatgagatgtaagaatcattagctaatagacatgcaacagcttttgtgtgaaagatgttatgagacatttaaggtatttgcttgtgattactaagcattcattgtatcattggagcacatgtgcttttataccctggagaaattccagtaattgaattgctgggttgaatgggattttgatttggattaaatttaaactatagattttatttagggaaaactggcatcttaattatgttattggggggcccttgctcccagagctcccaagatggtggcaggccgcttccaaaatgaccgcaggccacttccaagatggtggcaagcctcatgttctctgacctggggttcttggcctcacggattccaaggaatggaagcttgggccatgcagtgagtgttatagctctattagaagccgtgggtcacggaagagaaccgtggaacccagtgactagtgttcagctcgattaggacgaacccaggcacttagccgtgcaggaacaatggcgagcatttggcccgatcgagagtggcaatgggcgcctcgctggatcaggagcacagcggataccctgatggatccggagggatggaagccagcggtgggtctcccacgggggcaaacagcagtggtggacggtgagcgaaagcgaagctcgagccgtaacaaacatggaccagaagagtgcagttgcaagatttagtagagtgaagacagagctcccatacaaagggaggggacccaaagagggtagctgttaccggctcgaatgcctgggtttatatcccgatcattgtccctcccgctgtgctctcaggtgatagatgattggctatttctttacctcctgcttttgcctaattagcattttagtgagctctctttactatctgattggtcgggtgtgagctgagttgcaagccccgtgtttaaaggtggaagtggtcaccttcccagctgggcttagggattcttagtcggcctaggaaatccagctagtcctgtctctcaattacactgagttttccaatccatgcatccaatatgtggtgtatctcttcatatgttcatagcctctgagcaatgttttacaattttctgtgtaaagaactccacatcgttttatgtttcttctaaggtatatcctgattgctttttatgtcttcacaagttttttcctttcaaaattaattttccaattgtttggtgctaatatgctcaaatgtccttgattttcttagtttgaacagtccgtttttgttttggggatttatttttttttcagattctttaagattttctatgtctataaccatataatctctgaacagagacagttttgctttttcctttcaacttgaggtaggttttctgggtagttcaggacgcgcaggcactgggtgggtggtgttagcagctgcacgatgccttggagaggacactctcgggggactgtggccgctgctcagctgtgaccgttcttatagcaccagcagctgcggccaccattcttatccaatttccaaagccacaccacaggccctctcaagaacgaggcgtggaggctatgccctctcctggacacatcatcattcccaagccccacgatgtgggccccatgggacgcacacctttgtctgtccagacctcagccccacctcctcatcctgcaccagaactcttcagagcccagtgcatgaaatgggctaccaaggaaatgagggtaggttcctgagaggaaactggccctgcatttgggagctaggagtctgctaattcgcctggcagccctgtgcagccctccgtggctacagtccaccccgtgcccatcagtgcctccttcctgtgcaagcctggacctcgccctgggctcaggatgggctgtagaccgagaatgcaggcgggaaagtctttgtctatcggggccatagtcaggttctacagtgagtcagggaaagacctgtggaggtgtggatgaggacaatgggtccaccatcaacaggaggacacgggttcgaccccttgcagaggcacagtcccacatcactgggaggcagccacactcactgcctcgccctctcctcacacagtgcagtttccacgttcacagccccagccagtcaccaggaatgccctgggggcggcctttccccagtgcactccgagccctcccttggctgtgcggtgagctccatgcccaggagatatccacccatagtcctccggaaagcagctgacctgccatgccctggaaccacaaatccccacagatcagccagcctgcagtgggccttggatgtggtgaggagtggtggcacccccgttcccaccccacagatgcaacgcctgtgggtgacgcatgtgagtactgaggagtagagggtagaactgtaggccccgagaaccacagaaactcgggtgttacactctggggccatgtaaggagaaagtgtcactggacagaaacaggcccctcctagacactgtgtgcgccatagtcacctgtcattagctctcactcttgcagattcatgattgaggtggttaaaaaaaaaaaagctcctactcacccatccaaccccatcctggggtgtttccaccacccttggggtttgggatgagctgcccttgcccactgtgctctgtggacctccctttagaagctcacagctccctgcactcggctccatcctgccccaccacacagaagcaaaacccctctcctttccactgcaggcttttcctggaccagaatgctgacctgctgcccttcactcccgaagtggtgggactgcctggggtggtgtgggtgttgagccttcttactctagggacctggcacctggccccaggggcacagggatggtgcatctgcctagggatgcctcctcatgccagggggtgggggttagtaccatcggccctcaggatttgttgcatgaatgagtgaatgggtgaataaatgaaggggatctgatctatgaataagggtatatagactttggttgatgtaggacgccaaatgctggaatttcagagtcatcacacccaggggccctgcctctgagctcctctttgcatccaatctgctgaagaacatggctctagggaaacccagttgtagacctgagggccccggctcttcaatgagccatctccgtcccggggccttatatcagcaagtgacgcacacaggcaaatgccagggtgtggtttcctgtttaaatgtagcctcccccgctgcagaactgcagagcctgctgaattctggctgaccagggcagtcaccagagctccagacaatgtctgtctccttcctcatcttcctgcccgtgctgggcctcccatggggtcagtgtcagggagatgccgtattcacagcagcattcacagactgaggggtgtttcactttgctgtttccttttgtctccaggtgtcctgtcacaggtacagctgcagcagtcaggtccaggactggtgaagccctcgcagaccctctcactcacctgtgccatctccggggacagtgtctctagcaacagtgctgcttggaactggatcaggcagtccccatcgagaggccttgagtggctgggaaggacatactacaggtccaagtggtataatgattatgcagtatctgtgaaaagtcgaataaccatcaacccagacacatccaagaaccagttctccctgcagctgaactctgtgactcccgaggacacggctgtgtattactgtgcaagagacacagtgaggggaagtcagtgtgagcccagacacaaacctccctgcagggatgctcaggaccccagaaggcacccagcactaccagcgcagggcccagaccaggagcaggtgtggagttaagcaaaaatggaacttcttgctgtgtcttaaactgttgttgttttttttttttttttggctcagcaacagagatcatagaaaaccctttttcatatttttgaaatctgttcttagtctaatggagattctctaatatgtgacaatgtttttctcttgctgtttttggaattctttgtctttgacttttgacaacttgacttttgacagtgtgcctcaaagaagttctattttgggttctgtgaacctcctggatctgggaagttttcagctatgatttcattaaacgtgttttctacaccatttccctactcttttggaatacccataatgcaaatatttgttcacttaattgtgtcccataaatgctggggattttcttcattcctttttactctttttttctttttattcatctgcctgaattatttcaaaagatctgtcttcaacttcagaaactcttttgcttggcctagtctaatcttgaaggtctcaattgtacttttaatttcattcattgaattcttcaactctggaatttctgttggttcttttttatgatacttatctctttgttgaattcctcattcaaatgataaattgttttcctgatttcactgaattttctatctgtacactattgtatctccctgagtttcttagagattatccttttgaattatttttctgacattctgtatatttccttatgattggggtctgctactggagaatgactgttgtctttttcaggtgtcgtgtttcctggccttttcatgttttatgtgttcctacgttgatttctacacatctggcggaccagtcatcccttgcaatttaatggagtaggttttgcaggaaaagacttcctagtacagacgggtctcagggtgtcagtgtggcggggcgtgctggctttagttctaggttgacgcagtagcgtagtctccatgtcgtttcttcagctgccgtccacattggtgacgtttgcgagtgtctcagtggcctgggctgagaggtttgtggcagtggaagtgcaacgttgctagaggtggactcaccaggctgtttctgaggtcgaggcacatgcatgcacatggtggattgaccaacttggtgccaggctcactagggttggggacatggggctgtttctcaggcccaggatgcaaacacaagtctctttggctggcctgggggtgtggcttctgagggcaatccacagggctgtttctcaggttcaggacacaagtgcatggccgctcaactggcctgggcatgtgtctcccagggccaccccatgggctctttctcagacccaggacatggccacatggcttcctcagctggcctgggtgtgtgtctgctggggggctgcaggggcacagggttatttctcaggccggggtcatgggcgcacagctgcttgctggcttataggagtgcctgccaggggtggcccatgatgctgtttctcaggcctaatttcaggtgcagagcctttgggcaggtcaacggcatacctgtggaaattggagtggatgccacagggctatttctcaggtgcctgagtgtgggcacatatccactctgccagcctggagttagtatcaggtgctcggtggctcaggggcctctcctgctcaggggagggccctcagcagcttggccaaatcaatggtggattcaccctgggcaggcctggcaggctcttcctccagctggatgtgcagcagcaggggttgggttttttgctgtgcagggccagagtcacggccaatcctcagcctaggctctgcacagccagggttgtggcattcagccacccagatatgggcatcctgaagatggagccccaatgctagaaaggggcagtggctaccagcctcagggcaggatgcactccagaggcggctccggtctcaaggtggcgctgggctgcagcagctaggctcacagtggatgaatgggggcagggagtacacaccttgtgctcctaatctgggatcattcctggcagctcccaaccgcggatcctctccctatagtgagtcgtattagcggcc

SEQ ID NO: 10 - DNA, 202662 bp, Artificial Sequence
  Annabel
  misc_feature (151214)..(151343): n is a, c, g, or t
  misc_feature (183232)..(183281): n is a, c, g, or t
  misc_feature (194855)..(195259): n is a, c, g, or t
  misc_feature (198416)..(198423): n is a, c, g, or t
ggccgcctcccatgattccaacactgagttcagacttgtcacatggaacttatctttgcatgtttgtggcacagacagatggacccaaccatggattagtggatggatggatggatggatggatggatggatggatggatggatggatagatggatggatggatggctgagtaggtgtgtggatggaagagtgaaaagatagatggatgcatgtatgggtggatgggtaggttgatggatgcatggatgggtggatggatgggtgagtggatgaatgggtgggtaggtgggtggctacatgcatggatgagtacttggatagataagtgagtggatggatggatggatggatgaatgggtatgtgaagggatggatgtattagagtgggtagttaggcaggcatgagctgatagtcaagtgattgttaaactgcctctctaaaataataattggtctcggctggacgcggtggctcatgtctgtaatcccaacactttgggaggctgaggtgggcggatcacaaggtcaagagattgagaccatcctgaccaacatggtgaaaccctgtctttactaaaaatacaaaaattagctgggcgtggtggcgtgcatctatagttccagctactcgggaggctgaggcaggagaattgcttgaacctgggaggaagaggctgcagtgagctgagattgtgccactgcactccagcctggtgacagagcaaagctctgtctcaaataataataataataataaataataattgatctcagccagcgccaagaaaaggcagtctcccaatagatagaaaacacccgaaactggtcatcagcagcttcctgataagatctcaggcattgggtgagtgggctcaagcatatgcactaagaggcaaagtggcagagtttaactggcacataatcttcctctaggaacactctaatagtaagagaaggacacctcaaatgagcatgtgcacatttcattaaacccactgtgtatgcagcccctcccaagtgctggcaggccactgtacatgtgggcagcccactccaagggaagaatcaagggagaagaaatacaaatcccagaaccatgtcaatgtataaaaccccaagtcaagggccggacagagcacttagatctctcaagtcgcccacttagccctcttccaagtgtactttacttcctttagttcccactttaaaactttaataaacatttactcctgctctaaaacttgcttgggtctctcactcttctgtatgccccttggccaaattctttcctccaaggaggcgagaatcaagttgctgcagacctgtatggattcgctcctgctaacagatagctggatgggtggacagatgcatgaattagtggatggacgtttggatgtgtgggtgggtgggtggattgtgggatggctggatgaatgcatggctggatgggtggacagatgcatgaattagtggatggatgtttggatgtgtgagtgggtgggtggattgtgggatggctggatgaatgcatggctggatgggtggacagatgcatgaattcgtggatggacgtttggatgtgtgggtgggtgggtggattgtgggatggctggatgaatgcatggctggatgggtggacagatgcatgaattcgtggatggacgtttggatgtgtgggtgggtgggtggattgtgggatggctggatgaatgcatggctggatgggtggacagatgcatgaattcgtggatggacgtttggatgtgtgggtgggtgggtggattgtgggatggctggatgaatgcatggctgggtgggtggatggatgcatggataagtggtggacggatggacgggtgagtggatgggtggatgtgtgtgtggatgggtggataggaaagccctctaattgattacagggctcagtgtgtgcttcaacatcatgatggcatcatcacattggtccctgtatgaagcagtgggggaggagagtgtaccaggggagcaggaatgacttttctccagaatcgacctctcccaccctgcagcctgggctgtgcaggccacattggagaaggtgcggtcgactactcctaaatgttgttgtgtccaatggcttgttgacgttgatgtaggaatgagcctacatctccaccatagatggaactgtttgggtccccaaagcagaaagcctcttctgttgcaggtgctgaagtttccatcttcttctgcttatacggaagctcacgcatcccttggatggcaggcgtcaggttcctgtgcgcactgagttccccccttacatgctttggacagaagtgtgagacacacaagattgctgcaggaagtccacctgtggggatgctgcgacttctccagcaagaacacgagtctgctcattgaccatcaccacacataacaaattaagtgtcccttttttgataacacgtcattgtttcacagagtattcttttaaagtgtataagttgactgcagttattattttttacttctgttactaatttactcataattaggcacaatttacacttaagaaatttcttaatagttttttcctccttaaggtgaactacagtcagataacatacttatcaattgtctctagctcttgtcagaaaaacatatagatgtgtgtgtgcgtgtgtcttggcctttccaatgatgaattaagatgtgcattgagaaggcattcactttatttgacgttaaggaagtaccaagaagacgctctccacagaccctgggaaagccagcagctgcaccccgaggctgtgccaggcagggaacaaggaggcagcaccacctgctgggcagggaaaatgtcctcccagtccctgccgcttctctgcagaggcacaaagagctgccccttctcctgggccttctcctgggctgatgagattgctccccgatatgccaaatcagggttgtgcatctgaggctctgtctagactctcagctccttcctactcctgcaaagtgaagaaaacaatgccaaggggtcctggaggcgtctctacccctggagagttttgactctcttcaatagtctccactaccctgccctcactccatgtcctccgtttctccctaaagcggtgcccagtctgattgcactgtggcagggataacgaggggccaggacatcaggggagagaagtttctacctgagtcacagcagcggctgccctgcagactcctgaagacacaagacacatttccatcccagagacccagcgaaatgcaacctcaggctagagacagccagttattttttcttgttctgtcctggagaggccactgagaaagtcgagccccttgttgaggaaaacatgagatctctgtgtgtcgtcctctgcctgatggctgtacctccatgtgagtgtctcagagatttcagaacgggggctgtgggctgtggtgtccgcttgtgactcatctctttgcttcttgtccctgagtgtcctgcatcagatgcagctactggagtcatgcccagggctggtgaggtcctcacagacctctgggcctggacccagcagccctctgggaaggcgctggggcacctcagctccaggggcagcacacacttcagcccagcctttctgggccaactctccatctgtagagacacatccaaggcccagttatccctgcagctgagctccgtgatggccaagggcagggccgcacattcccgtgggagacagaatggggacctcagcgtgagcccagacacaaacctccctgcagggaagcacaagaccaccaggcggcgctccagaccacacagcggccccagaagcaggttttagggggcggggcagacgtgtccgcgttgagtcaggtcattggttttactttccctgagcaaacggcctctgccaaggactcactgcacctctcaccttcacagttgttttttttttttttttaatcaccctgtagagttttgctagctaatttagatattgaggagtgcttcatacttccttgggcctctgcttgcagaaacatagcaattgtaaggaggcacgtgggaaagccccggctcggtgacccgggggatgctgctgtggccctggcaagagggcgtcgggccgcagtaacaaaggtgcagacggctctcagcctgcgcccgcggagtacaacacataagggctgtaacctaacgaaaaaagaatcgcagtgcaactgtcctgcatttgagtttgtgatcagttttgccctttgtctttaacaggttctaacataaaattttgaatgttggttcaagccctgtgggtaaaatgcacttacccacattccttaaacaaatagaacactgaggtggaaatgttttgaaaaagtagttttcagacatttggaaacaagcatcacaggatcataacccctgagaaaagaaaaacaaatgaacgaatcctgctattgcctgaaagcagctgccaggacacacggaaaggcttagtgagctgagcggacagagagcagagttcaaggcagcagcagcccgaggggaggagcaccggggagcaggctgctgtgcagccaggatgggccggggtggggcggggggagaacagctggagacttgccgcagggagggggatccctcaggtttggggctgagaactgacttatgcctgacttatgcctgcatgaaaagaaactactcgatatcagggggaaatcaccagaaacctgtggacccaaaactacacagagcctacacaaggaaagcattgtttgtgttctcccagccagggtggaaagaccttgagatatgtaaagcttcaagcaatcttccgaagtaatctcgtgagtagtggtgccacattaattcaggactaaaggctgctctgaactgaacctaagaaatgcttcaagtgtagcctggagcccgggtgcagtggctcacacctgtaatcccagcactgtgggaggccgaggcaggcggatcacttgaggtcaggactttgagaccagcctggccaacatggcaaaacctgtctctactaaaaacacaaaaattagctgggcgtggtggcagatgcctgtaatcacctcccacctggacccttccttgatacatcagaattacaactagagatgagattggggtggggacacagagccaaaccgtatcacataggaacctaaaaggataataaagtaggaaaacttcccacatcagtaaccctttatccgatagtaatcccaatctgcaaagtaaaactgtgtgattttactaagataacggaatcttctctacagaaggactttccagtgcaaaagctccccaccctcaccatgaaatgcacgtgaccatttccaatttgtgtaaagtcctcagttagtactgagacttcggaaggttagaaatccctttgctcatgctgcatggtccggatgagatgtaagaatcattagctaatagacatgcaacagcttttgtgtgaaagatgttatgagacatttaaggtatttgcttgtgattactaagcattcattgtatcattggagcacatgtgcttttataccctggagaaattccagtaattgaattgctgggttgaatgggattttgatttggattaaatttaaactatagattttatttagggaaaactggcatcttaattatgttattggggggcccttgctcccagagctcccaagatggtggcaggccgcttccaaaatgaccgcaggccacttccaagatggtggcaagcctcatgttctctgacctggggttcttggcctcacggattccaaggaatggaagcttgggccatgcagtgagtgttatagctctattagaagccgtgggtcacggaagagaaccgtggaacccagtgactagtgttcagctcgattaggacgaacccaggcacttagccgtgcaggaacaatggcgagcatttggcccgatcgagagtggcaatgggcgcctcgctggatcaggagcacagcggataccctgatggatccggagggatggaagccagcggtgggtctcccacgggggcaaacagcagtggtggacggtgagcgaaagcgaagctcgagccgtaacaaacatggaccagaagagtgcagttgcaagatttagtagagtgaagacagagctcccatacaaagggaggggacccaaagagggtagctgttaccggctcgaatgcctgggtttatatcccgatcattgtccctcccgctgtgctctcaggtgatagatgattggctatttctttacctcctgcttttgcctaattagcattttagtgagctctctttactatctgattggtcgggtgtgagctgagttgcaagccccgtgtttaaaggtggaagtggtcaccttcccagctgggcttagggattcttagtcggcctaggaaatccagctagtcctgtctctcaattacactgagttttccaatccatgcatccaatatgtggtgtatctcttcatatgttcatagcctctgagcaatgttttacaattttctgtgtaaagaactccacatcgttttatgtttcttctaaggtatatcctgattgctttttatgtcttcacaagttttttcctttcaaaattaattttccaattgtttggtgctaatatgctcaaatgtccttgattttcttagtttgaacagtccgtttttgttttggggatttatttttttttcagattctttaagattttctatgtctataaccatataatctctgaacagagacagttttgctttttcctttcaacttgaggtaggttttctgggtagttcaggacgcgcaggcactgggtgggtggtgttagcagctgcacgatgccttggagaggacactctcgggggactgtggccgctgctcagctgtgaccgttcttatagcaccagcagctgcggccaccattcttatccaatttccaaagccacaccacaggccctctcaagaacgaggcgtggaggctatgccctctcctggacacatcatcattcccaagccccacgatgtgggccccatgggacgcacacctttgtctgtccagacctcagccccacctcctcatcctgcaccagaactcttcagagcccagtgcatgaaatgggctaccaaggaaatgagggtaggttcctgagaggaaactggccctgcatttgggagctaggagtctgctaattcgcctggcagccctgtgcagccctccgtggctacagtccaccccgtgcccatcagtgcctccttcctgtgcaagcctggacctcgccctgggctcaggatgggctgtagaccgagaatgcaggcgggaaagtctttgtctatcggggccatagtcaggttctacagtgagtcagggaaagacctgtggaggtgtggatgaggacaatgggtccaccatcaacaggaggacacgggttcgaccccttgcagaggcacagtcccacatcactgggaggcagccacactcactgcctcgccctctcctcacacagtgcagtttccacgttcacagccccagccagtcaccaggaatgccctgggggcggcctttccccagtgcactccgagccctcccttggctgtgcggtgagctccatgcccaggagatatccacccatagtcctccggaaagcagctgacctgccatgccctggaaccacaaatccccacagatcagccagcctgcagtgggccttggatgtggtgaggagtggtggcacccccgttcccaccccacagatgcaacgcctgtgggtgacgcatgtgagtactgaggagtagagggtagaactgtaggccccgagaaccacagaaactcgggtgttacactctggggccatgtaaggagaaagtgtcactggacagaaacaggcccctcctagacactgtgtgcgccatagtcacctgtcattagctctcactcttgcagattcatgattgaggtggttaaaaaaaaaaaagctcctactcacccatccaaccccatcctggggtgtttccaccacccttggggtttgggatgagctgcccttgcccactgtgctctgtggacctccctttagaagctcacagctccctgcactcggctccatcctgccccaccacacagaagcaaaacccctctcctttccactgcaggcttttcctggaccagaatgctgacctgctgcccttcactcccgaagtggtgggactgcctggggtggtgtgggtgttgagccttcttactctagggacctggcacctggccccaggggcacagggatggtgcatctgcctagggatgcctcctcatgccagggggtgggggttagtaccatcggccctcaggatttgttgcatgaatgagtgaatgggtgaataaatgaaggggatctgatctatgaataagggtatatagactttggttgatgtaggacgccaaatgctggaatttcagagtcatcacacccaggggccctgcctctgagctcctctttgcatccaatctgctgaagaacatggctctagggaaacccagttgtagacctgagggccccggctcttcaatgagccatctccgtcccggggccttatatcagcaagtgacgcacacaggcaaatgccagggtgtggtttcctgtttaaatgtagcctcccccgctgcagaactgcagagcctgctgaattctggctgaccagggcagtcaccagagctccagacaatgtctgtctccttcctcatcttcctgcccgtgctgggcctcccatggggtcagtgtcagggagatgccgtattcacagcagcattcacagactgaggggtgtttcactttgctgtttccttttgtctccaggtgtcctgtcacaggtacagctgcagcagtcaggtccaggactggtgaagccctcgcagaccctctcactcacctgtgccatctccggggacagtgtctctagcaacagtgctgcttggaactggatcaggcagtccccatcgagaggccttgagtggctgggaaggacatactacaggtccaagtggtataatgattatgcagtatctgtgaaaagtcgaataaccatcaacccagacacatccaagaaccagttctccctgcagctgaactctgtgactcccgaggacacggctgtgtattactgtgcaagagacacagtgaggggaagtcagtgtgagcccagacacaaacctccctgcagggatgctcaggaccccagaaggcacccagcactaccagcgcagggcccagaccaggagcaggtgtggagttaagcaaaaatggaacttcttgctgtgtcttaaactgttgttgttttttttttttttttggctcagcaacagagatcatagaaaaccctttttcatatttttgaaatctgttcttagtctaatggagattctctaatatgtgacaatgtttttctcttgctgtttttggaattctttgtctttgacttttgacaacttgacttttgacagtgtgcctcaaagaagttctattttgggttctgtgaacctcctggatctgggaagttttcagctatgatttcattaaacgtgttttctacaccatttccctactcttttggaatacccataatgcaaatatttgttcacttaattgtgtcccataaatgctggggattttcttcattcctttttactctttttttctttttattcatctgcctgaattatttcaaaagatctgtcttcaacttcagaaactcttttgcttggcctagtctaatcttgaaggtctcaattgtacttttaatttcattcattgaattcttcaactctggaatttctgttggttcttttttatgatacttatctctttgttgaattcctcattcaaatgataaattgttttcctgatttcactgaattttctatctgtacactattgtatctccctgagtttcttagagattatccttttgaattatttttctgacattctgtatatttccttatgattggggtctgctactggagaatgactgttgtctttttcaggtgtcgtgtttcctggccttttcatgttttatgtgttcctacgttgatttctacacatctggcggaccagtcatcccttgcaatttaatggagtaggttttgcaggaaaagacttcctagtacagacgggtctcagggtgtcagtgtggcggggcgtgctggctttagttctaggttgacgcagtagcgtagtctccatgtcgtttcttcagctgccgtccacattggtgacgtttgcgagtgtctcagtggcctgggctgagaggtttgtggcagtggaagtgcaacgttgctagaggtggactcaccaggctgtttctgaggtcgaggcacatgcatgcacatggtggattgaccaacttggtgccaggctcactagggttggggacatggggctgtttctcaggcccaggatgcaaacacaagtctctttggctggcctgggggtgtggcttctgagggcaatccacagggctgtttctcaggttcaggacacaagtgcatggccgctcaactggcctgggcatgtgtctcccagggccaccccatgggctctttctcagacccaggacatggccacatggcttcctcagctggcctgggtgtgtgtctgctggggggctgcaggggcacagggttatttctcaggccggggtcatgggcgcacagctgcttgctggcttataggagtgcctgccaggggtggcccatgatgctgtttctcaggcctaatttcaggtgcagagcctttgggcaggtcaacggcatacctgtggaaattggagtggatgccacagggctatttctcaggtgcctgagtgtgggcacatatccactctgccagcctggagttagtatcaggtgctcggtggctcaggggcctctcctgctcaggggagggccctcagcagcttggccaaatcaatggtggattcaccctgggcaggcctggcaggctcttcctccagctggatgtgcagcagcaggggttgggttttttgctgtgcagggccagagtcacggccaatcctcagcctaggctctgcacagccagggttgtggcattcagccacccagatatgggcatcctgaagatggagccccaatgctagaaaggggcagtggctaccagcctcagggcaggatgcactccagaggcggctccggtctcaaggtggcgctgggctgcagcagctaggctcacagtggatgaatgggggcagggagtacacaccttgtgctcctaatctgggatcattcctggcagctcccaaacttggctgagggcttgcaaaacctgtggaattctcctgttgcaagggctgtagatgtttgcagtggcagtgggtgctggcgggaaatctgcttaccttttccctacatgggaagtccctcctgtgtccagaccaatccgatctgggtggggaagacaaggctgcaaaggccaggtgcctccatgctgccctccgatcaccacgggtgcgtttccacacctccactgcactccgtcagtctcccttcaacactccagtcaaaccttagctgtttcttctttgccttattccttcctcatggggagggtgtgggtgaacaccaggcttctctaagttcttcatccatcttgctgatgtcattctccatccaggcatgggtttttaagaagtagtgaatactgaaatttcagcagaggacacctctataaaaattctgcaactggaaaacctccttaaattggctgattgtcattacaattggaggaaaactgccaataatttcaaatttagaaggctgagactctataaacaaagactaacaatatgttttctgatatttttccccaaaataatacttttccaagacgaaaatttttccagggtatataagcacatgtgctccaatgatacaacaaatacttactaatcataagcaaataccttaaatgtcttataacatctttcacacaaaagctgttgcatgtctattagctaaaaattcttatgtctcgtccagatcatgcagcatgagcaaagggatttttgaccttcaaaagtctcagtactaactgaggactttacacaaattggaaatggtcacctgcatttcatggtggtggtggggagcttttgcactggaaaatccttctgtagagaagattccattatcttggtaaaattacatagttttattttgcagattgggattaccaactgataaagggttactgatgtggaagttttcctactttattctcctattaggttcctatgtgatatggtttggctctgtgtccccaccccaatctcatctccaattgtaattcccatgtgtccagggagggtccaggtgggagtgattagatcaagggtggtttttcccaggctgttttcatgatagggtgttatcatgagatatgatggtttaaaagtggcaggttcccctgctctctctctcgcctgctgccacataagacgtgccttgctttcccttcaccttctgccatgattgtaagtttcctgaggcctccccagccatgcggaactatgagtcaattaaacctcctctctttataaattacccagtctcaggtagtatctttatagcggtgtgaaaatggactaatacactatggctttgaattaataatttaaaatttgtcagcttggcaataaaacatcctgttgacatttattttttaggtaatattttaaattggcagtttcattcatgtttttacaaattcttattttcagggtgtttaaggcctttgctttgaacttggtggttccttacactccatgctgttagtgaagagggaccaggttgggaggcattggtttgggtggtggtcaggaagggcagagtgatttgagtagggtctgagtggataatagctcatcagtttggaatttataaatgaccagggatgatttaaggagattcctgccagacacctatgccatggccatgccctatctggatctccagccgtgagatgagaacccagccatgcgggggagtctgttcgttctgctcaatgttgtaagtggcacatgctattggataatgtagaattgaatggatatcattttattattataatttacaaacttcctacaataaacttatcacctttatacatagaaacaaatataagtacattttccctcccctatgtcattttgagccctctctccaaaccatcctcccactctgcgactcactgtcctgcatttggctatgctctggcaagtcctgcttagacaagcactcaccagaccacctactcagcctcccttcagcgcccacctggcccacctgctcaaatacatgttgagtggtcacacacatggactgaacaccatctattccatgcactgccccagtgaccgcactgagcagcaagagagaaatgatcgcattagctatcaattatgccaattcaaatgctggagtctttctcagatacttttcaatgttcaagaattgttgattgtgaattctatacccaatgaaactatccttcagaaatgagcagaaaatggataccttctcaaataaacaaaaactaaaagaattcttgctacaagatgtactcttaaagactggctaaaggaagttcttcaaacagcaaggaaattgaattgatcttatgtcctgcacacttgctaaatttcctctcaattttagcagcactgtttagattccataggattttccatacaaacagtcatgtggtctatatatagagacagattttcctcttttccagtggggataaatttatgtctttttctttctgtgttacagcaggtaggacctccagtacaatgttaaacagaagtggtgaaaacagacattcttgcctgtttcctaacgttggagtttggtcttttactatggtgtcagatgttagctgtagggtttttataaatgcccttcatcacattgaggaagtttgctcctatgcctaattttctgagagtcttttaatgtgacactcatgctagaatttattaaatgctttctgtctactaagatgattatgcagttcttatattaacatgaataattacatttatttattctttaatatcaaggcaattttgcattcctgagacaaaccccatttagtcatcatgtgttgttattgttacatattgttggattcaatttcctcaaaatttgttaagaattgttacatctatgtttacaaggaagattagtctgtagggtattttttcttataataactttgcctagttttgcaatcagggtaatgctggactcacagaatgagttgggaagctatttcctcctcttcatttttctgaaagaatttgtataaaattggaattatatcttccttaaaggtttgcaagatttcataatgaagtcattggcctagagttttctttgtgggaaagtctttgtttgtttgttttgtggtttgggtttttttttaagagacacagtctcactctgttgcccaggctggaatgcagtggtgtaatcatagctcacagcagcctcaacctcctgggctcaagcaatcctcctacctcagccttcagagtagctgggactacgggcatgtaccaccacacccagctgtttgtttgtttgtttatcgctttgtcttgtttttgaggtcttattatgttgcccaggctggtcttgaactcctggcctcaagtaatcctcatgcctcagcctcccacagtgctggaattacaggcatgagccactgcacacagactgtgggaaagtttttaactaaaaattcaattttctcttccttttccagtgagctttccagtgtctttcaattaatgtatctattttatctaagttgttgaatttattgtcaaaatttttttaaacaatattcctctcttagaggttgaacatctgtagaatctgtagtgatggcacctcttaaatccctgatcttgctcatctgtgtcgtctctctttctctaatcagtatgcctaaagtttaatttcattgattttcttaaaaaactggttttggttttattgatttttttccctagttttttgtgttacatttcattgacttctgctctgatatttactatttcctttctactgcctacagtaagtttaatttgctattttcttagtttcctaaagtggaagctaagtttattgacttgaggcctttcctctgtctggatgcggatatttgctgctaaacatttccctccaacaccatgctgtgagttttagttacagcgggcttggagttggcctgagaaattctacttaaacagctgcacctatcatgtaagtgataaatgatgtacctgcctggccctcacccctggtcaaagaatgggatgtactaatgagcaatgttgctgcgtagctgtggatttcaaggtattttctgtgtggttttatcatcagcattgtttgttgatgactgcaagactgatgatttgcacctggcctcggtgagatccccgaaagaccctgcagatgggctggttacttagcagaaaatatgacaacgtggccagcaggaaacaggaaggtacaatcggctgcaggtgagctgttggaagtaagttccaattttcctattttgtatttgcattttaatagtgagactgcgcttatgttatttgtgtgaaacagctttattcatagcactgtaatttaaagagaaaacccattcatgggaacaacaaacgacctagacaccaaggtagctcatgccatccaaggctatactgtgcagtgattgggaaaatgggcactggtcccagaagtctgatcgacactctgccactggctagtcccgtgctggggggcgaggatccacactctgccactggttagtcccatgctggggacaagtatccacactctgccactggctagtcccgtgctggggggcgaggatccacactctgccactggttagtcccatgctggggacaagtatccacactctgccactggctagtcccgtgctggggggcaaggatccacactctgccactgattagtgttgtgaagatttaaataaagaacccacaccatattctttgacttgtgctttccgtatactgagagatagtaagagtacattattattatttataaagtaaactagaaagcacatgggaagacaagaagaaaacctgaataaacatgaattaccccattttcctcaggagaaaactttcacactctgaaggtacacaaattagcctacaaatttaatgtaaagcaaatagactgttgtaggtaccaattctcaatgtcacagtgttacatggaaagtaaaatacacaagaacagcccaaaagatggaaacaatggacgtggtcaaatgacatcagtacaacatccatatggtcctaagtagccatctttaaaatgggttagaaatgccttcaatcattcacacagacacatgcattgaacaaactctaagaagtgttcttacacgggaaaagcaagttacagatgcatgggcatgatatggatgtagatgtgtgtatgtgcatcccactcatacacaaaatacccagcatcgcccacatgcctgctgtgtgcgtaagtgtgagcgagtgcacagacaacagcgtgcagaaattcaaaccaagctgtgggtacttgttaccactgggaagggagtcggtcacagagggaaagagaaacaggacatcagcctttgacttcagaactgttcctgccttttcacatcctgtgctgttttcagcatcatcggagcccttaacacacatcacgggagtaagagtgtgttagagggagcattcggtgggacagatattgccatggcttgtggatagagttcacagtccttaataatccccgagatggcagccaagagctacgttctcaatcacgcagcttcaccccagaaactgacagaaacccaacaaccaaaaggtgtccattctgacagcctcagcctgtgctggctcagatgagcaaaaatgtacagatattaataatgatgttgatttgaagagcacagaggggggtatgcatgataagggtccaaatttttaccttaaaaaagaatacatttacttctcaatcacctacataacgatcattttttaaaaaactgatcaaatttggtgttacaagggcacgttgcaaattcttctggctacttttctctgactattctaattacgttaccgtgttttctcctgtatgtgcccgttcatgtgaatgtcatttctggctacttttctctgactattctaattacgttaccgtgttttctcctgtatgtgcccgttcatgtgaatgtcatttctggctacttttctctgactattctaattacattaccgtgttttcctgtatgtgcccgttcatgtgaatgtcatttctggctacttttctctgactattctaattacgttaccatggtttctcctatatgtgcccgttcatgtgaatgtcatttctggctacttttctctgactattctaattacgttaccgtgttttctcctgtatgtgcccgttcatgtgaatgtcatttctggctacttttctctgactattctaattacattaccgtgttttcctgtatgtgcccgttcatgtgaatgtcatccaggcagatttcccaaatccggcttcctgtaaccaagggctgaaagagggaacggtttcctgggaatcctttttgcagtttattttacccggaggcagaagcccacggttccgtgaagagtctattgctctcccctctctccttttgtgtctctatttttaattgacaaaaaagcaaatgtgaagattcctggggtacaatgcaaagtgacaatgcctgtctatattgtgggatgattaaaacaaggtaagtggcatatccatcacctcacacacttatcattttgtggtgagaacatttaaaatctcatcttttagcaattttgaaatagtcattattgttaactatagtcaccatgctgtgcaacagatcaaaagaactgactcctcccatcagcagaaacttcatgccctttgaccagcatctctcctttccccgtccacgactaacccccagcccaagagaacagccaacacccacctcgctgctgccacacgacatgtcgggctttgatgggatggaggtgagggtggggaagacaattccaaagctggagcactggcctcacagctcagacactcttctacttatcctgagagaatgatgtgctgagaccaactaaacctcccctgctcttcccacatggcagaaaagaggcaacccagggaagccattgccaggacatcatggtcacccaacccttgtgcagaaaggaagcacctgcccaggatgccatagcacccaaccctcatccccaaggaaacacagcccagggcaccatggacacccaaccgtcatccccaggggaggacacagcccagggcaccatggacacccaaccctcatccccaggggaggacacagcccagggtatcttggacacccagccctcattcctaggggagtacacagcccagggcatcttggacatccaaccctcatccccagggaaggacacagcccagggcatcttggacacccaaccctcattcccataagagcacacagcccagggcatcgtggaggcccgaccctcatccctaggggaggacacagcccagggcaccatggacacccaaccctcatccccaggggaagacacaacccaggccaccattaacacccaatcatgtgcagggagggtgtccttggagcctgggactcttgccagtgaagcggtggacaagaaactgaggatgcgatcagcacacagaaatctcaggcagcctaggatacatgaggcctctcacccctgggaacactgagcagccaccaggagcccacaccttgaggtacagcaggagccatgcgctcttgctcttgctcactcacactcctgcacacagccactgacacacgccctcgtgcacgttgcagattaactccactggccttgcacttgcaacgctggaggctgagaggtatccccaggttcttttctcgtgagaggggcaggctgactttcactctcctccatgtgctagaggcagctccaccaacactggctgccctgagtggatgcacctggctctggaattcctgtcatttgctttggatccaggagcccctgcctcatgtagctacttaacagaaaggaggaatccacccaggacatgcccagacgggagcctcacaggatggacagtggtgtctggggtcacgggcagccctgacccagcagcgccagcaccagcacacccagtggggaaggcggggaggcccaaacgccacccacagtttgttactccactgggtgggacccggcacccctgccttcctgacaccctggagtccctgcctcctcctagagcccccaagcccatctgcctcagagcatccagagacagacctggggagccatttcctcaggccctggacaaggaaacagggaattccaggttatgggtgcctggggcaggtctcaggcaggtgctgggaaccagagagaggggtcaccgcgaggcctcaggcctggcaccagcactttgagcctcagtttaccagcccacgaggtgctgagtctggactggatgaccttcccacccccagtgacctctgccctttcccgagcatgtcagctctgctccagcatcctggtgtgagcgcaatgccactttttttctcaacaaatacgaaaggaggaaggtgcccccagggccctgtgccctgaggatgcctgtgtggaggggtccatttcatcactggtgtcactcacaggaagggacgaagccacctgccttgacggagcttactccacctccgccgaaggccggggaggtccctcacagagaacctgaggcccagcaggctgcagaggtgctggcatggaatgactgctcagacgcccggggccggcagagaggacggatgtgggggaggtgcacactgaggagcctctccttggaggtggagacacgtgcaccacatggaccaggacacagtccacgaagcctcgcatccccctgagctgcagctcaagggcctctctctgagcccagagtcccacccctgggaggcagctgccccagctctgagggaggagggcatccaccaggccctccatctcctgggggcaccagcccagcccagaggctctgcaggactctgcacctccaattcatggccaggactttctggatgtatcttaaggactgaggactccacatcagggaccacacaagaccggggtcccggacacgggggttgggggtgagcatgtcaccgggatgggctgtggcgtcactctggtacttcatccggacagccagggaccaaagccacgccctcagccccaccccacccctgcctcacatggcaacgcagggtctgcagatgcaggagagtgagaagcatggtagccaggcagactagaggacccgagctggggttgagcacctccctgtctacccagggcatggcctgtgagactgcaggtggcctagtgtgtgctgcaggctcaaggtcctgccccagggagcatgacattcaggcccagaaattgcatcgtgctgcacacagtccaaggggataaccctgtgaagttcaggtcaccagcaggcttggggtcaagaccgagctgcagaggacaggtttctggaaggcacagcatcatgggtggagggacttggagcaaggtccttagccccgggaccagtgaatgtgtgcccttatagggaaagggggtctgtgcagaagcaagttagctgaaaatcatgaagtggagaggctcccctggattaaaggggtgagccctaatgtaatcacaagtgtccttctaggaggttggcagagggagactgacatagacagaagccaggtgaggtgggaagcggaggcagaggccgagagagcagacgctacgccctggccctgaagacggaggaggagccgagagctcagggatggagagactggaggaggcagggaagttctccccgcaagcctggagggagcatggcctccagcacccccagaccttggccctgcaggattcatctggacctgtggtataaatggtgtttaagccactgggctgtgcaaattgtcatagcagccatggcgcattcctagagggagccctggtggggacccagcaggcagcgacggggccctcacaagcctgtgagccactcagagccgcgagagtggctaggcttggtgaggtgcaggccacgcgcacctccactaaggcagccttagggcccacacatcctctctctctctctctctctctctctctatctctctccctccctccttccctccctcccgctctcttggttggacagctctccatcatccccctggacacgaccacctcccaaggccgagctggggcgctttgctcgaggtgagcactgacatcctgggggtgtgaggggcacctgcccagcggccccgtgtgcaggatgggcggtgggccctagctggcactgggcatatggcccggctggtgcctgcaggctgcagcttttctggggtggctgggatcagtgaaggcctccagagtctgggcctgggatccctgcagtgctggctgaggacaggcggggctgggcagtgagggcactgggtcactatcaccacccacggtttattacttcactaggtgggacctggcacccctgccttcctgacaccctggaatccctgcctcctcctacagcccccaagcccatctccctcagagcctccagagacagacctggggaggcatttcttctgcccccagcagaagcccgggaggccgggaaggcacagtgggtctaaaggagaggatcccaggactgcctgaggggtgactccgacgaggcaagcatagagcccactgagaagcggggtgggagccccaccagggatgggctagttcctcatgaaggaccaggacccaggaaggacaagggggcctgctggggcagggtctgctatgccggagtccctgtgagcctggcccagacctgcctctctctttcctcattggtccccacaggtccgtggtggttgccgtatcgggaggccccatggtggcaggggtgggacacctggtatacgtcgccaggtgtgtccaataggctcatgctcacaccttctcctggcacctgggcaaagcctgagcacccaggcactgaagtgagggcaaggcctcggggccccacaggatggccgaggagacagctgcagggcgcctgggacccctgggctcaggaggtagaaggatacagcctgaaaacccacaccacaagctcaccggccagtgcaggcccacagagctcgaggaggcagccctgagcctcccagggagagatgctctgtgcacgccggcacaggccctgggttacaaaccctaggcacagcccaggagaggcccaggccccagtccagcaaggggttgcaggaagcaagaggtccccggccacagcatgagataagcccatcaagccagggccaggtgggcaatgggaggcaggcagggcttgggggtgagtccctgctgcagcgccgtccactgtcgaccggaggagtttcttccctgtgcggagtccacgggcctcctgtgagtgtgtgcatgggcacaagtgtgtgtgtggctctgctgtgtgtctgtacacacgtatgttttgggtttttttgtgtctcagaccacagagtctgcccctcccaccaaagcccaggcagaaggatgaacccacgcccctggggcccaggcctcagcagcctctgcaggatcattgttcccagttgtcacttgcctttgccacagccctatttctccacaattccttaaagtcctcaacatgcatttaaggcacaaaggtgaaactgcccagaaacatctgactccgccgtggaacccaggagcaagctgggttagctaaggagcggggccgttggcagaggctggggatccaggctgaactttggaggaggcatgtgccagcatgggctcctgactatgtcctcctgggacaaacccaaacccactctttgaatatgggagggactttgctggccccggccctgaccgcagcacttggaaactgaggagtggtcgcctcctccgtgtcacagctgcccgttcaccatcatagaagcaactctgtcacctccatgggcccctctgtggctgctgcctgggtccaagctgagcccagctgcccaggcccagaaggaaagcccaggccaggtgcccagcacagaggcagtcacataccccggggagagccacagcaagcagccaatgttgcccaggagaggagtagctgacaaggtagaacgtgagctgccatcggctcgagaggctttgctggtcctcctggggctctggacatgaccaggaggagcgagggaagaagtcgcatggtggtcccatcctgggtggggcctgatggcagctggccacccgtcccagagtggcagccagatgccagcgccattcccacagtcacatcattggtcacagaatgcaggacatagagtgtcttctttccatcacagtgctgtccagacccatagcctagggtagacctggaagattcaatgtccacacccggggctggagcgtagccatgagccacgccccctgcccgtgcatggaaagccagcccaagctctgctccatccctagccaaagtcagtgtcctttccccttctcccaagtgagctctagccacctgcctaccctgccatctgaggatgacagccttcattccattggaacctggctctgccaccagcaggcttgcagtcctgggcagactccgtcacctctctatgcctcagcctttccatctgcacaggaggaagatgatgatggtggtgatgatgatggcgatggtttccttttgcatctgaggcaaggactaattgagatgatacacatcaggcactgggtatggtgctggtccttcctgagcactcaatctatgtgagctgtccttgtgaaatgggtgtcaccacatttccccacgcagaacatcctttgtctgccatacttgaaacatctgccccaatattaacagttccttcatggaagatgtgcacacccacccaccctcatactcccaaaggtgcccgtgctttatcaagccaaagtccagccaggaactttacagcagcatccctttccctctccaagcaccaaggagcaaggcaaagcactacatcttccatctggaggcaatgccaccctcttctcccattttcactgccatccctaagaggcagtgcttccccaaaaggttccatagcagcctgcctacagcaactctgttcacacgagtttcagcatccttgcagtggctcccctgccatgctgtggctcttcattcaccctcttctcctgctccccgtgacaggcatagattctgagtgatctggatacattgctttgtttaataacattacagcttctgtgctgaaaaagatacagcagatagagaaggcaattgttgaacacaaaatagtgacagcagagatgacggcaagttggcatttttcttttctagcaataaaacttaaagctgactcaaggagaaatggaaatcataattggaacagtaatcctcaagaaagcattaagattattaaataattgccctcacagatgacttcaggccaagatggctttatgggtgaagtttagactttcacaaaactaatcagttcccataagaactgctccaggatttggaggaacatgggaaagtctattaaagggatcacaattcacagtccccagagtaaaacatgggctaacttgcattttggcaaagagccaaatgttataaatgacatcctagaaggccaaattctgtccatctcgttgaacaaggacttacaccaggaatttagaactatttatagctcatcccaccactcaggccaatgatgacccatgatcatctcaccagaaatggaaagactcagatgattaatagagtctcaatttctctgagacatctaagagcccagcccaagcccagacccaggagggcacccaggcctggacagagaacactgatatcacaccagccctccagagggaagcagagactccttcaagctctggaaacacaggcccagacagctgcctaaagttgggcaggcttcactgcaaacccaaatcatgaagctaggtaacacctttacagattctttacatttaaaaatcatcaaaacaagagtaaataataaactcaaataatattaatctaatatgtaaaggtcttgtaccattattatgcaaacaacatacataagctaataagaaaaagaacaaatcccttaagaaatcggcaaaaaggatataacacaatttctaaaagaaaacaaatggctagcacacataaggaaaacactttgtgaacagacattcttcagaacattatttataattataaaatagttgaaagcaagatagtgcctgaagaaattatggtgcatacattagtgggactattctgcaaacattcccaattatacttgtcacatatctgtgataacgtgacagccagcattcatggggtgacctcatttggtaaaagggtgcaaagctcaacacgcattgtgagatgactgtggtgtaaaattagtgggattattccgcaaacattcccaattatacttaccgcatatctgtgataacatgacagcattcatggggtgacctcatttggtaaaagggtgcaaagctcaacacgcattgtgagatgactggtgtaaatacaaagaccaaactgtgaaaaggagtccatcaattaatcgatgcttaccttcagttttgggctaatttttaaagtatgctataagcatatgctcctgttataacagaatggagggattatgagagatgatgcaggtgtgtcctgggcctcccctggcccactgggccctagagatgccttcccaggcatcgctgtcagggcttccctcagagggagtcctgtattgacctcaccaccaaggtctggagcaggggatccttagatattggttggggttatctcaccttaggtctgaatttggggttgtcttagactgttttgtgctgttagaatagaatacccaagactgggaaatttatactgaacggaaatttatttctcacagttctagaggctgtgaagtccaagagcacaggtgccagagcaagtccaagagcaagggaaagtccaaagcaagtccaggagcatctggcgaggaccttcttgctgtgtcatcacatggcggaaggcaagaaagagagcaagagggggccgaactcacccttttataacagcaccaatcccacccatgaggtggggaccttatgacctaatcactcttcatactgttacaatggcaatgaaatttcaacatgagttttggaggagagaagcattcaaaccacagcaagggtgctcctacctcctctctcagggcatctgcagaaagagctgcaactgcacgtccttcctccgtccatcctccatcccttcccaatgtccgtgcatatcctgtgacccaggaggtctggcatagggggtgctcctgccttaggtctgaggccctgtctgaagaggggtaggtgaggaggccatctgatggtctgggccaagacagtcacaggacgcatcatttatcatcaaggaggctgagggttgagtctccaggtccagggaactccccacaaagtgggaaccctgcccagctccacacagcctctgctgggggaccctgctctggtgcagagcctggggacaggtcttgagctcagccagagtctgcctccctgtcatttaggaactaaaccaagcggcaggatgctggagcccagcccccatctgaccttacagggccaaggctggggccctgggttcccctcaaggcgcagcaggactggagccccaggcagtgcaggagtggccaaagctggggcttcctccagagcccccaagcatcacggcaccaagaagggtaggaccctggcctgaggaattggcaccaaagccccagaaactaccctggacaccatggagagaggcctggaggggaagcaccaggcactgcctccccttctgatcccacctgaggtggctgccaagcccagagagccgctctgatgtcccccagccctgcagcccagggatacctgtactgtgcccctgggggacccctggccagtctgtgcaaagaagtcaccaccctacactcagagacagtgggggtcctcgtcccacatcctcagagcatggcccggctgctgcagggatggtctcctggtcctcagagcatggcccggctgctgcagggatggtctcctggtcctcagagcatggcccagctgctgcagggatggtctcctggaggccccccagtgctctattgtcagggctccctccaccccccgcaccaagagagagccagaccccagcaaggcttccagtggcttcaggtcacacccctaggctgaccccagccccattaacacctgcctgagaaagctccacgcaccagaactgaccgtctgctccaactcttgacctcccgttctcagggcgtctgctgaaaaggctgcaactgcacatccttcctccgtccgttcccgatgtccgtgtgtctcctgtggccaggaaggtctttctcgggacctgagagccgctccctgaagtgtccccattgggaaggatggggcctgtgtctccaggctctgggaggacagaatcctgacctcaacagtggccggcacggacacaactggccccatcccggggacgctgaccagcgctgggcaacttttcccttccccgacgactgagccccgagcaccctccctgctcccctaccacctccctttacaaggctgtggcctctgcacagatgataatggagcttggctcattcccctagagtcggtagggagttaaggacaaaactcagtttcctccacctgaactcaagtctgcctatgtttacctaatcacacctggtggacagtttggacaaacttgcacactcagagacacagacacttctagaaatcattatctccctgccccggggaccccactccagcagaagtctgctaggcactggcctgggccctcctgctgtcctaggaggctgctgacctcctgcctggctcctgtccccaggtccagagtcagagcagactccagggacgctgcaggctaggaagccgccccctccaggcgagggtctagtgcaggtgcccaggacaagaaagattgtgaatgcaggaatgactgggccacacccctcccgtgcacgccccctcctgccctgcaccccacagcccagccccccgtgctggatgcccccccacagcagaggtgctgttctgtgatcccctgggaaagacgccctcaacctccaccctgtcccacggcccaaggaagacaagacacaggccctctcctcacagtctccccacctggctcctgctgggaccctcaaggtgtgaacagggaggatggttgtctgggtggcccctaggagcccagatcttcactccacagaccccaacccaagcacccccttctgcagggcccagctcatccccctcctcctccctctgctctcctctcgtcgcctctacgggaaatccgggactcagcagtaaccctcaggaagcagggcccaggcgccgtttaataggaggcttcctcacaatgaaacttttagaaagccttgactacaatgatgaccttggtgtggctgtgaacactgtcagctcccacagctgctgcagcaaaaaatgtccatagacagggtgggggcccggggtcgtctgctgtcctgctcagcccacagcacgcatggaggatctgaggtgccacacctgacgcccaggccagaacatgcctccctccagggtgacctgccatgtcctgcattgctggagggacaggggcagcctatgaggatctggggccaggagatgaatcctattaacccagaggaaaactaacaggacccaagcaccctccccgttgaagctgacctgcccagaggggcctgggcccaccccacacaccggggcggaatgtgtacaggccccggtctctgtgggtgttccgctaactggggctcccagtgctcaccccacaactaaagcgagccccagcctccagagcccccgaaggagatgccgcccacaagcccagcccccatccaggaggccccagagctcagggcgccggggcagattctgaacagccccgagtcacggtgggtacaactggaacgaccaccgtgagaaaaactgtgtccaaaactctctcctggcccctgctggaggccgcgccagagaggggagcagccgccccgaacctaggtcctgctcagctcacacgacccccagcagccagagcacagtggagtccccactgaaccccactgaatggtgaggacggggaccagggctccagggggtcatggaaggggctggaccccatcctactgctatggtcccagtgctcctggccagaactgaccctaccaccgacaagagtccctcagggaaacgggggtcactggcacctcccagcatcaaccccaggcagcacaggcataaaccccacatccagagccgactccaggagcagagacaccccagtaccctgggggacaccgaccctgatgactccccactggaatccaccccagagtccaccaggaccaaagaccccgccccggtctctgtccctcactcaggacctgctgcggggcgggccatgagaccagactcgggcttagggaacaccactgtggccccaacctcgaccaggccacaggcccttccttcctgccctgcggcagcacagactttggggtctgtgcagagaggaatcacagaggccccaggctgaggtggtgggggtggaagacccccaggaggtggcccacttcccttcctcccagctggaacccaccatgaccttcttaagataggggtgtcatccgaggcaggtcctccatggagctcccttcaggctcctccctggtcctcactaggcctcagtcccggctgtgggaatgcagccaccacaggcacaccaggcagcccagacccagccagcctgcagtgcccaagcccacattctggagcagagcaggctgtgtctgggagagtctgggctccccaccgcccccggcacaccccacccacccctgtccaggccctatgcaggagggtcagagccccccatggggtatggacttagggtctcactcacgcggctcccctcctgggtgaaggggtctcatgcccagatccccacagcagagctggtcaaaggtggaggcagtggccccagggccaccctgacctggaccctcaggctcctctagccctggctgccctgctgtccctgggaggcctggactccaccagaccacaggtccagggcaccgcccataggtgctgcccacactcagttcacaggaagaagataagctccagacccccaagactgggacctgccttcctgccaccgcttgtagctccagacctccgtgcctcccccgaccacttacacacgggccagggagctgttccacaaagatcaaccccaaaccgggaccgcctggcactcgggccgctgccacttccctctccatttgctcccagcacctctgtgctccctccctcctccctccttcaggggaacagcctgtgcagcccctccctgcaccccacaccctggggaggcccaaccctgcctccagccctttctcccccgctgctcttcctgcccatccagacaaccctggggtcccatccctgcagcctacaccctggtctccacccagacccctgtctctccctccagacacccctcccaggccaaccctgcacatgcaggccctccccttttctgctgccagagcctcagtttctaccctctgtgcctaccccctgcctcctcctgcccacaactcgagctcttcctctcctggggcccctgagccatggcactgaccgtgcactcccacccccacactgcccatgccctcaccttcctcctggacactctgaccctgctcccctcttggacccagccctggtatttccaggacaaaggctcacccaagtcttccccatgcaggcccttgccctcactgcccggttacacggcagcctcctgtgcacagaagcagggagctcagcccttccacaggcagaaggcactgaaagaaatcggcctccagcaccctgatgcacgtccgcctgtgtctctcactgcccgcacctgcagggaggctcggcactccctgtaaagacgagggatccaggcagcaacatcatgggagaatgcagggctcccagacagcccagccctctcgcaggcctctcctgggaagagacctgcagccaccactgaacagccacggagcccgctggatagtaactgagtcagtgaccgacctggagggcaggggagcagtgaaccggagcccagaccatagggacagagaccagccgctgacatcccgagcccctcactggcggccccagaacaccgcgtggaaacagaacagacccacattcccacctggaacagggcagacactgctgagcccccagcaccagccctgagaaacaccaggcaacggcatcagagggggctcctgagaaagaaaggaggggaggtctccttcaccagcaagtacttcccttgaccaaaaacagggtccacgcaactcccccaggacaaaggaggagccccctgtacagcactgggctcagagtcctctccaacacaccctgagtttcagacaaaaaccccctggaaatcatagtatcagcaggagaactagccagagacagcaagaggggactcagtgactcccgcggggacaggaggattttgtgggggctcgtgtcactgtgaggatattgtagtagtaccagctgctatgcccacagtgacacagccccattcccaaagccctgctgtaaacgcttccacttctggagctgaggggctggggggagcgtctgggaagtagggcctaggggtggccatcaatgcccaaaacgcaccagactcccccccagacatcaccccactggccagtgagcagagtaaacagaaaatgagaagcagctgggaagcttgcacaggccccaaggaaagagctttggcgggtgtgcaagaggggatgcgggcagagcctgagcagggccttttgctgtttctgctttcctgtgcagatagttccataaactggtgttcaagatcgatggctgggagtgagcccaggaggacagtgtgggaagggcacagggaaggagaagcagccgctatcctacactgtcatctttcaagagtttgccctgtgcccacaatgctgcatcatgggatgcttaacagctgatgtagacacagctaaagagagaatcagtgaaatggatttgcagcacagatctgaataaattctccagaatgtggagccacacagaagcaagcacaaggaaagtgcctgatgcaagggcaaagtacagtgtgtaccttcaggctgggcacagacactctgaaaagccttggcaggaactccctgcaacaaagcagagccctgcaggcaatgccagctccagagccctccctgagagcctcatgggcaaagatgtgcagaacatatgtttgtcatagccccaaactgagaatgaagcaaacagccatctgaaggaaaacaggcaaataaacgatggcaggttcatgaaatgcaaacccagacagccagaaggacaacagtgagggttacaggtgactctgtggttgagttcatgacaatgctgagtaattggagtaacaaaggaaagtccaaaaaatactttcaatgtgatttcttctaaataaaatttacagccggcaaaatgaactatcttcttaagggataaactttccactaggaaaactataaggaaaatcaagaaaaggatgatcacataaacacagtggtcgttacttctactggggaaggaagagggtatgaactgagacacacagggttggcaagtctcctaacaagaagagaacaaatacattacagtaccttgaaaacagcagttaaaattctaaattgcaagaagaggaaaatgcacacagctgtgtttagaaaattctcagtccagcactgttcataatagcaaagacattaacccaggttggataaataaacgatgacacaggcaattgcacaatgatacagacatacattcagtatatgagacattgatgatgtatccccaaagaaatgactttaaagagaaaaggcctgatatgtggtggcactcacctccctgggcatccccggacaggctgcaggcacactgtgtggcagggcaggctggtacctgctggcagctcctggggcctgatgtggagcaggcacagagccgtatccccccgaggacatatacccccaaggacggcacagttggtacattccggagacaagcaactcagccacactcccaggccagagcccgagagggacgcccatgcacagggaggcagagcccagctcctccacagccagcagcacctgtgcaggggccgccatctggcaggcacagagcatgggctgggaggaggggcagggacaccaggcagggttggcaccaactgaaaattacagaagtctcatacatctacctcagccttgcctgacctgggcctcacctgacctggacctcacctggcctggacctcacctggcctagacctcacctctgggcttcacctgagctcggcctcacctgacttggaccttgcctgtcctgagctcacatgatctgggcctcacctgacctgggtttcacctgacctgggcttcacctgacctgggcctcatctgacctgggcctcactggcctggacctcacctggcctgggcttcacctggcctcaggcctcatctgcacctgctccaggtcttgctggaacctcagtagcactgaggctgcaggggctcatccagggttgcagaatgactctagaacctcccacatctcagctttctgggtggaggcacctggtggcccagggaatataaaaagcctgaatgatgcctgcgtgatttgggggcaatttataaacccaaaaggacatggccatgcagcgggtagggacaatacagacagatatcagcctgaaatggagcctcagggcacaggtgggcacggacactgtccacctaagccaggggcagacccgagtgtccccgcagtagacctgagagcgctgggcccacagcctcccctcggtgccctgctacctcctcaggtcagccctggacatcccgggtttccccaggcctggcggtaggtttggggtgaggtctgtgtcactgtggtattacgatttttggagtggttattatacccacagtgtcacagagtccatcaaaaacccatccctgggaacctgctgccacagccctccctgtggggcaccgccgcgtgccatgttaggattttgactgaggacacagcaccatgggtatggtggctaccgcagcagtgcagcctgtgacccaaacacacagggcagcaggcacaacagacaagcccacaagtgaccaccctgagctcctgcctgccagccctggagaccatgaaacagatggccaggattatcccataggtcagccagacctcagtccaacaggtctgcatcgctgctgccctccaataccagtccggatggggacagggccggcccacattaccatttgctgccatccggccaacagtcccagaagcccctccctcaaggctgggccacatgtgtggaccctgagagccccccatgtctgagtaggggcaccaggaaggtggggctggccctgtgcactgtcactgcccctgtggtccctggcctgcctggccctgacacctgggcctctcctgggtcatttccaagacagaagacattcccaggacagctggagctgggagtccatcatcctgcctggccatcctgagtcctgcgcctttccaaacctcacccgggaagccaacagaggaatcacctcccacaggcagagacaaagaccttccagaaatctctgtctctctccccagtgggcaccctcttccagggcagtcctcagtgatatcacagtgggaacccacatctggatcgggactgcccccagaacacaagatggcccacagggacagccccacagcccagcccttcccagacccctaaaaggcgtcccaccccctgcatctgccccagggctcaaactccaggaggactgactcctgcacaccctcctgccagacatcacctcagcccctcctggaagggacaggagcgcgcaagggtgagtcagaccctcctgccctcgatggcaggcggagaagattcagaaaggtctgagatccccaggacgcagcaccactgtcaatgggggccccagacgcctggaccagggcctgcgtgggaaaggcctctgggcacactcaggggctttttgtgaagggtcctcctactgtgtgactacagtaactaccacagtgatgaacccagcagcaaaaactgaccggactcccaaggtttatgcacacttctccgctcagagctctccaggatcagaagagccgggcccaagggtttctgcccagaccctcggcctctagggacatcttggccatgacagcccatgggctggtgccccacacatcgtctgccttcaaacaagggcttcagagggctctgaggtgacctcactgatgaccacaggtgccctggccccttccccgccagctgcaccagaccccgtcctgacagatgccccgattccaacagccaattcctggggccaggaatcgctgtagacaccagcctccttccaacacctcttgccaattgcctggattcccatcccggttggaatcaagaggacagcatcccccaggctcccaacaggcaggactcccacaccctcctctgagaggccgctgtgttccgtagggccaggctgcagacagtccccctcacctgccactagacaaatgcctgctgtagatgtccccacctggaaaagaccactcatggagcccccagccccaggtacagccatagagagagtctctgaggcccctaagaagtagccatgcccagttctgccgggaccctcggccaggctgacaggagtggacgctggagctgggcccacactgggccacataggagctcaccagtgagggcaggagagcacatgccggggagcacccagcctcctgctgaccagaggcccgtcccagagcccaggaggctgcagaggcctctccagggggacactgtgcatgtctggtccctgagcagccccccatgtccccagtcctgggggcccctggcacagctgtctggaccctctctattccctgggaagctcctcctgacagccccgcctccagttccaggtgtggttattgtcagggggtgtcagactgtggtggatacagctatggttaccacagtggtgctgcccatagcagcaaccaggccaagtagacaggcccctgctgtgcagccccaggcctccagctcacctgcttctcctggggctctcaaggctgctgttttctgcactctcccctctgtggggagggttccctcagtgggagatctgttctcaacatcccagggcctcattcctgcaaggaaggccaatggatgggcaacctcacatgccgcggctaagatagggtgggcagcctggcggggacaggacatcctgctggggtatctgtcactgtgcctagtggggcactggctcccaaacaacgcagtcctcgccaaaatccccacggcctcccccgctaggggctggcctgatctcctgcagtcctaggaggctgctgacctccagaatggctccgtccccagttccagggcgagagcagatcccaggccggctgcagactgggaggccaccccctccttcccagggttcactgcaggtgaccagggcaggaaatggcctgaacacagggataaccgggccatcccccaacagagtccaccccctcctgctctgtaccccgcacccccaaggccagcccatgacatccgacaaccccacaccagagtcactgcccggtgctgccctagggaggacccctcagcccccaccctgtctagaggactggggaggacaggacacgccctctccttatggttcccccacctggctctggctgggacccttggggtgtggacagaaaggacgcttgcctgattggcccccaggagcccagaacttctctccagggaccccagcccgagcacccccttacccaggacccagccctgcccctcctcccatctgctctcctctcatcaccccatgggaatccagaatccccaggaagccatcaggaagggctgagggaggaagtggggccactgcaccaccaggcaggaggctccgtctttgtgaacccagggaggtgccagcctcctagagggtatggtccaccctgcctatggctcccacagtggcaggctgcagggaaggaccagggacggtgtgggggagggctcagggccccgcgggtgctccatcttggatgagcccatctctctcacccacggactcacccacctcctctccaccctggccacacgtcgtccacaccatcctaagtcccacctacaccagagccggcacagccagtgcagacagaggctggggtgcaggggggccgccagggcagctttggggagggaaggatggaggaaggggagttcagtgaagaggcccccctcccctgggtccaggatcctcctctgggacccccggatcccatcccctccaggctctgggaggagaagcaggatgggagaatctgtgcgggaccctctcacagtggaatacctccacagcggctcaggcaagacccaaaagcccctcagtgagccctccactgcagtcctgggcctgggtagcagcccctcccacagaggatgaacccagcaccccgaggatgtcctgccagggggagctcagagccatgaaggagcaggatatgggacccccgatacaggcacagacctcagctccattcaggactgccacgtcctgccctgggaggaacccctttctctagtccctgcaggccaggaggcagctgactcctgacttggacgcctattccagacaccagacagaggggcaggccccccagaaccagggatgaggacgccccgtcaaggccagaaaagaccaagttgtgctgagcccagcaagggaaggtccccaaacaaaccaggaagtttctgaaggtgtctgtgtcacagtggagtatagcagctcgtcccacagtgacactcgccaggccagaaaccccatcccaagtcagcggaatgcagagagagcagggaggacatgtttaggatctgaggccgcacctgacacccaggccagcagacgtctcctgtccatggcaccctgccatgtcctgcatttctggaagaacaagggcaggctgaagggggtccaggaccaggagatgggtcccctctacccagagaaggagccaggcaggacacaagccccctccccattgaggctgacctgcccagagggtcctgggcccaccccacacaccggggcggaatgtgtgcaggcctcggtctctgtgggtgttccgctagctggggctcacagtgctcaccccacacctaaaacgagccacagcctcagagcccctgaaggagaccccgcccacaagcccagcccccacccaggaggccccagagcacagggcgccccgtcggattctgaacagccccgagtcacagtgggtataactggaactaccactgtgagaaaagcttcgtccaaaacggtctcctggccacagtcggaggccccgccagagaggggagcagccaccccaaacccatgttctgccggctcccatgaccccgtgcacctggagccccacagtgtccccactggatgggaggacaagggccgggggctccggcgggtcggggcaggggcttgatggcttccttctgccgtggctccagtgcccctggctggagttgacccttctgacaagtgtcctcagagagtcagggatcagtggcacctccctaacatcaaccccacgcagcgcaggcacaaaccccacatccagggccaactccaggaacagagacaccccaataccctgggggaccccaaccctgatgactcccgtcccatctctgtccctcacttggggcctgctgcggggcgagcacctgggagcaaactcaggattaggggacaccactgtgggcctgacctcgagcaggccacagacccttccctcctgccctggtgcagcacagactttggggtctgggcagggaggaacttctggcaggtcaccaagcacagagcccccaggctgaggtggccccagggggaaccccagcaggtggcccactacccttcctcccagctggaccccatgtcttccccaagataggggtgccatccaaggcaggtcctccatggagcccccttcaggctcctctccagaccccactgggcctcagtccccactctaggaatgcagccaccacgggcacaccaggcagcccaggcccagccaccctgcagtgcccaagcccacaccctggaggagagcagggtgcgtctgggaggggctgggctccccacccccacccccacctgcacaccccacccacccttgcccgggccccctgcaggagggtcagagcccccatgggatatggacttagggtctcactcacgcacctcccctcctgggagaaggggtctcatgcccagatccccccagcagcgctggtcacaggtagaggcagtggccccagggccaccctgacctggcccctcaggctcctctagccctggctgccctgctgtccctgggaggcctgggctccaccagaccacaggtctagggcaccgcccacactggggccgcccacacacagctcacaggaagaagataagctccagacccccaggcccgggacctgccttgctgctacgacttcctgccccagacctcgttgccctcccccgtccacttacacacaggccaggaagctgttcccacacagaccaaccccagacggggaccacctggcactcaggtcactgccatttccttctccattcacttccaatgcctctgtgcttcctccctcctccttccttcgggggagcaccctgtgcagctcctccctgcagtccacaccctggggagacccgaccctgcagcccacaccctggggagacctgaccctcctccagccctttctcccccgctgctcttgccacccaccaagacagccctggggtcctgtccctacagcccccacccagttctctacctagacccgtcttcctccctctaaacacctctcccaggccaaccctacacctgcaggccctcccctccactgccaaagaccctcagtttctcctgcctgtgcccacccccgtgctcctcctgcccacagctcgagctcttcctctcctagggcccctgagggatggcattgaccgtgccctcgcacccacacactgcccatgccctcacattcctcctggccactccagccccactcccctctcaggcctggctctggtatttctgggacaaagccttacccaagtctttcccatgcaggcctgggcccttaccctcactgcccggttacagggcagcctcctgtgcacagaagcagggagctcagcccttccacaggcagaaggcactgaaagaaatcggcctccagcgccttgacacacgtctgcctgtgtctctcactgcccgcacctgcagggaggctcggcactccctctaaagacgagggatccaggcagcagcatcacaggagaatgcagggctaccagacatcccagtcctctcacaggcctctcctgggaagagacctgaagacgcccagtcaacggagtctaacaccaaacctccctggaggccgatgggtagtaacggagtcattgccagacctggaggcaggggagcagtgagcccgagcccacaccatagggccagaggacagccactgacatcccaagccactcactggtggtcccacaacaccccatggaaagaggacagacccacagtcccacctggaccagggcagagactgctgagacccagcaccagaaccaaccaagaaacaccaggcaacagcatcagagggggctctggcagaacagaggaggggaggtctccttcaccagcaggcgcttcccttgaccgaagacaggatccatgcaactcccccaggacaaaggaggagccccttgttcagcactgggctcagagtcctctccaagacacccagagtttcagacaaaaaccccctggaatgcacagtctcagcaggagagccagccagagccagcaagatggggctcagtgacacccgcagggacaggaggattttgtgggggctcgtgtcactgtgaggatattgtactaatggtgtatgctatacccacagtgacacagccccattcccaaagccctactgcaaacgcattccacttctggggctgaggggctgggggagcgtctgggaaatagggctcaggggtgtccatcaatgcccaaaacgcaccagactcccctccatacatcacacccaccagccagcgagcagagtaaacagaaaatgagaagcaagctggggaagcttgcacaggccccaaggaaagagctttggcgggtgtgtaagaggggatgcgggcagagcctgagcagggccttttgctgtttctgctttcctgtgcagagagttccataaactggtgttcgagatcaatggctgggagtgagcccaggaggacagcgtgggaagagcacagggaaggaggagcagccgctatcctacactgtcatctttcgaaagtttgccttgtgcccacactgctgcatcatgggatgcttaacagctgatgtagacacagctaaagagagaatcagtgagatggatttgcagcacagatctgaataaattctccagaatgtggagcagcacagaagcaagcacacagaaagtgcctgatgcaaggacaaagttcagtgggcaccttcaggcattgctgctgggcacagacactctgaaaagccctggcaggaactccctgtgacaaagcagaaccctcaggcaatgccagccccagagccctccctgagagcctcatgggcaaagatgtgcacaacaggtgtttctcatagccccaaactgagagcaaagcaaacgtccatctgaaggagaacaggcaaataaacgatggcaggttcatgaaatgcaaacccagacagccacaagcacaaaagtacagggttataagcgactctggttgagttcatgacaatgctgagtaattggagtaacaaagtaaactccaaaaaatactttcaatgtgatttcttctaaataaaatttacaccctgcaaaatgaactgtcttcttaagggatacatttcccagttagaaaaccataaagaaaaccaagaaaaggatgatcacataaacacagtggtggttacttctgctggggaaggaagagggtatgaactgagatacacagggtgggcaagtctcctaacaagaacagaacgaatacattacagtaccttgaaaacagcagttaaacttctaaattgcaagaagaggaaaatggacacagttgtgtttagaaaattctcagtccagcactgttcataatagcaaagacattaacccaggtcggataaataagcgatgacacaggcaattgcacaatgatacagacatatatttagtatatgagacatcgatgatgtatccccaaataaacgactttaaagagataaagggctgatgtgtggtggcattcacctccctgggatccccggacaggttgcaggctcactgtgcagcagggcaggcgggtacctgctggcagttcctggggcctgatgtggagcaagcgcagggccatatatcccggaggacggcacagtcagtgaattccagagagaagcaactcagccacactccccaggcagagcccgagagggacgcccacgcacagggaggcagagcccagcacctccgcagccagcaccacctgtgcacgggccaccaccttgcaggcacagagtgggtgctgagaggaggggcagggacaccaggcagggtgagcacccagagaaaactgcagacgcctcacacatccacctcagcctcccctgacctggacctcactggcctgggcctcacttaacctgggcttcacctgaccttggcctcacctgacttggacctcgcctgtcccaagctttacctgacctgggcctcaactcacctgaacgtctcctgacctgggtttaacctgtcctggaactcacctggccttggcttcccctgacctggacctcatctggcctgggcttcacctggcctgggcctcacctgacctggacctcatctggcctggacctcacctggcctggacttcacctggcctgggcttcacctgacctggacctcacctggcctcgggcctcacctgcacctgctccaggtcttgctggagcctgagtagcactgagggtgcagaagctcatccagggttggggaatgactctagaagtctcccacatctgacctttctgggtggaggcagctggtggccctgggaatataaaaatctccagaatgatgactctgtgatttgtgggcaacttatgaacccgaaaggacatggccatggggtgggtagggacatagggacagatgccagcctgaggtggagcctcaggacacaggtgggcacggacactatccacataagcgagggatagacccgagtgtccccacagcagacctgagagcgctgggcccacagcctcccctcagagccctgctgcctcctccggtcagccctggacatcccaggtttccccaggcctgccggtaggtttagaatgaggtctgtgtcactgtggtattacgatattttgactggttattataaccacagtgtcacagagtccatcaaaaacccatgcctggaagcttcccgccacagccctccccatggggccctgctgcctcctcaggtcagccccggacatcccgggtttccccaggctgggcggtaggtttggggtgaggtctgtgtcactgtggtattactatggttcggggagttattataaccacagtgtcacagagtccatcaaaaacccatccctgggagcctcccgccacagccctccctgcaggggaccggtacgtgccatgttaggattttgatcgaggagacagcaccatgggtatggtggctaccacagcagtgcagcctgtgacccaaacccgcagggcagcaggcacgatggacaggcccgtgactgaccacgctgggctccagcctgccagccctggagatcatgaaacagatggccaaggtcaccctacaggtcatccagatctggctccgaggggtctgcatcgctgctgccctcccaacgccagtccaaatgggacagggacggcctcacagcaccatctgctgccatcaggccagcgatcccagaagcccctccctcaaggctgggccacatgtgtggacactgagagccctcatgtctgagtaggggcaccaggagggaggggctggccctgtgcactgtccctgcccctgtggtccctggcctgcctggccctgacacctgagcctctcctgggtcatttccaagacagaagacattcctggggacagccggagctgggcgtcgctcatcctgcccggccgtcctgagtcctgctcatttccagacctcaccggggaagccaacagaggactcgcctcccacattcagagacaaagaaccttccagaaatccctgcctctctccccagtggacaccctcttccaggacagtcctcagtggcatcacagcggcctgagatccccaggacgcagcaccgctgtcaataggggccccaaatgcctggaccagggcctgcgtgggaaaggtctctggccacactcgggctttttgtgaagggccctcctgctgtgtgactacagtaactaccatagtgatgaacccagtggcaaaaactggctggaaacccaggggctgtgtgcacgcctcagcttggagctctccaggagcacaagagccgggcccaaggatttgtgcccagaccctcagcctctagggacacctgggccatctcagcctgggctggtgccctgcacaccatcttcctccaaataggggcttcagagggctctgaggtgacctcactcatgaccacaggtgacctggcccttccctgccagctataccagaccctgtcttgacagatgccccgattccaacagccaattcctgggaccctgaatagctgtagacaccagcctcattccagtacctcctgccaattgcctggattcccatcctggctggaatcaagaaggcagcatccgccaggctcccaacaggcaggactcccgcacaccctcctctgagaggccgctgtgttccgcagggccaggccctggacagttcccctcacctgccactagagaaacacctgccattgtcgtccccacctggaaaagaccactcgtggagcccccagccccaggtacagctgtagagagagtcctcgaggcccctaagaaggagccatgcccagttctgccgggaccctcggccaggccgacaggagtggacgctggagctgggcccacactgggccacataggagctcaccagtgagggcaggagagcacatgccggggagcacccagcctcctgctgaccagaggcctgccccagagcccaggaggctgcagaggcctctccagggagacactgtgcatgtctggtacctaagcagccccccacgtccccagtcctgggggcccctggctcagctgtctggaccctccctgttccctgggaagctcctcctgacagccccgcctccagttccaggtgtggttattgtcaggcgatgtcagactgtggtggatatagtggctacgattaccacagtggtgccgcccatagcagcaaccaggccaagtagacaggcccctgctgcgcagccccaggcatccacttcacctgcttctcctggggctctcaaggctgctgtctgtcctctggccctctgtggggagggttccctcagtgggaggtctgtgctccagggcagggatgattgagatagaaatcaaaggctggcagggaaaggcagcttcccgccctgagaggtgcaggcagcaccacggagccacggagtcacagagccacggagcccccattgtgggcatttgagagtgctgtgcccccggcaggcccagccctgatggggaagcctgtcccatcccacagcccgggtcccacgggcagcgggcacagaagctgccaggttgtcctctatgatcctcatccctccagcagcatcccctccacagtggggaaactgaggcttggagcaccacccggccccctggaaatgaggctgtgagcccagacagtgggcccagagcactgtgagtaccccggcagtacctggctgcagggatcagccagagatgccaaaccctgagtgaccagcctacaggaggatccggccccacccaggccactcgattaatgctcaaccccctgccctggagacctcttccagtaccaccagcagctcagcttctcagggcctcatccctgcaaggaaggtcaagggctgggcctgccagaaacacagcaccctccctagccctggctaagacagggtgggcagacggctgtggacgggacatattgctggggcatttctcactgtcacttctgggtggtagctctgacaaaaacgcagaccctgccaaaatccccactgcctcccgctaggggctggcctggaatcctgctgtcctaggaggctgctgacctccaggatggctccgtccccagttccagggcgagagcagatcccaggcaggctgtaggctgggaggccacccctgcccttgccggggttgaatgcaggtgcccaaggcaggaaatggcatgagcacagggatgaccgggacatgccccaccagagtgcgccccttcctgctctgcaccctgcaccccccaggccagcccacgacgtccaacaactgggcctgggtggcagccccacccagacaggacagacccagcaccctgaggaggtcctgccagggggagctaagagccatgaaggagcaagatatggggcccccgatacaggcacagatgtcagctccatccaggaccacccagcccacaccctgagaggaacgtctgtctccagcctctgcaggtcgggaggcagctgacccctgacttggacccctattccagacaccagacagaggcgcaggccccccagaaccagggttgagggacgccccgtcaaagccagacaaaaccaaggggtgttgagcccagcaagggaaggcccccaaacagaccaggaggtttctgaaggtgtctgtgtcacagtggggtatagcagcagctggtaccacagtgacactcacccagccagaaaccccattccaagtcagcggaagcagagagagcagggaggacacgtttaggatctgagactgcacctgacacccaggccagcagacgtctcccctccagggcaccccaccctgtcctgcatttctgcaagatcaggggcggcctgagggggggtctagggtgaggagatgggtcccctgtacaccaaggaggagttaggcaggtcccgagcactctccccattgaggctgacctgcccagagagtcctgggcccaccccacacaccggggcggaatgtgtgcaggcctcggtctctgtgggtgttccgctagctggggctcacagtgctcaccccacacctaaaatgagccacagcctccggagcccccgcaggagaccccgcccacaagcccagcccccacccaggaggccccagagctcagggcgccccgtcggattccgaacagccccgagtcacagcgggtataaccggaaccaccactgtcagaatagctacgtcaaaaactgtccagtggccactgccggaggccccgccagagagggcagcagccactctgatcccatgtcctgccggctcccatgacccccagcacgcggagccccacagtgtccccactggatgggaggacaagagctggggattccggcgggtcggggcaggggcttgatcgcatccttctgccgtggctccagtgcccctggctggagttgacccttctgacaagtgtcctcagagagacaggcatcaccggcgcctcccaacatcaaccccaggcagcacaggcacaaaccccacatccagagccaactccaggagcagagacaccccaataccctgggggaccccgaccctgatgacttcccactggaattcgccgtagagtccaccaggaccaaagaccctgcctctgcctctgtccctcactcaggacctgctgccgggcgaggccttgggagcagacttgggcttaggggacaccagtgtgaccccgaccttgaccaggacgcagacctttccttcctttcctggggcagcacagactttggggtctgggccaggaggaacttctggcaggtcgccaagcacagaggccacaggctgaggtggccctggaaagacctccaggaggtggccactccccttcctcccagctggaccccatgtcctccccaagataagggtgccatccaaggcaggtgctccttggagccccattcagactcctccctggaccccactgggcctcagtcccagctctggggatgaagccaccacaagcacaccaggcagcccaggcccagccaccctgcagtgcccaagcacacactctggagcagagcagggtgcctctgggaggggctgagctccccaccccacccccacctgcacaccccacccacccctgcccagcggctctgcaggagggtcagagccccacatggggtatggacttagggtctcactcacgtggctcccatcatgagtgaaggggcctcaagcccaggttcccacagcagcgcctgtcgcaagtggaggcagaggcccgagggccaccctgacctggtccctgaggttcctgcagcccaggctgccctgctgtccctgggaggcctgggctccaccagaccacaggtccagggcaccgggtgcaggagccacccacacacagctcacaggaagaagataagctccagacccccagggccagaacctgccttcctgctactgcttcctgccccagacctgggcgccctcccccgtccacttacacacaggccaggaagctgttcccacacagaacaaccccaaaccaggaccgcctggcactcaggtggctgccatttccttctccatttgctcccagcgcctctgtcctccctggttcctccttcgggggaacagcctgtgcagccagtccctgcagcccacaccctggggagacccaaccctgcctggggcccttccaaccctgctgctcttactgcccacccagaaaactctggggtcctgtccctgcagtccctaccctggtctccacccagacccctgtgtatcactccagacacccctcccaggccaaccctgcacctgcaggccctgtcctcttctgtcgctagagcctcagtttctcccccctgtgcccacaccctacctcctcctgcccacaactctaactcttcttctcctggagcccctgagccatggcattgaccctgccctcccaccacccacagcccatgccctcaccttcctcctggccactccgaccccgccccctctcaggccaagccctggtatttccaggacaaaggctcacccaagtctttcccaggcaggcctgggctcttgccctcacttcccggttacacgggagcctcctgtgcacagaagcagggagctcagcccttccacaggcagaaggcactgaaagaaatcggcctccagcaccttgacacacgtccgcccgtgtctctcactgcccgcacctgcagggaggctccgcactccctctaaagacaagggatccaggcagcagcatcacgggagaatgcagggctcccagacatcccagtcctctcacaggcctctcctgggaagagacctgcagccaccaccaaacagccacagaggctgctggatagtaactgagtcaatgaccgacctggagggcaggggagcagtgagccggagcccataccatagggacagagaccagccgctgacatcccgagctcctcaatggtggccccataacacacctaggaaacataacacacccacagccccacctggaacagggcagagactgctgagcccccagcaccagccccaagaaacaccaggcaacagtatcagagggggctcccgagaaagagaggaggggagatctccttcaccatcaaatgcttcccttgaccaaaaacagggtccacgcaactcccccaggacaaaggaggagccccctatacagcactgggctcagagtcctctctgagacaccctgagtttcagacaacaacccgctggaatgcacagtctcagcaggagaacagaccaaagccagcaaaagggacctcggtgacaccagtagggacaggaggattttgtgggggctcgtgtcactgtgaggatattgtagtggtggtagctgctactcccacagtgacacagacccattcccaaagccctactgcaaacacacccactcctggggctgaggggctgggggagcgtctgggaagtagggtccaggggtgtctatcaatgtccaaaatgcaccagactccccgccaaacaccaccccaccagccagcgagcagggtaaacagaaaatgagaggctctgggaagcttgcacaggccccaaggaaagagctttggcaggtgtgcaagaggggatgcaggcagagcctgagcagggccttttgctgtttctgctttcctgtgcagagagttccataaactggtgttcaagatcagtggctgggaatgagcccaggagggcagtctgtgggaagagcacagggaaggaggagcagccgctatcctacactgtcatctttcaaaagtttgccttgtgaccacactattgcatcatgggatgcttaagagctgatgtagacacagctaaagagagaatcagtgagatgaatttgcagcatagatctgaataaactctccagaatgtggagcagtacagaagcaaacacacagaaagtgcctgatgcaaggacaaagttcagtgggcaccttcaggcattgctgctgggcacagacactctgaaaagccctggcaggatctccctgcgacaaagcagaaccctcaggcaatgccagccccagagccctccctgagagcgtcatggggaaagatgtgcagaacagctgattatcatagactcaaactgagaacagagcaaacgtccatctgaagaacagtcaaataagcaatggtaggttcatgcaatgcaaacccagacagccaggggacaacagtagagggctacaggcggctttgcggttgagttcatgacaatgctgagtaattggagtaacagaggaaagcccaaaaaatacttttaatgtgatttcttctaaataaaatttacaccaggcaaaatgaactgtcttcttaagggataaactttcccctggaaaaactacaaggaaaattaagaaaacgatgatcacataaacacagttgtggttacttctactggggaaggaagagggtatgagctgagacacacagagtcggcaagtctccaagcaagcacagaacgaatacattacagtaccttgaatacagcagttaaacttctaaatcgcaagaagaggaaaatgcacacagctgtgtttagaaaattctcagtccagcactattcataatagcaaagacattaacccaggttggataaataaatgatgacacaggcaattgcacaatgatacagacatacatttagtacatgagacatcgatgatgtatccccaaagaaatgactttaaagagaaaaggcctgatgtgtggtggcactcacctccctgggatccccggacaggttgcaggcacactgtgtggcagggcaggctggtacatgctggcagctcctggggcctgatgtggagcaagcgcagggctgtatacccccaaggatggcacagtcagtgaattccagagagaagcagctcagccacactgcccaggcagagcccgagagggacgcccacgcacagggaggcagagcccagctcctccacagccaccaccacctgtgcacgggccaccaccttgcaggcacagagtgggtgctgagaggaggggcagggacaccaggcagggtgagcacccagagaaaactgcagaagcctcacacatccacctcagcctcccctgacctggacctcacctggtctggacctcacctggcctgggcctcacctgacctggacctcacctggcctgggcttcacctgacctggacctcacctggcctccggcctcacctgcacctgctccaggtcttgctggaacctgagtagcactgaggctgcagaagctcatccagggttggggaatgactctggaactctcccacatctgacctttctgggtggaggcatctggtggccctgggaatataaaaagccccagaatggtgcctgcgtgatttgggggcaatttatgaacccgaaaggacatggccatggggtgggtagggacatagggacagatgccagcctgaggtggagcctcaggacacagttggacgcggacactatccacataagcgagggacagacccgagtgttcctgcagtagacctgagagcgctgggcccacagcctcccctcggtgccctgctgcctcctcaggtcagccctggacatcccgggtttccccaggcctggcggtaggtttgaagtgaggtctgtgtcactgtggtattatgattacgtttgggggagttatcgttatacccacagcatcacacggtccatcagaaacccatgccacagccctccccgcaggggaccgccgcgtgccatgttacaattttgatcgaggacacagcgccatgggtatggtggctaccacagcagtgcagcccatgacccaaacacacagggcagcaggcacaatggacaggcctgtgagtgaccatgctgggctccagcccgccagccccggagaccatgaaacagatggccaaggtcaccccacagttcagccagacatggctccgtggggtctgcatcgctgctgccctctaacaccagcccagatggggacaaggccaaccccacattaccatctcctgctgtccacccagtggtcccagaagcccctccctcatggctgagccacatgtgtgaaccctgagagcaccccatgtcagagtaggggcagcagaagggcggggctggccctgtgcactgtccctgcacccatggtccctcgcctgcctggccctgacacctgagcctcttctgagtcatttctaagatagaagacattcccggggacagccggagctgggcgtcgctcatcctgcccggccgtcctgagtcctgcttgtttccagacctcaccagggaagccaacagaggactcacctcacacagtcagagacaaagaaccttccagaaatccctgtctcactccccagtgggcaccttcttccaggacattcctcggtcgcatcacagcaggcacccacatctggatcaggacggcccccagaacacaagatggcccatggggacagccccacaacccaggccttcccagacccctaaaaggcgtcccaccccctgcacctgccccagggctaaaaatccaggaggcttgactcccgcataccctccagccagacatcacctcagccccctcctggaggggacaggagcccgggagggtgagtcagacccacctgccctcgatggcaggcggggaagattcagaaaggcctgagatccccaggacgcagcaccactgtcaatgggggccccagacgcctggaccagggcctgcgtgggaaaggccgctgggcacactcaggggctttttgtgaaggcccctcctactgtgtgactacggtgactaccacagtgatgaaactagcagcaaaaactggccggacacccagggaccatgcacacttctcagcttggagctctccaggaccagaagagtcaggtctgagggtttgtagccagaccctcggcctctagggacaccctggccatcacagcggatgggctggtgccccacatgccatctgctccaaacaggggcttcagagggctctgaggtgacttcactcatgaccacaggtgccctggccccttccccgccagctacaccgaaccctgtcccaacagctgccccagttccaacagccaattcctggggcccagaattgctgtagacaccagcctcgttccagcacctcctgccaattgcctggattcacatcctggctggaatcaagagggcagcatccgccaggctcccaacaggcaggactcccgcacaccctcctctgagaggccgctgtgttccgcagggccaggccctggacagttcccctcacctgccactagagaaacacctgccattgtcgtccccacctggaaaagaccactcgtggagcccccagccccaggtacagctgtagagagactccccgagggatctaagaaggagccatgcgcagttctgccgggaccctcggccaggccgacaggagtggacactggagctgggcccacactgggccacataggagctcaccagtgagggcaggagagcacatgccggggagcacccagcctcctgctgaccagaggcctgccccagagcccaggaggctgcagaggcctctccagggggacactgtgcatgtctggtccctgagcagccccccatgtccccagtcctgggggcccctggcacagctgtctggaccctccctgttccctgggaagctcctcctgacagccccgcctccagttccaggtgtggttattgtcagggggtgtcagactgtggtggatacagctatggttaccacagtggtgctgcccatagcagcaaccaggccaagtagacaggcccctgctgtgcagccccaggcctccagctcacctgcttctcctggggctctcaaggtcactgttgtctgtactctgccctctgtggggagggttctctcagtgggaggtctgttctcaacatcccagggcctcatgtctgcacggaaggccaatggatgggcaacctcacatgccgcggctaagatagggtgggcagcctggcgggggacagtacatactgctggggtgtctgtcactgtgcctagtggggcactggctcccaaacaacgcagtcctcaccaaaatccccacagcctcccctgctaggggctggcctgatctcctgcagtcctaggaggctgctgacctccagaatgtctccgtccccagttccagggcgagagcagatcccaggccggctgcagactgggaggccaccccctccttcccagggttcactggaggtgaccaaggtaggaaatggccttaacacagggatgactgcgccatcccccaacagagtcagccccctcctgctctgtaccccgcaccccccaggccagtccacgaaaaccagggccccacatcagagtcactgcctggcccggccctggggcggacccctcagcccccaccctgtctagaggacttggggggacaggacacaggccctctccttatggttcccccacctgcctccggccgggacccttggggtgtggacagaaaggacacctgcctaattggcccccaggaacacagaacttctctccagggaccccagcccgagcacccccttacccaggacccagccctgcccctcctcccctctgctctcctctcatcaccccatgggaatccggtatccccaggaagccatcaggaagggctgaaggaggaagcggggccgtgcaccaccgggcagcaggctccgtcttcgtgaacccagggaagtgccagcctcctagagggtatggtccaccctgcctggggctcccaccgtggcaggctgcggggaaggaccagggacggtgtgggggagggctcagggccctgcgggtgctcctccatcttcggtgagcctcccccttcacccaccgtcccgcccacctcctctccaccctggctgcacgtcttccacaccatcctgagtcctacctacaccagagccagcaaagccagtgcagacaaaggctggggtgcaggggggctgccagggcagcttcggggagggaaggatggagggaggggaggtcagtgaagaggcccccttcccctgggtccaggatcctcctctgggacccccggctcccatcccctcctggctctgggaggagaagcaggatgggagaatctgtgcgggaccctctcacagtggaatatccccacagcggctcaggccagacccaaaagcccctcagtgagccctccactgcagtcctgggcctgggtagcagcccctcccacagaggacagacccagcaccccgaagaagtcctgccagggggagctcagagccatgaaagagcaggatatggggtccccgatacaggcacagacctcagctccatccaggcccaccgggacccaccatgggaggaacacctgtctccgggttgtgaggtggctggcctctgtctcggaccccactccagacaccagacagaggggcaggccccccaaaaccagggttgagggatgatccgtcaaggcagacaagaccaaggggcactgaccccagcaagggaaggctcccaaacagacgaggaggtttctgaagctgtctgtatcacagtggggtatagcagtggctggtaccacagtgacactcgccaggccagaaaccccgtcccaagtcagcggaagcagagagagcagggaggacacgtttaggatctgaggccgcacctgacacccagggcagcagacgtctcccctccagggcaccctccaccgtcctgcgtttcttcaagaataggggcggcctgagggggtccagggccaggcgataggtcccctctaccccaaggaggagccaggcaggacccgagcaccgtccccattgaggctgacctgcccagacgggcctgggcccaccccacacaccggggcggaatgtgtgcaggccccagtctctgtgggtgttccgctagctggggcccccagtgctcaccccacacctaaagcgagccccagcctccagagccccctaagcattccccgcccagcagcccagcccctgcccccacccaggaggccccagagctcagggcgcctggtcggattctgaacagccccgagtcacagtgggtataactggaacgaccaccgtgagaaaaactgtgtccaaaactgactcctggcagcagtcggaggccccgccagagaggggagcagccgccctgaacccatgtcctgccggttcccatgacccccagcacccagagccccacggtgtccccgttggataatgaggacaagggctgggggctccggtggtttgcggcagggacttgatcacatccttctgctgtggccccattgcctctggctggagttgacccttctgacaagtgtcctcagaaagacagggatcaccggcacctcccaatatcaaccccaggcagcacagacacaaaccccacatccagagccaactccaggagcagagacaccccaacactctgggggaccccaaccgtgataactccccactggaatccgccccagagtctaccaggaccaaaggccctgccctgtctctgtccctcactcagggcctcctgcagggcgagcgcttgggagcagactcggtcttaggggacaccactgtgggccccaactttgatgaggccactgacccttccttcctttcctggggcagcacagactttggggtctgggcagggaagaactactggctggtggccaatcacagagcccccaggccgaggtggccccaagaaggccctcaggaggtggccactccacttcctcccagctggaccccaggtcctccccaagataggggtgccatccaaggcaggtcctccatggagcccccttcagactcctcccgggaccccactggacctcagtccctgctctgggaatgcagccaccacaagcacaccaggaagcccaggcccagccaccctgcagtgggcaagcccacactctggagcagagcagggtgcgtctgggaggggctaacctccccaccccccaccccccatctgcacacagccacctaccactgcccagaccctctgcaggagggccaagccaccatggggtatggacttagggtctcactcacgtgcctcccctcctgggagaaggggcctcatgccgagatccctgcagcactagacacagctggaggcagtggccccagggccaccctgacctggcatctaaggctgctccagcccagacagcactgccgttcctgggaagcctgggctccaccagaccacaggtccagggcacagcccacaggagccacccacacacagctcacaggaagaagataagctccagaccccagggcgggacctgccttcctgccaccacttacacacaggccagggagctgttcccacacagatcaaccccaaaccgggactgcctggcactagggtcactgccatttccctctccattccctcccagtgcctctgtgctccctccttctggggaacaccctgtgcagcccctccctgcagcccacacgctggggagaccccaccctgcctcgggccttttctacctgctgcacttgccgcccacccaaacaaccctgggtacgtgaccctgcagtcctcaccctgatctgcaaccagacccctgtccctccctctaaacacccctcccaggccaactctgcacctgcaggccctccgctcttctgccacaagagcctcaggttttcctacctgtgcccaccccctaacccctcctgcccacaacttgagttcttcctctcctggagcccttgagccatggcactgaccctacactcccacccacacactgcccatgccatcaccttcctcctggacactctgaccacgctcccctccctctcagacccggccctggtatttccaggacaaaggctcacccaagtcttccccatgcaggcccttgccctcactgcctggttacacgggagcctcctgtgcgcagaagcagggagctcagctcttccacaggcagaaggcactgaaagaaatcggcctccagtgccttgacacacgtccgcctgtgtctctcactgcctgcacctgcagggaggctccgcactccctctaaagatgagggatccaggcagcaacatcacgggagaatgcagggctcccagacagcccagccctctcgcaggcctctcctgggaagagacctgcagccaccactgaacagccacggaggtcgctggatagtaaccgagtcagtgaccgacctggagggcaggggagcagtgaaccggagcccagaccatagggacagagaccagccgctaacatcccgagcccctcactggcggccccagaacaccccgtggaaacagaacagacccacagtcccacctggaacagggcagacactgctgagcccccagcaccagccccaagaaacactaggcaacagcatcagagggggctcctgagaaagagaggaggggaggtctccttcaccatcaaatgcttcccttgaccaaaaacagggtccacgcaactcccccaggacaaaggaggagccccctgtacagcactgggctcagagtcctctctgagacaggctcagtttcagacaacaacccgctggaatgcacagtctcagcaggagagccaggccagagccagcaagaggagactcggtgacaccagtctcctgtagggacaggaggattttgtgggggttcgtgtcactgtgagcatattgtggtggtgactgctattcccacagtgacacaaccccattcctaaagccctactgcaaacgcacccactcctggggctgaggggctgggggagcatctgggaagtatggcctaggggtgtccatcaatgcccaaaatgcaccagactctccccaagacatcaccccaccagccagtgagcagagtaaacagaaaatgagaagcagctgggaagcttgcacaggccccaaggaaagagctttggcaggtgtgcaagaggggatgtgggcagagcctgagcagggccttttgctgtttctgctttcctgtgcagagagttccataaactggtattcaggatcaatggctgggagtgagcccaggaggacagtgtgggaagagcacagggaaggaggagcagccgctatcctacactgtcatcttttgaaagtttgccctgtgcccacaatgctgcatcatgggatgcttaacagctgatgtagacacagctaaagagagaatcagtgaaatgcatttgcagcacagatctgaataaatcctccagaatgtggagcagcacagaagcaagcacacagaaagtgcctgatgccaaggcaaagttcagtgggcaccttcaggcattgctgctgggcacagacactctgaaaagcactggcaggaactgcctgtgacaaagcagaaccctcaggcaatgccagccctagagcccttcctgagaacctcatgggcaaagatgtgcagaacagctgtttgtcatagccccaaactatggggctggacaaagcaaacgtccatctgaaggacaacagacaaataaacgatggcaggttcatgaaatgcaaactaggacagccagaggacaacagtagagagctacaggcggctttgcggttgagttcatgacaatgctgagtaattggagtaacagaggaaagcccaaaaaatacttttaatgtgatttcttctaaataaaatttacacccggcaaaatgaactatcttcttaagggataaactttcccctggaaaaactataaggaaaatcaagaaaacgatgatcacataaacacagtggtggttacttctactggggaaggaagagggtatgagctgagacacacagagtcggcaagtctcctaacaagaacagaacaaatacattacagtaccttgaaaacagcagttaaacttctaaatcgcaagaagaggaaaatgcacacacctgtgtttagaaaattctcagtccagcactgttcataatagcaaagacattaacccaggttggataaataagcgatgacacaggcaattgcacaatgatacagacatacattcagtatatgagacatcgatgatgtatccccaaagaaatgactttaaagagaaaaggcctgatgtgtggtggcaatcacctccctgggcatccccggacaggctgcaggctcactgtgtggcagggcaggcaggcacctgctggcagctcctggggcctgatgtggagcaggcacagagctgtatatccccaaggaaggtacagtcagtgcattccagagagaagcaactcagccacactccctggccagaacccaagatgcacacccatgcacagggaggcagagcccagcacctccgcagccaccaccacctgcgcacgggccaccaccttgcaggcacagagtgggtgctgagaggaggggcagggacaccaggcagggtgagcacccagagaaaactgcagaagcctcacacatccacctcagcctcccctgacctggacctcacctggcctgggcctcacctgacctggacctcacctggcctgggcttcacctggcctgggcttcacctgacctggacctcacctggcctcgggcctcacctggcctgggcttcacctggcctgggcttcacctgacctggacctcacctggcctgggcctcacctgacctggacctcacctggcctgggcttcacctggcctgggcttcacctggcctgggcttcacctgacctggacctcacctggcctgggcttcacctgacctggacctcacctggcctcgggcctcacctgcacctgctccaggtcttgctggagcctgagtagcactgaggctgtagggactcatccagggttggggaatgactctgcaactctcccacatctgacctttctgggtggaggcacctggtggcccagggaatataaaaagccccagaatgatgcctgtgtgatttgggggcaatttatgaacccgaaaggacatggccatggggtgggtagggacagtagggacagatgtcagcctgaggtgaagcctcaggacacaggtgggcatggacagtgtccacctaagcgagggacagacccgagtgtccctgcagtagacctgagagcgctgggcccacagcctcccctcggggccctgctgcctcctcaggtcagccctggacatcccgggtttccccaggcctggcggtaggtttgaagtgaggtctgtgtcactgtggtattactatgatagtagtggttattactaccacagtgtcacagagtccatcaaaaactcatgcctgggagcctcccaccacagccctccctgcgggggaccgctgcatgccgtgttaggattttgatcgaggacacggcgccatgggtatggtggctaccacagcagtgcagcccatgacccaaacacacggggcagcagaaacaatggacaggcccacaagtgaccatgatgggctccagcccaccagccccagagaccatgaaacagatggccaaggtcaccctacaggtcatccagatctggctccaaggggtctgcatcgctgctgccctcccaacgccaaaccagatggagacagggccggccccatagcaccatctgctgccgtccacccagcagtcccggaagcccctccctgaacgctgggccacgtgtgtgaaccctgcgagccccccatgtcagagtaggggcagcaggagggcggggctggccctgtgcactgtcactgcccctgtggtccctggcctgcctggccctgacacctgagcctctcctgggtcatttccaagacattcccagggacagccggagctgggagtcgctcatcctgcctggctgtcctgagtcctgctcatttccagacctcaccagggaagccaacagaggactcacctcacacagtcagagacaacgaaccttccagaaatccctgtttctctccccagtgagagaaaccctcttccagggtttctcttctctcccaccctcttccaggacagtcctcagcagcatcacagcgggaacgcacatctggatcaggacggcccccagaacacgcgatggcccatggggacagcccagcccttcccagacccctaaaaggtatccccaccttgcacctgccccagggctcaaactccaggaggcctgactcctgcacaccctcctgccagatatcacctcagccccctcctggaggggacaggagcccgggagggtgagtcagacccacctgccctcaatggcaggcggggaagattcagaaaggcctgagatccccaggacgcagcaccactgtcaatgggggccccagacgcctggaccagggcctgtgtgggaaaggcctctggccacactcaggggctttttgtgaagggccctcctgctgtgtgactacggtggtaactcccacagtgatgaaaccagcagcaaaaactgactggactcgcagggtttatgcacacttctcggctcggagctctccaggagcacaagagccaggcccgagggtttctgcccagaccctcggcctctagggacacccgggccatcttagccgatgggctggtgccctgcacaccgtgtgctgccaaacaggggcttcagagggctctgaggtgacttcactcatgaccacaggtgccctggtcccttcactgccagctgcaccagaccctgttccgagagatgccccagttccaaaagccaattcctggggccgggaattactgtagacaccagcctcattccagtacctcctgccaattgcctggattcccatcctggctggaatcaagagggcagcatccgccaggctcccaacaggcaggactcccacacaccctcctctgagaggccgctgtgttccgcagggccaggccgcagacagttcccctcacctgcccatgtagaaacacctgccattgtcgtccccacctggcaaagaccacttgtggagcccccagccccaggtacagctgtagagagagtcctcgaggcccctaagaaggagccatgcccagttctgccgggaccctcggccaggccgacaggagtggacgctggagctgggcccacactgggccacataggagctcaccagtgagggcaggagagcacatgccggggagcacccagcctcctgctgaccagagacccgtcccagagcccaggaggctgcagaggcctctccagggggacacagtgcatgtctggtccctgagcagcccccaggctctctagcactgggggcccctggcacagctgtctggaccctccctgttccctgggaagctcctcctgacagccccgcctccagttccaggtgtggttattgtcagggggtgccaggccgtggtagagatggctacaattaccacagtggtgccgcccatagcagcaaccaggccaagtagacagacccctgccacgcagccccaggcctccagctcacctgcttctcctggggctctcaaggctgctgtctgccctctggccctctgtggggagggttccctcagtgggaggtctgtgctccagggcagggatgactgagatagaaatcaaaggctggcagggaaaggcagcttcccgccctgagaggtgcaggcagcaccacagagccatggagtcacagagccacggagcccccagtgtgggcgtgtgagggtgctgggctcccggcaggcccagccctgatggggaagcctgccccgtcccacagcccaggtccccaggggcagcaggcacagaagctgccaagctgtgctctacgatcctcatccctccagcagcatccactccacagtggggaaactgagccttggagaaccacccagccccctggaaacaaggcggggagcccagacagtgggcccagagcactgtgtgtatcctggcactaggtgcagggaccacccggagatccccatcactgagtggccagcctgcagaaggacccaaccccaaccaggccgcttgattaagctccatccccctgtcctgggaacctcttcccagcgccaccaacagctcggcttcccaggccctcatccctccaaggaaggccaaaggctgggcctgccaggggcacagtaccctctcttgccctggctaagacagggtgggcagacggctgcagataggacatattgctggggcatcttgctctgtgactactgggtactggctctcaacgcagaccctaccaaaatccccactgcctcccctgctaggggctggcctggtctcctcctgctgtcctaggaggctgctgacctccaggatggcttctgtccccagttctagggccagagcagatcccaggcaggctgtaggctgggaggccacccctgtccttgccgaggttcagtgcaggcacccaggacaggaaatggcctgaacacagggatgactgtgccatgccctacctaagtccgcccctttctactctgcaacccccactccccaggtcagcccatgacgaccaacaacccaacaccagagtcactgcctggccctgccctggggaggacccctcagcccccaccctgtctagaggagttggggggacaggacacaggccctctccttatggttcccccacctggctcctgccgggacccttggggtgtggacagaaaggacgcctgcctaattgtcccccaggaacccagaacttctctccagggaccccagcccgagcacccccttacccaggacccagccctgcccctcctcccctctgctctcctctcatcactccatgggaatccagaatccccaggaagccatcaggaagggctgaaggaggaagcggggccactgcaccaccgggcaggaggctccgtcttcgtgaacccagggaagtgccagcctcctagagggtatggtccaccctgcctggggctcccaccgtggcaggctgcggggaaggaccagggacggtgtgggggagggctcagggccctgcaggtgctccatcttggatgagcccatccctctcatccaccgacccgcccacctcctctccaccctggccacacgtcgtccacaccatcctgagtcccacctacaccagagccggcagagccagtgcagacagaggctggggtgcaggggggccgccagggcagctttggggagggaggaatggaggaaggggaggtcagtgaagaggcccccctcccctgggtctaggatccacctttgggacccccggatcccatcccctccaggctctgggaggagaagcaggatgggagaatctgtgcgggaccctctcacagtggaatacctccacagcggctcaggccagatacaaaagcccctcagtgagccctccactgcagtgctgggcctgggggcagcccctcccacagaggacagacccagcaccccgaagaagtcctgccagggggagctcagagccatgaaggagcaagatatggggaccccaatactggcacagacctcagctccatccaggcccaccaggacccaccatgggtggaacacctgtctccggcccctgctggctgtgaggcagctggcctctgtctcggacccccattccagacaccagacagagggacaggccccccagaaccagtgttgagggacacccctgtccagggcagccaagtccaagaggcgcgctgagcccagcaatggaaggcccccaaacaaaccaggaggtttctgaagctgtctgtgtcacagtcgggtatagcagcggctaccacaatgacactgggcaggacagaaaccccatcccaagtcagccgaaggcagagagagcaggcaggacacatttaggatctgaggccacacctgacactcaagccaacagatgtctcccctccagggcgccctgccctgttcagtgttcctgagaaaacaggggcagcctgaggggatccagggccaggagatgggtcccctctaccccgaggaggagccaggcgggaatcccagccccctccccattgaggccatcctgcccagaggggcccggacccaccccacacacccaggcagaatgtgtgcaggcttcaggctctgtgggtgccgctagctggggctgccagtcctcaccccacacctaaggtgagccacagccgccagagcctccacaggagaccccacccagcagcccagcccctacccaggaggccccagagctcagggcgcctgggtggattctgaacagccccgagtcacggtgggtatagtgggagctactaccactgtgagaaaagctatgtccaaaactgtctcccggccactgctggaggcccagccagagaagggaccagccgcccgaacatacgaccttcccagccctcatgacccccagcacttggagctccacagtgtccccattggatggtgaggatgggggccggggccatctgcacctcccaacatcacccccaggcagcacaggcacaaaccccaaatccagagccgacaccaggaacacagacaccccaataccctgggggaccctggccctggtgacttcccactgggatccacccccgtgtccacctggatcaaagaccccaccgctgtctctgtccctcactcagggcctgctgaggggcgggtgctttggagcagactcaggtttaggggccaccattgtggggcccaacctcgaccaggacacagatttttctttcctgccctggggcaacacagactttggggtctgtgcagggaggaccttctggaaagtcaccaagcacagagccctgactgaggtggtctcaggaagacccccaggagggggcttgtgccccttcctctcatgtggaccccatgccccccaagataggggcatcatgcagggcaggtcctccatgcagccaccactaggcaactccctggcgccggtccccactgcgcctccatcccggctctggggatgcagccaccatggccacaccaggcagcccgggtccagcaaccctgcagtgcccaagcccttggcaggattcccagaggctggagcccacccctcctcatccccccacacctgcacacacacacctaccccctgcccagtccccctccaggagggttggagccgcccatagggtgggggctccaggtctcactcactcgcttcccttcctgggcaaaggagcctcgtgccccggtcccccctgacggcgctgggcacaggtgtgggtactgggccccagggctcctccagccccagctgccctgctctccctgggaggcctgggcaccaccagaccaccagtccagggcacagccccagggagccgcccactgccagctcacaggaagaagataagcttcagaccctcagggccgggagctgccttcctgccaccccttcctgccccagacctccatgccctcccccaaccacttacacacaagccagggagctgtttccacacagttcaaccccaaaccaggacggcctggcactcgggtcactgccatttctgtctgcattcgctcccagcgcccctgtgttccctccctcctccctccttcctttcttcctgcattgggttcatgccgcagagtgccaggtgcaggtcagccctgagcttggggtcacctcctcactgaaggcagcctcagggtgcccaggggcaggcagggtgggggtgaggcttccagctccaaccgctccactagccgagactaaggaagtgagaggcagccagaaatccagaccattccatagcaaatggatttcattaaagttaccagacttcagtgtaagtaacatgagccccatgcacaacaatcccttatgaaggggaagtcagtgtcgcctcggatttcttgaaaaacacaaaaacttatcaatgcctgtaaaagtctgttggaaagaaaatatgattcaagaatgttatgcccaacaaagctggcatattttctacccggacacactcagggaatgtggtcgcttgagtgcttctctcactgcgtaaatcctacgtggtgtttaagcatattcataaatgtgtatgtctatttttatgtgtaagatggttcatttttattttatttattcaatatgtacaataaagaatattgacaaataggctggacatggtggctcccacctgtaatcccagccctttgggaggccgaggcgggcagatcacctgaggtctggagttcgagaccagcctggccaacatgatgaaaacccatctctactaaaaatacaaagattagccaggcatggtggtgcatgcctgtaatcccagccactcaggaggctgagacaggagaaatgcgtgaacccggaaggcggaggttgcagtgagccgagatcacaccactgcactccagcctggcgacagagcaagattccatctcaaaaaaaaaagacaaagaaatttgtttttttgaataaagacaaatttcatcacacgaagataaagatgcaaagctccagacaggaaggcacggacagcacagtgaagcctggagcgggcgctggggggccaggggcatggcgggggtgccagcgtctctcagtgcctaccatggccactccagcctgtgttctcacgaggatggctgtgcaatgctaggagcgtgttcgaagctctagggcaaccactggaagtgaggctgaggagcagagcccagaggcccgtggagctgatgaaaagaaagctggagaaagtgtttgctgcctcccaacatggtaagaaaagatagaaagagagagcacacggcaaagggagcttgctgagggactctttacaatggcttgcacagagctcagggggtctgggaggctagggccctgcgcagggcagtcaccccagcctgctgaccaaggtttgctgcaggcagctctgggggtggttgaggcgcggtccctggagccacccctcaagggaacgaggcagcagagtgggccaaggcccaggtcggctgcaaggctgcccaggacttggggtccttacatcagcagccactgatgcagctggcccagagagaggcgccgagcaggttgcctccaggggacaaaccaggtcggagagggtgaggcagtggatggagccacaacaaccccgggcacgggtgacacgcacgttcatgcacatctgacccttcctccctcaccaaacaggtccccctgccttccccatggttgcgaaaaagcaaaatgtagacgttttttcttttttaattcatgttttaattgacaaatgaagccgtatatatttattgtgtacaacatgatgctttaaaatatgtatacatcgtggaacagcaacgtcgagctaatttaacacgcattacttcacatacttgtcatcttttgtggcgagaatgcttaaaatccactctcttagtattttttaagaatgcaatacattgttgtcaactgtggtcaccgtcatgcatagccaagctcccgacctcaccctcctgccagctcaggctgtgcatcctttcaccagcatcccccaccccggcccctggccctggtaactaccactctatactctacgtatgagttcagctttttaagattccacagatgaatgagatcatacagtatttgctttctatgcctggcttattttagttaacacactgtcctccagatccatccgttgttgcaaatgacagggtttcattctttttaaagtctaaagagtattccattgtgtcaatggacctcatttgctttatccatgcatcaactatggacatttaggttgattccatttcttagctgttgtggatggtgctgcagtaaacatggggctgcagatgtctcttcaacatactgacatcatgtcctttggataaatacccagtagtgggatcgctggatcacaatgtacagttttttttttaatggaaactttcattttttggtgaaattaggaaaacagataaaacccacagaatccaaaatatatgtgaagatgccaaaaacagttgacattgggcagaggtcacatggaaggaagtgaatacatgacggggtgtgagggcccagaggcagctgaaatacgctttctaaacacaaggacctcttctgagagggcagaagttttatcctgcacatgcaatgaccagcacagctaaaatacactttctaaacatgaggacctcttctgagagggcagctttatcctgcaaatgcaatgaccagcacaggacccagaataaagagagttgccagcggacgcctggtgtccatgtgtccaggtgagttcgagatgcggacggcgctggccagccagtcacaccctaagtcaatctgctgcatgcatttgtccttgccacagcagaaaacgagaaagcctttgggctgcaaagcttcacaggctcctcttctcccgactccatggaaacagctacaaagagcaggcccagtagagcttaattcatgaaaatgagtaataaacttgaactggaacagtatcgactttttagaaacggcagcaaagtgtataaaaaatattcaccagaacaatatttccaaacgatgagatgagaatttcagccaagtaatcctccatggatagaaaataatgaagggattggatttatgaaggaaaatcatggagctcaaatacaagagaagagaatcaaaaatgaacaggaggagataaaatatggtttggccaaagttacaaaataaattttttaaaaacccttcatcatggcaagtagaaagagcgagaggaaaaacagatcccgtggaagacacaaataggacatggggagaaaaatgaatgagatgaaacagagcagaaataaaattttacggaactaaagacaagtgatctgaacctgcctggggcctgggggacctcgccaccctgaagggaaagaacatgcctggctggctttgccacctgctcattgcagagccccacagcttgcaacaaacataggcggtagccagggagtggttacagcaggccttgagcaagacccagtgttgtgctgacttcaggtctgacccagcactgtcatagtggtggtgtccatagtggtagtgggggtgcttgtgtcactccacccccatctccaggaggctcagaacagacagagagagactccatttgtttgggagaaagtaagggatgagaacaagagtctctgcctggtaatccagagaattattctagatcttggccaagattatcaaagcagtacctctatgagtcttttgggcttggagtccccctaaagcagatatagctaagatcacaacacccaagtccttttgaatatgtgggaagacttcccaaggacaggagcaaacaaacaagcccagactgcaaaaaaacaagcccagactgcaataaacacctcactcttcaatgcccaggcactgaagaacatctcctagcagcaacaccatccaggaaaacatggcctcaaccagtgaactaaataaggcaccagggaccagtctcggagaaatagaggtatgttatctttcagagaattcaaagtagctttgttgaggaaactcaaagaaattcaagataacacagtgaaggaattcagaatcctatccgataaatttaacagagattgaagcaattaaaaagaattaagcagaaattatggagctgaaaaatgcaattggcatactgaaaaatgcatcagagtattttcatagcctcatatatcaagtagaagaaagaattagtgagcttgaaaacaggctatttggaaaagcacgataaaaggagacaaaagagaaaagaataaataacaatgaagcatatctacaggatctagaaaatagcctcaaaaggccaaatctaagaattattagccttaaagaggaggtagagaaagagggatggagagtttattcaaagggataataacagaaaacttcccaaacctagagaaagatatcaatatccaaatgcaagaaggatgtagtacaccaaggagatttaatgcaaagaagactacctcaaggcattcaatactcaaactcccatatgacaaggactttaaaaagatcctaaaagcagcaaaagaaaagaaatgaataaaatactatggagctccaatatgtctggcagcagacttttcagtgaagactttatatgccaggagagagtgtcataatggatttaaagtgctgaaggaaaaaacttttaccctcgaacagtatagctggtgaaattatccttcaaacatgaaggagaaataatttgtttccagacaaatgttgagggatttcatgaacaccagacctgtcttttaagaaatgctaaagggagtacttcaatcagaaagaaacacgttagtgaacaataagaaatcatctgaaggcacaaaactcaccggtaatagtaagtacacagaaaaacacagaatattataacactgtaactgtggtgtgtaaactccttttgtttgtttgtttgtttgtttgtttgtttgtttttgtttttagacggagttttgctccagcccaggctggagtgcaatggcacaatctcagctcactgcaacttccacctcctgggttcaagcaattctcctgcctcagcctcccaagtagctgggattacaggcatgtgctaccatgtccagctaattttgtattttagtagagacggtgtttcaccatgttggtcaggctagccttatcttgagtagaaaaactaaatgatgaagcaatgaaaaataataactacaacttttcaagacatagtacaataagatataaatcataacaaaaagttaaaaggtggagggatgaagttaaggcatagagtctttattagttttctttttacttgtctgtttatgcaaacagtgttaagttgtcatcagtttaaaataatgggtcataagatactatttgcaagcctcatggtaacgtcaaaccaaaagcaatacaacagatacacaaaaaacaaaaagcaagaagctaaattacgtcatcagagaaaatcaccttcactaaaaggaagacggagaaaagaatgaagagagagaagaccaaaagcaaatagcaatatggcaggagtaagtccttacttatcaataataccattgaatgtaaatggactaaactctccaatcaaaagacatagagtggctgaatcaattaaagaaaaaacaagacccattgatctgttgtccacaagaaacacactttatctataaagacacacatagactgaaaacaaagggatggaaaaagatactccacgccaatggaaaccaaagaaagagcaggagtagctacacttatatcaggcaaaatagatttcaagacaaaaactataagaagagacaaggtcactaatgataaacaggtcaattcagcaagaggatataacaattgtaaatatatatgcacccaatgctggagcacccagatatataaagcaagtatttactagagctaaagagagaaatagactccaatgcaataatagctggagatttcaacatcccactttcaacattgaacagatcctccagatagaaaatcaacaaagaaatattggacttaatctgcactatcgaccaaatggatctaacagatatttacagaacatttcatccaacagctgcagaacacacattcttttcctcagcacatagatcattctcaaggatagaccatatgttgggtcacaaaacaagttttaaaatattcaaatacattgaaataatatcaagcatcttctgtgaccacaatggactaaaactagaaatcaataacaagaggaattttggaaactatataaatatatggaaattaatgaatgctgagtgggtcaatgaagcaattaagaaggaaactgaaatttttcttggaacgaatgatcatggaaacagaaaataccaaaacctatgggatacagcaaaagcagtactaagagggaagtttacagctacaaatgcttacattaaaaaagaagaaaaacttcaataaaaaaacctaacaatgcatcttaaagaactagaaaagcaagaggaaatcaaatccaaaattagtagaagaaaacagtaaaggtcagagcagaaataagtaaaattgaaatgaagaaaacaatacaaaagatcaataaaacaacaggttgttttcttgaaaagttaaacaaaattgacaaacctttagccagactaagaaaaaaagacagaagatccaaataaataaaatcagagatgaaaaaggtgacattacaacttacaccacagaaattcaaaggatcattagtggctactataagcaactatatgccaataaattggaaaatctagaagaaatgcagaaattcctagacacatacaacctcccaagattaaaccaagaagaaattcaaaacctgaacagactgataacaagtaatgagatcaaagccgtaataaaaagcctcccagtaaagagaagcccaggacccgacggcttcactgctgaattctaccaaacatttaaagtagaactaataccaatcctactcaaactattccaaaaaatagaggtggaaggaatacttcaaaactcattatacgaggccagtattaacctgacaccaaaactagacaaagacacatgaaaaaaagaaaactacaggccaatatgtctgatgaatattgacacaaaaatcctcaacaaaatactagcaaaccaaattcaactacacattagaaagttcactcatcatgaccaagtggaatttatctaacttgggatgcaaagatggttcaacatatgcaaatcaatcaatgtgatacatcatatcaacagaatgaacaacaaaaaccatttgatcatttaattgatactgaaaaagcatttgataaaattcaacattccttcataataaaaattctcttctatactaggtacaaaagaaacttacctcaacataataaagccatatatgacagtcccacagtatgatactaaatgaggaaaaactgagagcctttcctctacgatctggaacatgacaaagatgcccactttcatcactgttattcaacatagtactggaagtcctagctggagcgatcagacaagagaaagatataaaaggcatccaaattggaaaggaataagtcaaattatcctcatttgcatatggtatgatcttctatttagagctaactaaagactccaccaaaaaaagttattagaactgacgaacaaattcagtaaagctgcaggatacaaaatcaacatacaaaaatcagtagcatttctatatgccaacaatgaccaatgtgaaaaagaaattaaaaagtaaccctatttacaataaccacaaataaacacctaggaattaaccaaagaggtaaaagatttctgtaatgaaaactataaaacactgatgaaagaaattgaagagtacaccaaaaaatggaaagcaattgcatgttcatggattagaagaatcagtgttgttataatgtccatactatccaaagcaatctacagattcaatgcaatccttatcaaaataccaatgacatcattcacagaaatagaaaaaaaaaatcctaaaatttacgtggaaccacaaagacccagaatagccaaagctctcctaagcaaaaagaacgaaactgtaggaatgacattgcctgtcttcaaattctactacagagctatagatagtaaccaaaacagcgtggtactagcataaaaacagacacagagacaaacagaacaaaatttaaaaacccagaaataaatccacacacctacagcaaattcatttttgacaaagttgccaagaacatactctggggaatagataatgatatctcttcaataaataatgtggggaaaactggatatccatatacataacagtgaaactagacccctctctctctcactatatacaaaaatcaaatcaaaattgtttaaggacttaaatctaagacctcatactatgaaaccactgcaagacaaccttggcggaaactctccaagacatcagtccaggcaaagatttcttgagtaatatcccacaagcacagacaaccaaagcaaaaatggacaaatgggatcacatcaagttaaaaagcttctgcacagtaagggaaacaaccaacaaaatgaagagacaacccacagaatgggagaaaatatttgaaaaatacccatctggcaagggattaaaaaccagaatatatgcagaatatataaggagctcaaacagtgctatagaaaaaaaaatctaataatctgatttaaaaatgggaaaaatgttagaatagacatttcttaaaataagacatacagatggcaaaccgacatggaacggtgctcaacatcatggattatcacagaaacacaatcaatcaaaactaaaactaaaatgtgctatcatctcaccccagttaaaatggctgatatccagaagacaggcaataacaaatgctggcaaggatgtggggaaaagggagcccccatacactgttgctgggattgtaaattagtacaaccactgtggagagcagcatgaaagttcctcaaaaaactgaaagaaagctaccataggatccagcaatcccactgctgtgtatatactacaaaagaaaggaagtcagtatatgaagaggtatctgcactcccatgtttgttgcagccctgttcacaacagccaagatttggaagcaacctaagtgtccatcagcagttgaatgtataaagaaaatgtggtgcatatacacaatggagtattattcaataataaaaaggaatgagattgagtcatttgcaacaacatggatggaactggagatcattatgtgaagtgaaataagccaggcacagaaagacaaacattacaatgttcttacttattaatgagatctaaaaatcaaaacaattgcacccatgttcataaagagtaaaaggatggttaccagatgctgagaacggtggtggggggatagggaaaggtggcagtggttaacgggtacaaaaaaatagaaagaatgaataagacttactacttgatagcacagcaaggtggctatagtcagtaatttagttgtatatttttaataatgaaaggtgtataattggattgtttctaacacaaaggataatgcttaagaggatggataccccattttccatgatgtgattatttcacattgcacgcctagatcaaaacatccaatgtaccccataaatatatacatcttctatgtacccataaaaattctgtaaaataaaatatataaaaagaggtgacagatatggaagacaggcaaagaagagacgacatccacataatccgagtacctaagaaagaatggagtccagtgcatctcaggagccaccattctaagccaattttctctggttctctcagtcaccctaccaatacgtgggcaatcttgttttatttcaggatagagtttttgaaattatagatttaagtatgctttctgttctattacttttggtaattaattttagaaagaactaatttgggcacaaatttgaaaaaattctaaatccaaaaaaaaaaagaaaaaaacacacacacaatcatctataagggggatgatgaccagtcctagatttctcaccagccacattcaagatcagtaaatggtaggacaaaacctgtagggtccttaagggggaaagaagtagtggatagtccagagtctatatacagccaactgttcttgaagaaaaaaggctgctgaaaaggagttccaaacattctataatccataatctcatgatgaaactactagaggaagaccaccagccatcaaaaggtgcttggagaacccagggccaagaaccaaaagtaaatattaagtgtccttaactgcgagactaagatagaaatgactgtgggggaccatgtggcctcaacagaggtgaaatggtgtctgcctgacaaagtggacattttacaatgatcaaaacacagaatatgagatagagagcacttctgaattactgcctcactccaaataactctcagccaaaggacttcagtaaaaccaaattgggcatattagacagtacaaacaaattctaagaaaataatattactgattacaatcacatgatgctagagatggaggggaaaaggaagaggaaaccaggtaatttcatactcgtatatagtaaagaactaaagtacattgtccaaagaagaacaaagaatattttggaaagttataaaggtagccactacacatagaagatagcaaagaacaagaaaacttaagatggaaaactttttggaagcataaaaatagaaaatataaactactaagataagattgaagccaaacagatctatgaaaacaacaaacatcaatggccttaacttgcctattaaaaggaagagactttcaaattggaccacaagataaaacccaactctatatagcatatgagtattacacacaaaatgggaaaagctgaaaaaacttgggcaaaattcaccccaagcaaattccactgtttcctttgggacaaaatgccaagctccatgccagggaagatgattctcctcagaccttctcctcactctcccagtcctcttagggaaggaattgggtgttagaggagggagactctgtcgattatcagctgaagcagtggtgtgctcctgcgttgcttctgacctgggaaatgaagcagcaagactctttctgctgtgtctttgcccagaagggccatccccccagagcagagtacccaggccggcaggagcagtggtggaagcgtggaaaccacgtctcctacagcagagaccatcagaagcggagcctcgggtataagggaaacaacgcgttctccctaacctgggagtgacagacagcgtcattcctcacagtgataccctgtgttctagccatctggcccatgacagagccagcccagagccagcccagagccagcccctcaccaacctggagcctggccagctcgccaagctgcaccataggcctggaaggcgtggagacctgcggcagtgccctgtcctcccgtgaggcctgccatccctgccaggggtcgcctctggcttctccttctccaggaccgcacggtccagaggctcagtgcctggagtaggtgttgcccccctgcttctaggcccagaccctcccttgttcctgaccccgggcctttccctctggcttggacatccagggccctgtctcagctggggagctgctcctgctcaaggactgtcttccgcgggatcgaaaggccgcgtcctgaacaatgcgtgggccacgtgagcggagcaggctctaaaggccgcgtcctaaacagtgcgtgggccacgtgagcggagcaggctctaaaggccgcgtcctaaacagtgcgtgggccacgtgagcggagcaggctctaaaggccgcgtcctaaacagtgcgtgggccacgtgagcggagcaggctctaaaggccgcgtcctaaacagtgcgtgggccacgtgagcggagcaggctctaaaggccgcgtcctaaacagcgcgtgggccacgtgagcggagcaggctctaaaggccgcgtcctaaacagtgcgtgggccacgggagcggagcagactctaaaggccgcgtcctaaacagtgtgtgggccacgtgagcggagcgccctctccactgccctcggggccgcagctcccagctcagctcccagccctgctcagggcagccaggccaggaggtaccatccaggctaagtgaccctcaggggggacaggtgccccaggagatgccagctgttgggagaggctgggggaccaactcgacctggcctgtgggccctgccctggccacccattgtaggatccagccgccacgcctgtgacactcgtgtgctttccctggtgtgtgcttgtggcaggtgggggcagagggtcctcaggccagagagccactcccccagcgccagaccaccctcttcctcactcccccacctcaccccctcacaggtgcctcccaggccatcagggcccaaccacccctaaacaaatgggttctcggcccctcgtggctggaggtgggttctctcaccattcccagcctaagactccatccccatgctggcagctgttcaaccatgtctagagagatccactgtcccagacagcacctcagggtcccccgtcctgcctggaaccctgtaggaaactccacaaaccgccgccattctgtccacacccctacaggagccccaaccctctccccacatccaggcttccctcccagacccctcatccctgcccgcacggtgcctgagggggccttcttgggcagcgcctaagcaagcccccagcacccttcggccccttcaaggcacacaggccccctttccacccagcctcaggaaaccacctgtgtcctccaacgacaggtcccagcctcccagcctttgccttgcctgttcctctccctggaactctgccccgacacagaccctccccagcaagcccgcagggcacctcccctgcccccagacaccctgtgcccatcagttcatccccagcagaggccctcaccaggcacacccccatgctcacacctggccgcaggcctcagcctccctgagggccccacccagcccgcgtctggccagtggtgcgtgcaaagcccctcacccagactcggcggaaggcagccagtgcaggcctggggaggggctctccttagaccaccttgcaccttccctggcacccaccatgggaagagctgagactcactgaggaccagctgaggctcagagaagggacccagcactggtggacacgcagggagcccacgccagggcgccgtggtgagtgaggcccagtgccacccactgaggcctcccgttcagtgggacgacggtgaacaggtggaaccaaccaggcaacccccgccgggccccacagacgggatcagagcaggaaaggcttcctgcccctgcaggccagcgaggagccctggcgggggccgtggccctccaggcgaggaggctcccctggccaccgccacccgggcctctctgctgctgggaaaacaagtcagaaagcaagtggatgagaggtggcgtgacagacccagcttcagatctgctctaatttacaaaagaaaaggaaaaacacacttggcagccttcagcactctaatgattcttaacagcagcaaattattggcacaagactccagagtgactggcagggttgagggctggggtctcccacgtgttttggggctaacagcggaagggagagcactggcaaaggtgctgggggcccctggacccgacccgccctggagaccgcagccacatcagcccccagccccacaggccccctaccagccgcagggttttggctgagctgagaaccactgtgctaactggggacacagtgattggcagctctacaaaaaccatgctcccccgggaccccgggctgtgggtttctgtagcccctggctcagggctgactcaccgtggctgaatacttccagcactggggccagggcaccctggtcaccgtctcctcaggtgagtctgctgtctggggatagcggggagccaggtgtactgggccaggcaagggctttggcttcagacttggggacaggtgctcagcaaaggaggtcggcaggagggcggagggtgtgtttttgtatgggagaagcaggagggcagaggctgtgctactggtacttcgatctctggggccgtggcaccctggtcactgtctcctcaggtgagtcccactgcagccccctcccagtcttctctgtccaggcaccaggccaggtatctggggtctgcagccggcctgggtctggcctgaggccacaccagctgccatccctggggtctccgccatgggctgcatgccagagccctgctgtcacttagccctggggccagctggagcccccaaggacaggcagggaccccgctgggcttcagccccgtcagggaccctccacaggtagcaagcaggccgagggcagggacgggaaggagaagttgtgggcagagcctgggctggggctgggcgctggctgttcatgtgccggggaccaggcctgcgctttagtgtggctacaagtgcttggagcactggggccagggcagcccggccaccgtctccctgggaacgtcacccctccctgcctgggtctcagcccgggggtctgtgtggctggggacagggacgccggctgcctctgctctgtgcttgggccatgtgacccattcgagtgtcctgcacgggcacaggtttgtgtctgggcaggaacagggactgtgtccctgtgtgatgcttttgatatctggggccaagggacaatggtcaccgtctcttcaggtaagatggctttccttctgcctcctttctctgggcccagcgtcctctgtcctggagctgggagataatgtccgggggctccttggtctgcgctgggccatgtggggccctccggggctccttctccggctgtttgggaccacgttcagcagaaggcctttctttgggaactgggactctgctgctggggcaaagggtgggcagagtcatgcttgtgctggggacaaaatgaccttgggacacggggctggctgccacggccggcccgggacagtcggagagtcaggtttttgtgcaccccttaatggggcctcccacaatgtgactactttgactactggggccagggaaccctggtcaccgtctcctcaggtgagtcctcacaacctctctcctgctttaactctgaagggttttgctgcatttctggggggaaataagggtgctgggtctcctgccaagagagccccggagcatcctggggggctcaggaggatgccctgaggcaacagcggccacacagacgaggggcaagggctccagatgctccttcctcctgagcccagcagcacgggtctctctgtggccagggccaccctaggcctctggggtccaatgcccaacaacccccgggccctccccgggctcagtctgagagggtcccagggacgtagcggggcgccagttcttgcctggggtcctggcattgttgtcacaatgtgacaactggttcgacccctggggccagggaaccctggtcaccgtctcctcaggtgagtcctcaccaccccctctctgagtccacttagggagactcagcttgccagggtctcagggtcagagtcttggaggcattttggaggtcaggaaagaaagccggggagagggacccttcgaatgggaacccagcctgtcctccccaagtccggccacagatgtcggcagctggggggctccttcggctggtctggggtgacctctctccgcttcacctggagcattctcaggggctgtcgtgatgattgcgtggtgggactctgtcccgctccaaggcacccgctctctgggacgggtgccccccggggtttttggactcctgggggtgacttagcagccgtctgcttgcagttggacttcccaggccgacagtggtctggcttctgaggggtcaggccagaatgtggggtacgtgggaggccagcagagggttccatgagaagggcaggacagggccacggacagtcagcttccatgtgacgcccggagacagaaggtctctgggtggctgggtttttgtggggtgaggatggacattctgccattgtgattactactactactactacatggacgtctggggcaaagggaccacggtcaccgtctcctcaggtaagaatggcctctccaggtctttatttttaatctttgcctatggagttttcagagtattgcatactaaccccggagatgtgtcaagctggccgggagaagctagggactaaactgcctaggggatctcagagccttggggataaactaagaatctctttgatggtgttggtagagtccctaaatgatggagcagggattttggagcctcatttgagggagatgctaaaaagattccatggctaaagggatagtttgggctgtggttggagattttcagtatttagagtaatagtgttagctgagaaatataattcaggaccctctgagacagcatctgtacagtatctgatgcacagggacaaagagtggagtgggacactttcttcagatttgtgaggaatgttctgagtagattgtttaaaacatcatttgttgaaaagagaacttttagtgaatcaatcaaggaaggaaggaaggctcagtctcaaaagggtagctgatatccagaggaatctggataagcctgcaaaagtctagctttcaaaggaatgcagaagtatgcatgtggaaaattagaagatttttttttacccttaaagtggttcctatgatagttagaatactgtgactttactatgtgagagagttttcaagtattcacttttttttttaaatgtccaagtacgaaaaaattttgtcagtttgaagtcaggtttgtacagaattgatattgttgaaagtttaaccaaagaatgggaatgaggctctttcacaccctattcagaactgacttttgacaataataaattaagtttaaaatgtttttaaacaaattgagcaatgttgagttgcagtcaagatggccgatcaggaccaggacacctgcagcagctggcaggaagcaggtcatgtggcaaggctattttgggaagggaaaataaaaccactaggtaaacttctagttgtggtttgaagaagtggttttgaaatgctctgtccagccacgcagaactgaaagtccaggctgagaaaaacaacacctggataatttgcatttctaaaataagttgaggattcagtcgaaactggaaaggtcctcttttaacttagtgagttcaatcttttaattttagcttgagaagttctagtttccctcaaacttaagtttatcgacttctaaaatatattcattttcaaaattaagttatgtaaaaaaattgaaggacttcagtgtctttaatttctaatgtatttagaaaactttttaaagttactttattattcttccctctgattattggtctctgttcaattcttttcccagtacccaaagcatttacagtgactttgttcataattttttttaagttagttgttttctgccttactattaagactttagcattctggtcgaagtggcttcataaatctttttcaaggccactttttaggagaaagacatcttttttttaatgaatgcaattatctagaattatttcagttaaacatgttagttggtggttgagaggacactcagtcagtgcagaaggtctgtaagccagtccacagagacattcctgggtgaactccctctggccctgcttcttgttggagaactggccagaggtctgagaccaggctgctgctgggaaggcctggactttggtctcccagtaccgcccagacctggggatgtatggttgtggcttctgccacccatccacctggctgctcatgaaccagccagtcttgatggctttgaaggaatgattccacacaaagactctggacctccctgaaaccaggcactgcaaacggtaagccagcggcagccacagctgtggccgctgtccttaaaccttgtaattgtttctgcttgattgagtcttaagtcattgctttaggaggagaaagagacatttgtgtcttttgagtaccattgtctgggtcactcgcatttaactttccttgaaaaacttataagagaaaaacgttgcctgttaaccattaactacagggctcgtgatactttgagaaaatcttagaaaaaaatgtatacagttgtctggaattatttcaatgaagtgtattagttggggtactggcgctgtctctacttcagttatacatgtggttttgaattttgaatctattttgtctcttcttaagcaccaagtatagatacagtggatacactcactggtttttaacggtggttttaatctagaaggaatttaaactggaggctaatttagaatcagtaaggagggacccaggctaagaaggcaatcctaggattctgaaagaaaagatggttttagtttttatagaaaacactactaccattcttgatctacaactcaagacggtctaatgaattttgaagttactggtaaatatacttcctggttgttaaggaatgattatcaaatggatcagtgcttggatctgaggtcagtgtgagaggacagggcctgggctgtggatatacagaaggaaggccacagctggatagaattgaaaaagaatggagacctgctgctgaggcaagcagatcagccggactctttccagccatagcaaagaaccagattaataaagagaaggccagattaataaagcttgctgagcaaaatttagtgaacaaggttgacagcctggctaggaagctaggctctagttaagcacagttggactgagatgtgtaggcttccctgagcccttcaaaaatgtgctaagctgagatgattactctgaggtagccaaagctggacttgagcaggaacgaggtagactgcaatgagctgaattgagctaggccggctaagctaaactaggctgacttaaccaagatagccaaattggaatgaattgtcttgatctgggctgattggagctaaactctactggactgctctgaactgagctgtgttgggctgtgttgtgctggggtgagctgagctagcatgagctactctgtggtagctggggtgagctgggatgagctgagctgggtgagctgagctgggtgagctgagctgggttagctgagctggggtgagctggggtaagctggggtgagctgagctgggtgagctgagctgggtgagctgagctgagctgggtgagctggggtaagctggggtgagctgggctgacctgaggtggttgagctgagctgggtgagcagagctgaggtgagctgagctgagctgggtgagcagagctggggtgagctgagctgagctgggctggggtgagctgagctgagctgggtgagctgagctgggtgagttgagctgagctgggtaagctgagctgagctgggtgagcagagctgggggtgagctgagctggatgagctgggctgaactggggtgagctggggtggggtgagctgggtgagctgagctgggctgagctgggctgagctggggtgagctgagctgggatgagctgggctgagctgggctgagctgagctgggctgggctgagctgagctgggctgagctgggctgggctgggctgggctgggctgggctgagctgggctgagctgggctgaactggggtgagctggggtggggtgagctgggtgagctgagctgggctgagctgggctgagctggggtgagctgggtgagctgagctgggctgagctgggctgagctgggctgagctgagctgggctgggctaagctgagctggactgagctgggctgagctgggctgagctgagctgggctgggctgggctgggctgagctgggctgagctgggctgagctgagctgggatgggctgggatgagctgaactgggtgagctgagctggggtgagatgagctgaacagggctgaactggggtgagctgagctgggatgagctggggtgagctgagctgggtgagatgagctgggtgagctgagctgagctgggctgagctgggtgagctgagctgggtgagatgagctggggtgagctgagctggggtgagctgagctgggtgagctgggctgagctgggctgggtgagctgagctgggttgagctgagctgggctgagctgggctgagctgggctgagctgggctgagctgggctgagctgagctgagctgggatgagcagggctgggatgagctgggctgagctgagctgggatgagctgggtgagctgagctggggtgagatgagctggggtgagctgagctggggtgagctgagctgggatgagctaggtgagctgagttggggtgagctgagctggggtgagctgggctgggtgaactaaactagggtgagctgggctgagctgatctggttgagctgggctgggtgagctgagctgggtgaactgagctggggtgagctgaactgagctgggtgagctggggtgagctgagctgagctgggtgaactgagctgagttgagttgggtgagctgagctgggtgagctgaactgagctggactgagctggggtgagctggggtgagctgggctggatgagctgagctgggtgagatgagctgaacagggctgaactggggtgagctgagctgggatgagctggggtgagctgagctgggtgagatgagttggggtgagctgaactgagctggactgagctggggtgagttgggctaggtgagctgaactggggtgagctgagctggggtgagatgagctgaacaggtctgaactgggatgagctgggatgagctggggtgagctggggtgagctgagttgggtgagctgagctgggtgagctgagctggggtgagctgagctgggattagctggctgagctgggatgagctgggtgagctgagttggggtgagctgagctggggtgagctgggctgggtgaactaaactagggtgagctgggctgagctgatctggttgagctgagctggggtgagctgggctgagctgggctgggtgagctgagctgggtgaactgagctggggtgagctgaactgagctgggtgagctggggtgagctggggtgagctgagctgagctgggtgaactgagctgagttgagttgggtgagctgagctgggtgagctgaactgagctggactgagctggggtgagctggggtgagctgggctgggtgagctgagctgggtgagctgagctgggctgagctggggtgagctgagctgagctgggctgggtgagctgagctgggtgagctgagctggggtgagctgagctgagctgggtgagctgggctgagctgagctgagctggggtgagctggggtgagctgggctgggtgagatgagctgtgctgggctgggtgagctgagctgggtgaactgagctgagctgagttgggtgagctgagctgggtgagctgagctgggctgagctggggtgagctgagctgagctggggtgagctggggtgagctgggctgggtgagctgagctgggtgagatgagctgtgctgggctgggtgagctgagctgggtgaactgagctgagctgagttgggtgagctgagttgagtgagctgagttgggtgagctgagctggggtgagctgaactgagctggactgagctggggtgagctgagctggctgagctgagctgggtgagctgagctgagctgagctgagctgagctgagctgggctgagctgggctgggtgagctgggctgagctgggctgggtgagctgggctgagctgggctgggtgagctaagctgggtgagctgggatgggtgagctggcctgagctgggtgagctgagctgaaaggatctgggttggagtcagctttgcttgggtgagctgagcagggtttagctgagctaggatgagttgagttggctgggctgagctgggatgaagtaggctaaataagctagcttgagctaaatagagctggggtgagctgtacttaaatgagctgtgattgaagtgggctgggatgagctcagctgaactgggctagctgatgtggatgatggtgaggctgagttaggatgagcatgactgagctggtttggacatgaatgagctggacccggctgacttgggctggttgagctttgcaagatgatgtggactaaactgggctagctggcaggatgagagaggttgaactaggctcagatgagctaggctgagcagggcttaggtgaggtggtttgggatgagctgggataagttgggctcagatgagctaccatgaactgggctgaggtggcctgggagaacatgaatcgagttgcactgagtacagccaggatgaactgggataaactgggctaaactgggttgggctaagaatggactgcctgagttatgctaagctgagctgggatgaattggggattgtcaagacttaaatgagccagactgaactggttggacttgggtgagctgaggggacctgctgcagggccggcatagctgagttgaatttagatgaggaagggtgagctagactgagcaaggctagactgcttatgctgagctacactaacctggcctgagttgggccaggctttgttggccatgtctaaactgagttaagatcaacagggagtctagaggggtaggggatgaactaagatgaattacactagctgagctgaattgagataaggtatggtaacctgagctgaactggaaagagatgtactggataaccttaactgggctgagatgagctaggtctacccaggcctggatcagcttaattagggtaggctagaccaaactgtagcagtatgtattagcctgtgccaagctgggctacattaaactaaactggacttagctaggctcagattagtttcgctactctagatggggtaagttgggccaaactgggatgaactaatttaactagcctgagatgggcagatctgaagtgtagcaaacacagccagggtgaactgaatgagtttgaccaggcctggaccagttaggctaaggaccttgtcctgggcagaccgtgtgctatggtggagtttcatgatgatgccataagagttcccccaccataacccacgtttctcctaccccatatacctgtctggtgtgtaaacctaatctttgtgtgctgatacagaagcctgagcccatcccccttccaccaccacctacctattgctttggaatgagcaaggttatctcagcgaatgtctcaaagggaagccgggacctaggcctgtccctgagagcagatgttcatgcccctggagtggctgccggtggctgaagggccagaaccacctactctagaggcatctctcgctgtctgtgaagtcttccaaagacattcctgtggttagaaggcagccctgctgtggctctgtcccatagaccaaacttacctactatctagtcctgccaaccttaagagcagcaacatggagacagcagagtgtagagagatctcctgactggcaggaggcaagaagatggattcttactcgtccatttctcttttatccctctctggtcctcagagagtcagtcctccccaactgtcttccccctcgtctcctgcgagagccccctgtctgatgagaatttggtggccatgggctgcctggcccgggacttcctgcccagctccatttccttctcctggaactaccagaacaacactgaagtcatgcagggtgtcagaaccttcccaacactgaggacaggggacaaatacacagctacctcgcaggtgttactgtccgccaaaaatgtccttgaaggttcagatgaatacttggtatgcaaaatccaccatggcaacaaaaacaaagatctgcatgtgccgattccaggtaagaaccaacccttcccgaggggatggggagagggggcaggcccaggcatggcccagagggagcagtggagtgggtcttaagccagcctgagctcacacctcaacctttcattccagctgtcgttgagatgaaccccaatgtgagtgtgttcattccaccacgtgatgccttctctggccctgcaccccgcaagtccagactcatctgcgaggccaccaacttcagtcccaaacagatcacagtatcctggctacaggatgggaagcctgtgaaatctggcttcaccacagagccagtgactgtcgaggccaaaggatccagaccccaaacctacaaggtcataagcacactgaccatcactgaaagcgactggctgaacctgaatgtgttcacctgccgcgtggatcacaggggtctcaccttctggaagaacgtgtcctccacatgcgctgccagtgagtagcctgtgctaagcccaatgcctagccctcccacattagagcagtcctcctacggttgtggccaatgccacccagacatggtcatttgcttcttgagccttggcttccaacagtggccaaggccaaggatgagcagtaggcagcagggggatgagagtcagatggagggaatcagcatcttcccttaagcagatttggaagatggagactgagcttttatccaacttcacaactagacacatcacaacctaacacagtgttctcttgactgcaggtccatctacagacatcctagccttccccatccccccctcctttgctgacatcttcctcaccaagtctgctaagctgtcctgtctggtcacaaacctggcaacctatgacaccctgaatatctcctggtcttccaaaagtggtgaaccactggagaccaacactaaaatcatggaaagtcaccccaatggcaccttcagtgctgtgggtgtggctagtgtttgtatggaagactgggataacaggaaggaatttgtatgcactgtgactcacagggacctgccttcaccacagaaaaaattcatctcaaaacccaatggtaggtatccccctttccttcccctccaattccagagcataccctgtacctcacagggagggcaggtccccttctaccctatcctcactattatctttgcttacagaggtggccaaacatccacctgctgtgtacctgctgccgccagcccgtgaacaactgatcctgagggagtcggccacagtcacctgcctggtgaagggtttctctcctgcagacatctttgtacagtggcttcagagagggcaacccttgtcctcagacaagtatgtgaccagtgccccaatgccagagcctggggctccaggcctgtacttcacccacagcatcctgactgtgacagaggaggaatggaactccggagagacctacacctgtgttgtaggccacgaggccctgccacacatggtgaccgagaggaccgtggacaagtccactggtaaacccacactgtacaatgtatcgctgatcatgtctgacacaggtggcacctgctattgaccatgctagcgctcaaccaggcaggccctgggggtcgagttgctctgtgtatgcaaactaaccatgtcagagtgagatgttgcattttataaaaattagaaataaaaaaaaatccattcaaatgtcactggttttgattgtccgatgctcatgcctgctggggcaactgttgtgttatgcttgtcctgcacacaccctgtatacttgcctccaccttggcccttcctctaccttgccagttacatccttgtgtgtgaactcagaaaggcttacaacagagtgtgagcatgccattcctccagctacttctagatatggctgaaagcttgcctaccttggtgcaggcagcattcaggcacatccacagacacacagagacagacatgcatttatacatagatctagagatggacatgtatagatacatgcacgaatatgtattcatagacacacagatagaggttccgcatgcgtgcatggacaaatacaaacaccttcagagacaaatatgcacagacacacaaccacacatggaaacaggcacaaacacacatgatcatgtgtgcaccaaaacagaatataggcaaatatagacaagtgaactacatagacatgaagacatgcatacacagacatgtaaagaaacatcttgaaatgtgtacactaacatgtggacagacatggcacacagttacacctggtctctgaccaggaccataatctccagggttcagggctcagagagtccatactaggctgggtggcactgatactcctcagggtcccactctatgattaggggaaatagcccgaggagcaaaatgtgcatttttggctcaacaccatggggcagaagataccccactaaccacccatgacagaaaattagccttggttgtgtctccattaatagaatacctcaggagatcaatgagagagcgcttgacccactcacttcccagtccagatgcagaagacacaatgcaattgtccaaaagaattgtacacacacacacacacacacacacacacacacacacacaccaacaaaggaacctctataaggagtcaccacccaataacattgcctctttggattcacatcctggacattcttcatattcatatccatttgggacctgggctttagaaatccccaagggctcatctttacagaggtcagagatcccaataaatgccctggtcccacagcctctctatctcttggtaccaagactcaacactgctggcaggggtagaacaatcaacacacaggaactctgatcaaagagaggcatgagatgcctgggtccttcaggaagtaaggagggataacctctgatatgcctactcttattcccaaagcccaggagaagggaaacctgctctgaattctcagtctaacagccccgatggtgccacctgctcagagaaagtccaaagaacacaaaaatcattatgccacatttcctgagtctgcctttacccatgtccgtatgttgcatctgccttgcttgctctgctgccccagagttcctgggacaaggccccaagttagtgcctcctccagtttgacctgtgctttgtctctgtctagcttgagctattaggggggccagtcaattctccagaaccagcagaacacccccaaccctgaggcaaatgttcaatcaccccaaggcttggcttgaccctccctctgtgtgtcccttcacagagggggaggtgaatgctgaggaggaaggctttgagaacctatggaccaccgcctctaccttcatcgtcctcttcctcttgagcctcttctacagcaccactgtcaccctgttcaaggtagtgtgtgtggtggggctgaggacacagggcagagacagggagtcaccactcctcactgcccctacctctactctgtaaaagggaacagcaattcacactgtctctgtcacctgcaggtgaaatgactctcagcatggaaggacatcagagagcaagagaccctcccacagggacactacctctgggcctggggttcctgcctgtatgactagtaaacttattcccacatctttcctgtgttgccctccagctttgatctctgagacgggcttctttctagactggccaaagactttgtccacttgtgcaacctggaacaatgtctggaaccacagacagctgtgctgtatacaaatgtcactttgaaataaatacttcaccttgcgaacccactctattgtgaaggaatttgttcttgttttcaaacttttcctgtggtgttgacatcccaaagactctctaaatagagcctgggaacttgaagtgaacagtctgatggggcttaagagtgaaagagggaaaggaggtgtggaagaagagagagagagagagagagagagagagagagagagagagagagagagagaaaccaccctgacagcaaagtatagcacaggcagccaatgggtagcagtctggtttatccaccctgatagaagaaagtagggcagagaaaactccaggcctgatctcacaaaagcaaccgaatctgaaaagtagcctctagcctggggtgtctgctccatccctcagcccaccctcttgggctggcgttgcttccagctagtgcaatactttggtgttagccaaacctttgtggtatgtggggtgtgccttgggagagttggctgagatctctaggatgtttgtatcccttctgcaacatgacaagccctaggggttagcccataacttgaggactcaaaccctctgtctataacaactgctgtggtcactggagaaggacagctaaaggcctgctcacacagcaggaaaggaaagggaggtaggtcatgtacttcagctcagaggaggaagcacagcagatacaaggtgagggcagtgctaggggttctgctgttcaccgtgtggatggctggaggaacctcacagaggtgggactagctggttacattgagagcaggacctgggagcagggcataagaaagaatatcagacagtgggagggaactgtgtagatgccagggtcctaaagagagtctttaaataagcatgtatggtagcaccttggtgatggcccctttctgagttgggtttctagtgggtagctgcaggagagcaacaagcatctattgagaaaacactgtaaagacgatagggcccaccaccaaattccagatatattttaggcattcacctcaataccctactttccataccagcatctgttttagtttccctgggctgcgggtgcaaagtgccacatgtggcagtttgagcaacagaactctgttctttcccagttctaaaggccaggattctgggcttcagcaggctggttcctctgtgcggcagggagaatgtgtcacagacttccagctctgaagccatagcatttgactaatacttgtctcctggcaccaacaccccagttactgtttcaaatgcatagcccatccccatgtgtgtttcctttgtacttactgccacgtttcacgaacccagttctgctgggtttgatgcccaccctcattcagcacaagttcatctcaggcagattccacccactacgacctcagagctagaagtctatgacacgttctccctgctgcacagaggacactagcctgctgtagcccagactcctggcctctagaactgtgaaagaacagagttctgttactcaaactgccacgtgttgcactttgccccagcagcccaagagagctacatagatgttagtatatgacgtaaggtgcagaggtgactttggaattgggcgatgaacctccaggcagtaaacagcctgctgacctttgcattagctgtgtgactgagatcacatcagttcccgacccccaagccccttcagacgtcacatcaatagagtcaaccgttagagtccatcgctataggaatgatgtcgcttgcactttagaaaggttttataaccaggactgtagttgtaccttaagctttgtgatatgtaaagaagtgagctaattatcaaaaggaaacattctgccaagtgatgttgtacttgaatgtgcccaaaacaaacatcccagcatcaaacgctagtatcttaaaccaacacaggtactgagtcatattaaactgaacgtacttcttgattcacacagacctacactgctgtctctgtttgcggagacccatgcagactaggtactggtgcacatagtcaacgagatgctgagggaggagagcacatactttaaggtagattaaaagggcactggacttggctattgacctccaggccacgctcaatgatgaggcaactaagagtctctgtacagccagaaatgtccccatatgctggccaggtataagatagatggtactagacacttggtgcaagagaaagagagtgtatatgacagacataggcacttgtagacttagtacacagcccactcagggccctaactgtctaaaaatgtgaaggagaatccataactcagtccatgagcattacatacacacctgtagctccacccacctcatcttcacaccttttaacatacagatcatcaggttatatcaggcctgtggcactctgaacccatctccatggctagtctatatccagaatgctgatggaccagcggtcaaggaagcctctctacctaccactctgatgccttttcctcctgagcttcatggtcaaagagaggatccatgagagcatccagggaccaaccacagccctatcagcacatggttctccagccatgtcgtcaactctgtctacccttggttattgctctttaataggtaccttgtctcactgtggcttataggttccatacgtgactatgatatgatagttcttcatctcaggtcctctgagtatcaacattctcacagacctagagcctgcctttgctctgaaagctgtatcttctcaacttggcactgacacagacagcaccctccattcctgtgtattgacccacatcctacccggagatattcctcaagaagcctcctccttaacctatgttcttccccggccagcacaagctcctaaatctgtgtcctgggtctgagccttggacctcataacgtggatcttctgtttacagaggttcaccccagcatcctacactacaattacccagcatgggcacctctgaccagacataaccttcctgattaacaatctgcttcttgttctccacattgcagtctttctgatgaggcccacataacctacaggctcctcacctctttctctgacacttcacaacacattcttccttcccttccattacatactgtcagtgtctctaaacccagagaaacacctggcttttcctagcagtcccaatcattcaagttaaggaccctcactttagtgaggatggccagtcccatgacccttcagaatttgttcccatctacatagttctgaggccctgaaggtcaccctctcccaatatctgtacctaactcctcctgcaaagacctgcaatgagctcctctactctgggggatccactaacctgtgtatcatgtgccagagcaggtttgattacttcattccgtattctcatgagcccctgagaccagaactggaatccctgattccacaatctaaaccatcaggttcccatggcagtccattttagagaccttctggtccgtgcctcttcttaatttatccaaggcattctcctgagtctcagcaatgcttctgtctgaagacataatttcctctacttggacactcaggcagagactcgagcctcttctttaaccgattcagtttggatggcacaccaggcttatcagtgttttcttgagatagcactagctagagacagggacagagaggtttagccaccaaagctggacttagatcacacatgaacaagaggcccagaggctatgaaccctctccaatgagctggtcaggaaagagtgggcataatcactcagcctcagccagctcagggacccagaaggcccaggtgcacagagtaggagcacatccaggcttcctaccttgtcccctgagtctcaagagtaccacatcaactactcccacacatccacatgaactaatctcagtcagctttggactccccctcatgtccagatacagaaacctccccagaataaaggggaacctcaggaaataccttatgccacccactgtcaatcatgttcttactcaatcatagggtggaaatagggtggcattcgcatctctggaacaaaggctgtgactctgggaaagacaagagaaagccaggaacaaatacatctgctttcacagcttccacatgtcaaaggggtcagcactaaatgaagctgcagaagaagaagacctcacagacagccagcatctgtagcccttccagatctttgagtcatcctatcacaggagattgagaaggagttgacggaccagcccaagcagaggaagcctgtgtgttcaacagtaaatgtgtttgccagcagcctgatgtcaactgagaagactgtggcgagtgcttgggagacaatcacgggcagctagagctgcacaaccccatagacaacaagcctgaaacacaaggagatgatgaaatatatccagaagactgcggaatcagtttggcctggaccacaggttgatagaaccaaggcagctgagccctgtggtaagtgaccaggagggcagagggagggagcttccaggagcatgcctgggaatgccttcaggccttctgagaagcagaaagtaggcaccctggggttccaggaaccatcccagcactcaagagttactaagggaatagaagcaaacctgagctgaaggagagaaagaaaagtggagggaagcccaagccactcaaagtaacaggcaggacaacttccagtgagctgagagaacaggagtgctggagaaggcagagcaagcccagcagatcaggagaacctgcataggagtctggatgactagagaaacccagaaggtgagagaacaggcttaacagctgtcatggacttagggatatgcaagcctggggcaccaagctgatctgcatagagggcaagggtaagtgggaatccaagagatctaagaatgaccagcgctgggcagagaggtggcctgggagaagatggctggtcttccccatgagtccaatagcaagattgtcggaataggttatcctatgacagatggcagtatcagtgaccaaatgaagacgctatggaagaattggaccatgtgggagttaagagttgaggacacaaggctgacctgcccatgggaactacagctgataaaagtgctgtgattcagggcatttctggaagctctgtgatccaggttgcagtacacaagtaaactgggacagacgggagttctgggggttcagttcagatactaggaacttaggaaactgggaaaagggaagttggggctgatggcagaactatgagaaggcactggaattctgaagaccagaccttctaatcaactatagaggaaatggagtgggtaggagtggtggatacagctgagcatcacaggggacctggggattggggacagctatactggggctagcagtgcaaacacagaaattgggggaccaaagggggaattgaggatgaccttgggtagatagaaatgctggatgcctaaggtacctccaggagcttagggaacctcgcagagcagctacaaagctggtggtgttagtgacactttcagaaccagatcgggcaggttggcatgtagaaatggggttaatggagacccaggacagtggcagattcagaataaaatacaaacaaccgaaagagttatgtgccctgtaagaagttgatctgacacccacagcagagacatctaaggtctcacagcccacatcaaacaggcttctgatctaaggacagcacaaaaggaaggaggcatcaaaccatcctggggaagacagtgcagtagtagccagaagtgtaagcccaacagcagtgggactggtgtagcagccagggacagggtccctgccaagatgagcctcaggggagctgagcagctgagaaactcaccagctgagaagctcaggggaatcagggtaagtggaggttccagagaatcaggggaagtcaagagctcagaacccaagaaggggcacctgcaaaagagctaaggcctatgagagtgtggggaacactttaagcagctttaggggagccaagacaggtagaagtgtggggacccaaacagggaagctccaggggagctaggaaaggtggaactgtgggaatccaggcagagcagcacctggggagcaaggaaagaagtgtggggatccaggcagagcaggtccaggggagccaaaaagtggaggtgtggagacacaagcagggcagcatctggggaaccaggacaggtggaagggtagggacccaggcagagcagcaccaggggagccaggacaggtggaactgtggggatccaggcagagtagcaccaggggaccaaggaaagaataagtgtggggatctaggcagaacaggtccagaggagtcaaaaagtagaagtgtggagagccaagcagggcagcatctggggagccaggacaggtggaagtgtggggatccaaccagagcagcaccaggggagccaggaaaggtggtagtgtagggtcacaggcagagtcgaaccagggaaccaaagaaagaagaagtggggggaccaggggagccaggacaggtagaagggtggggacccagacagagcagctccaggggagccaggacaggtggaagggtagggatccaggcagagcagcaccagggaagccaggacaggtggaagggtagggacccagacagagcagctccaggggagccaggacaggtggaagggtaggggcccaggcagagcagcaccagggaacgcgggacaggtagaagggtggaaacccaaacagggcagcaccaggggagcaaggaaaggttgtactgtggagatctaggcagagtaataccagggaagccaagacaggtagaagtgtggggacccagacagagcagctccaggggagccaggacaggtggaagtgtggggacaaaaatggggcggcttcagtgtgtctggggagcaaggaaaggtagaagtggagagacccaggcagagcaataccaggggctaacaaggtagaagtgtggggaccagaacagagcagcaccaggggagccaggacaggtggggatgtggggacccaggcagggcagctccaggggagccaggacaggtggaagggtagggagccagacagagcagctccaggggagccaggacaggtggaagggtggggaccaaggcagagcagctccaggggagccaggacaggtggaagtgtagggacccaggcagagcagcaccaggaaagccaggacaggtggaagggtagggatccaggcagagcagcaccaggggagccaggacaggtggaagggtagggacccagacagagcagctccaggggagccaggacaggtggaagggtaggggcccaggcagagcagcaccagggaacgcgggacaggtagaagggtggaaacccaaacagggcagcaccaggggagcaaggaaaggttgtactgtggagatctaggcagagtaatgccagggaagccaagacaggtagaagtgtggggacccagacagagcagctccaggggagctaggacaggtggaagtgtggggacaaaaatggggcggcttcagtgtgtctggggagcaaggaaaggtagaagtggagagacccaggcagagcaataccaggggctaacaaggtagaagtgtggggaccagaacagagcagcaccaggggagccaggacaggtggggatgtggggacccaggcagggcagctccaggggagccaggacaggtggaagggtagggagccagacagagcagctccaggggagccaggacaggtggaggtgtggggacccaggcagggcaccaccaatggccaacaaggtagaagtgtggggacccaggcagagcagctccatgggagccaggacaggtggaggtgtggggaccaaggcagagcagctccaggggaggcaggacaggtggaagggtggggacccaggcagagcagctccaggggagccaggacaggtggaagtgtggggacccaggcagagcagctccaggggagccaggacaggtggaagggtggggacccagacagagcagcaccaggagtgtcaggagaggtggaagttaagtagttataggggaacaggggcagaatagaatgagggatgcaggctgagaggatacaggggaaatgtggcaagtggaagggcaggaagagaggcagagtggctacagggaagttgaggcaggtaagactgtctgttccaggtcaaaaaacactgaagaccagtagaaaggaaactggtgcatgtggtagtgggggattcttagcttagcagtcacagggaaagtgagccaagtaggaatgcaggcatggggggcaggcacagctgagcaaacactaaagagctgtagctgaagggttataaggtaccaagctgagaagctgctgggaatctggagctaatggggtgtgggggagcaggctgagcaactacacaggatcagggataggtaactgtgtaaggaggcaggctgagcatctccatgacagctggagctactatgaatgttaagctccagactgagcatctgcagggaaacagaggcaagagggagtgtggggatccaggctgagtaggtccagggaagctgtagtaggtggaggtggaggcccaggctgaggagctacaggagagatgggacactagggagggcagggatcatggccaagcagatactcagtagctgagatagatgtggggaatcagcttaagcagcagacacaggggagcaggatctagtcagcttctagggatccaggctgtgtagacatggagggactgggggagctataagtaaatacactaggcataaaattacagggaaacggaggccagtgggaacgtgggcctcctactgaacaagtaacagagagccagaactgacgggttgaagaggaaccaggctgatgagctccaggaaatctgtggggactcggtcaatgggagaacagggtgagcagctatagaggatcagggataggcaaaaacgtatggagtcaggctgagcagttacatgagagctggagccctagttatgtggaggtccaggcagaggggctggagggtagctgagggaaatggtgctagagaatcaggctaggcagacacaggggagcaggttctagtctacatatgagtggggatccaggatgtgtagagaaaggatagcaaaggtcatggaggattccaggcttaggggtcactgggaaactaagactggtggaagtgggattgtcctaagtgaacaaattccatgaagctagagccagtgggtgtaaaggtagcagactgaaggactatagagtatctgggggtggatgggaatgtggggaatcgtgctgagccactacaaggacagtgtggctagcaggctgtaggagaccaagctgagtatctgaagggaaaccaagggaagtggaagtgtaggattccagaaatgagcaaatgcagggcacttgaggcaggtatcagtgtagggaacgagactgagcagttcacaggtcacccagggtaggtaagagttctggatcatcagagaagcctctggaagccctaagcacctacagtagacctaaggcaggtggggtgcagggaataagttgtgcagctcctgaggaggaggacaggttggagtagaggaggttctgactaaagagttgaatgggagcagggcaggtgggaatgtagaggaactagctagacagaagtccagatgagattgagggccacatgatgccctgagccgatgagctggccttagaaatcactctgctgggaccagggccaggggtttgaggaacaaggctgaggtgaaatggtagcatgacagggaggcaatggcagagaggaaggagaaggcatgcttaattcatggtggagtgcagggagggaaagagccaggaggtctaggctggagctgatccagctttctgcactgatgagaggggcgggactgagttcttttggctccaggagccagggcaacaagacaaaggcgcctagcatagcaaggacacatctggatctaagaccaggagaagagggcaagaccgaaagttcaggaggtcatgggagggagtgggaaatctacaagggactgtctttagaaaagagtaagtgcccagtggagggagtgcccaagcaacaagtccagtgttgggagagatcggggtgggcaaaggctgtatgtgcagtaggcaggcccaagtccccaggaaggaaagaagaagtgcataggaaaacgggtcaggtctagcaggagccaaccgaggtgctcaggactgagaggcagagcccaagacacaggaatcgctgagctcatgcaggtaccaagaataactgagagctaagagaaaaattatctagggaatagggggacatgaggaaggactgttggctgagaagggaaagggacagggagaatcctaagggttggcatagacaaaggaaacacacaggctttgggttgttagtccggggctctgcatatgatccaccgagattgtggaaacagaagagcaggaagatcaaatctgtcccaactatacagggacacacggtcaacctacaaaaggaaggagatgtgaggatcaggggctgagcagtgaggaggtgtgtggaggtgttagagctcaggtgcagcagagactagcatggccctggggatagagggaaggacccaagggacagtagggacaggagggcgaggtgaggtgatgaccagcattatacaaatggtggcgctgtccaacttctagggccctgtgctactgagaaaggaaagggacttccgaggtttggcaatacaagccccgtgcaaaggcagaacccagggcactgtgaagacaacactgcaagacaggagaagccaaggctgagttcaccgaggtcacattagtgagaatacactgcgaggagaggggaggcgctgagcacccagccacaccagacaggcccatgctgagtccctggacagtgggggaggggagcacctggtgacctgtaagaactgtgagactggaggagaaccaaggtaaaaggtgtgtcaaaggacacatgtttagcaggctgggccgacttaatgcaggacacacgtggtggcaaagccaagagggctgcgtatgagccacaagtgaatcctgacccaagaatagagagtgctaaacctacttacatcaaagccaactgaaaggacaaggccagcaaaacgaagctaaggccagagatcttggactatgaagagttcagagaacctaggatcaggaaccattagtgaacagacaaaggcaggtaaagcagcctaggagtggacaaagacaggagaatacagaagacggcagggatgacccgacttcagtttgggcttcactgttgtccaaactgtgtgcagattatggcccatgggtaagaggtttagcattagaacacagatacccacattggacaatggtgggggaacacagatacccatactgcaaggctcttcgggccctttcctaaaagtgtactaggagtgggactgggctcaaagggattaggtgtgatctggcctggtgaggctgacactgacaagcccaatggttgggtgttgcatcctccatttatacagccagggacttggggagggtacaaaatggaggacttgtaggagcttgggtccagacctgtcagacaaaatgatcacgcatactttttcttgtagctgaaacaacagccccatctgtctatccactggctcctggaactgctctcaaaagtaactccatggtgaccctgggatgcctggtcaagggctatttccctgagccagtcaccgtgacctggaactctggagccctgtccagcggtgtgcacaccttcccagctgtcctgcagtctgggctctacactctcaccagctcagtgactgtaccctccagcacctggcccagccagaccgtcacctgcaacgtagcccacccggccagcagcaccaaggtggacaagaaaattggtgagagaacaaccaggggacgaggggctcactagaggtgaggataaggcattagactgcctacaccaaccagggtgggcagacatcaccagggagggggcctcagcccgggagaccaaacattctcctttgtctcccttctggagatttctatgtcctttacacccatttattaatattctgggtaagatgcccttgcatcatgacatacagaggcagactagagtatcaacctgcaaaaggtcatacccaggaacaacctgccatgatcccacaccagaaccaacctggtgccttctaacctatagacaccaataacacacagccttctctctgcagtgcccagaaactgtggaggtgattgcaagccttgtatatgtacaggtaagttactaggccttaaattccagccccaggtccaacaaatgtcctctgaggcccatgttggaggatattggcatatttccacctttcttcttcatctacaggctcagaagtatcatctgtcttcatcttccccccaaagcccaaagatgtgctcaccatcactctgactcctaaggtcacgtgtgttgtggtagacattagccaggacgatcccgaggtccatttcagctggtttgtagatgacgtggaagtccacacagctcagactcgaccaccagaggagcagttcaacagcactttccgctcagtcagtgaactccccatcctgcaccaggactggctcaatggcaggacgttcagatgcaaggtcaccagtgcagctttcccatcccccatcgagaaaaccatctccaaacccgaaggtgggagctgcagggtgtgtggtgtagaagctgcagtaggccatagacagagcttgacttaactagacttctgccctcttactgacctccatgctgaccactctctgtatccacaggcagaacacaagttccgcatgtatacaccatgtcacctaccaaggaagagatgacccagaatgaagtcagtatcacctgcatggtaaaaggcttctatcccccagacatttatgtggagtggcagatgaacgggcagccacaggaaaactacaagaacactccacctacgatggacacagatgggagttacttcctctacagcaagctcaatgtgaagaaggaaaaatggcagcagggaaacacgttcacgtgttctgtgctgcatgaaggcctgcacaaccaccatactgagaagagtctctcccactctccgggtaaatgaccccagagtcagtggcccctcttggcctaaaggatgccaaaacctacctctaccacctttctctgtgtaaataaagcacccagctctgccttgggaccctgcaaaaatgtcctggttctttctgagatacagagtccagcgaggtcatgggctgaggggcgtccagggtttgaggcctgaggtttgactaaggaaaaagggtgatctacactgccagacacagcacttttgatttgctggcatgaacagaatttacctctcactgaaaagtggaggctttatcccgaggcaatccctcttgctttctcttcctctacctaatacatctatagtgggcacagaatatatcatgaaagtaaggacgacccaaactccacctccctagtccacctttacccctcttcctagccaaggatcccactgaaggcactcaatggacacatatggtcacagacagacccttgctattccaccactcaatgcaagaagcgttccagagactaagtctaatgtaacgatgcacatagctgtcactgctctctcactgcccatgagaatcaacatggacccattagacacaacctgatgagcaacactgagggcaaaaggcccatatgtatgcatgcacacacatcttcaaatgcacagcacagtgacacacacacacacacacacacacacacacacacacacacacactggaacctcacatgggcatcctgtgcagtactcccagatgaaaagaaaccaggtctacacacaggatcatcccaacattcacaagtgggccagctgagacagatacaacttttctctgccttggatgcccacagacatcttcatgcacacatgagtttcctggggtcaatctgtccctgaccctgggatggtgccccaacctcacacagttggcacccatccgaaactgtataacttactcacttcccactgtggatcttaactgcagtcctagcatcatggggaatcagctctgcaatccctctggccctcagttctcggtcatcagcagatacaggatcaggcagaccacacagacactacccatgagaggcacaggccctgactcagcctagccaggttcagaactcaaggctggagcacacacagaatgacctagtgtataggccaggccaccatcaggtccagggtgtctggtgagctcagggacaaaactacagcactttggggaactgaagtttctggtccagagagagatcagaaaggagagatggcctcagggagggtctgctggcccagtcaggctgtaactttctcctggaactccacacaacctcatctgacacagggaatggccctagtcacgccgtgttgggataaacaaacgctgacttccctctctgtccagggatggaagtggacgatgcctgtgctgaggcccaggacggggagctggacgggctctggacaaccatcaccatcttcatcagcctcttcctgctcagcgtgtgctacagtgcagctgtcacactcttcaaggtcagccacaccatctccacagtgtccacaccatcctcacactgttcctcatactgtctctgtgatcagctatgccccacactgtcccatgctattgacctgtcttacatgctgggcaatgccacctaaccttctctatgatacagtctcacagtgtcccatgcagtctccctaattccccaagatgtccgcactctattgctgtgttgcctcatgctgcccccacactgtccatccctccctggtatgctatcccaggctgttgtctctattttcatgctctcctcacactgtccctagtgtctcatactgccaatgttggctcccacattgtccccacactctgcacacaaccggacaataaaccctgctgtcccataatgttccctgtggtccccaactctatccctgcacatttgtctatgttccctgaattctcatgttgtttgcacactgttagtgtctaacgaactctctcccaggtgtaccttcttccatgctgtctcacctcatctcccattctgtccttgtactaaccccactctatcacgacactgtccctattcactgtccctatgaagtgcccatgctgtctgcattctgtcccatgttgtatcctcatcccggtctcatgcagttcagatctatctgacactattcccactctatgcacacatttccccctataccatccctgtctgatcaacatgcaatcctctagacacccatgtagcaggttagagactctagggatgggtacctgcctgactgagctacctctcttggtgggagaggaaacacaggtgagagtgcagtcctgatcttatcttattcaccctgtcccacaggtaaagtggatcttctcctcagtggtagggttgaagcagacgctggttcctgaatacaagaacatgattggacaagggccctaagccacctcctataatggcaaaggattccccacgccctagaggaccctgtccaatgtgccaagcagtctgactcagatcacactgtctgctcacttcactatcttctgtctatgagacccaacctccctcaattcttctctctctggaggactatgtggacattagatttccacaagccacagcctccaggacctaaaataccatcacagcagcagccaggacactagatagggtcagaaggaccatagtttcctgactagtttatccaatctgttgggacagaagaatcactgaaaaagtgacaagtgcccaagttgcctgtgttcagcttggaagggaccaaccttggaaccagtcctgtcagcatcatcttctaaaacacaagaattgagtatgtaaatggcagattttggatccccagggtaagacagacttcaaccaggccacgacctgggcaatcatggcccagctgaagttgactgaattattccagtggccttcacatcgtcttgccaggttccttcttaccacttccatgaaccctgggatacagaaaagaactgtgcttctcgggatcttgggacagaactgtctaattggtgggatccttaggtagatctttcttccagtcacgggtataatacaatacactagattctcacataaaggaaaaaattcacacacaactccggccagtcctgaggcctagacaccaccacctctctggaattctgagctctatgctggaggcacaagagaggaaggcctggacttcatggcctctgtgtagccctagtaggtgcagaggcccctaagccggggttgggtgaccagcaaggacctcctggagagggatctgatgagtagattccacctgggacagaaggaaaaagatgaaaagcaacagaggtggaagggcactggagagagccatggtatagcaggtttatcttgcagacctgacatctgtccatgactctgagacttagctaatgacagctggggcagcagtccaaggaattaccatgccccctaacaccaggctcctggagtgtggagtgggtctactccagagctccaatacctgtttctccatcacttctcagccaatgagaaatcggtttccagacaggaagaaaaatgaaggcaggaaggaaaagtgggcacctgttcttctgtgagtggcaggaagttctcaaaagactcaggactttggcttctaacttcctgtggatcattgatgtctctaaggtctctgtctgctttgttggttttgtttgtttttggtttggtttttttttttttttttttggtcaataaaacgttttttcaaacattccacaatctctgtgttcttcctatgtgaaccagccctggtacttagaaacagcactgttaagtagaccagtgagtcatgaagaacatactacctctcctggtcctgtgtcctaccagttctcctctaagggtcccttcacagctgtgtgccagctctgctatcctataccagataggtcctccgtctttcttccctatgggcagtttcttcccagccagaagctgcctttgtcctgtaggttgcccactcatggcctcccacaccagccacacaaactaagaagcaggtgtctcagtgacctcaggctcagtgataacatttctatggaaaagtgaaggaataagaaagagaagaaatactccagagtcagggaagagaaagattataagggatgtttgctttctcaagtatgtttggagaagttccagatcaggcgttgacaaggtcgggttctcagcagggctcttcttgcctggtaggtgccttctcctccttgtgacctcacaggctttccctctgtgtgtgtctctgtcttgatctcttctcataagtacacagtcaggctagaagaggtacaccctagccctaattataacttatcagtttatgaccctgtctgcaaacataggtcatggtggcttaaatgtcatttgctgaatcttctggggacagaatttagtccacatcagctctccctatggaccccaaaagttcatatccttcccacatataatgtccctcaccccatacaaacaccccaaagtctcacccttccaccatcagctctgtctcaattctcctccaagactgctagttaggtaagtgtgagatgtgggtgtgactcattcaggatcaagttcaagccatgactgtcaggaaagaggtttaggccgtcagcgcagagcagattccaggaccatctgagcagttgctgaggttcaaaggcagattatagactgattccttgctatagagaagatagcccattgtgatcctctcatactagttcagtgataacaattctatggaaagtgaaataataagaaagagaagaaatactcgagtcagggaagaaaaagaacctgcaggggctgccaattgtctcttgttctgctgggcgtgtctgtgccctactagagttggattctgtcttcccatggagacaaggagacaccggctccatggcctgagatagcaccgtagaggggcccagaatttgcttctggaatgtaggagtgttagcaccaatggagagctaaggtacacaaaggcctcctaagcaaagacccaaaaacaggagctaggtgctaagtgtgcagttgagttctcagatggtgtttagatgtcctcaggtatatccttgactgttagagactgttcaagccattatgacctctagtgatggctatatgagggaaatcaactgggctggactggtcaagagaagatcctgtcaccacagctacagtggtgaggggctgggtggggggcagaatccaaactggccaatgccattacagtttctggtatagggaaagacatgcttttcctcggacagagaagcagcagatccctgtgagtggtattgctgctggggaagccatagggagatggacctcggagggatttgttgctcatgtgcagacagctgcaaggagcctgggctttggccaagcacactgggcagccgctacaatgctacacactttgggagttaggacagtggaacctagactacaaagaggacagctgcactaaccctgagaaaagttacttaattcttcacaaacctctgtttaatgtgtgaccaaacatccctccctgcaaagcgagggaagaagaacatagaatagtgaatttaaagaacatttaggcctgggacagtttccttgctcagataagaggaaatgtttgttttatctcatagttcaagtgtacagtctgtcacagcaagagtcttagtttcatttctgttgcaatgataaagtaccctgaaaatagcaactttattcagcctgctgtttaaggttacagtctatcaccgtgaaaagtgagagcaggaacttgaggcagccagtcattcacacaatcaggaacagagagaggggtgtgcacgtgcccactacccagtgacacgtgacgttagaaaggaaatttggtggggataaaagaggaaatggaggagagggagtagggacggattttatatattacatgtattatgaaattccctaacaataaagagagctacaaacggctcattaggagaaggtacaatgtgtgaagctcttcagtgggttatgaagtagggatggtgaagcccaggtgcactgaaaatgaatttaccccagaagccgcccttcatatgtgcaccatgacatgtgcacgcacacacatgtacacaattatacatagacacattcaacataaacacaacatacatgtacatacaccacaacaccacacacacacacacacacacacacacacgaaacacatacataaacacacacaatcattcatggacacactcaacataaatacaacacaccacatgccctcatacataccacacatacacacacacatgcacacacacacacacaaaacacatcaatacatgcaccaccacacacataccacacacacaccttcatatacaccactcagcacacacagagacacaaaaaaaatacatatttacacaccacacacacatacataaacacacacaatcatgcatggacacactcaacataaatacaacacaccacatacactcatacataccacacacacacacacacacatacaaaacacataaatacatgcaccaccacacacacataccccccaacacacacacacacacacacacacacacacacactagaacacactaatataataatgtttaaggactgcatcatttttctatctttctgcaggcacttgtctgaggtgctgaatgttttcatgctcccatccttgccaaacagcactttatgaggagttataaccatgccacagcctcagtgtggtgctgacttaaaagttcctccaccaaataaactattccattccttccgaaaatagccagatactttcccagaatgtaatacaggtcatcaggtcttgatgagatcttgtctccccaccctgaaacctcatgagctggatccttgctgtccttaccccctttttaatgttccctgcactgggctttctcgtcccacagcatccatgtaagttatcctgaaagatgccacatcctttcctctgctgacaaatctgtccaccttactgtttaagttcctagagtaggtatattctgagaaagtacttatttatatccagagaatatatacatttcacatagttccttttgttctggttattgatgtcattgggtcctgaagttgtgtttggaccttacaatgacaaaaacccatctttccctttcttttaccaccaattctatctcatctatctccctgtttctctctgtccatatctctgtctttttctctgtgtgtgtgtttctgtgtgtgtgtttgtgtttctctctctctctctctctctctctctctctctctctctctctctctctgtgtgtgtgtgtgtgagagagagagagggggggggggagacatgtgtgtaggtgcgagtgaaggtcagaaaaggcatctgatccctgaaacgagaattacaggaggttgagaaccacctgaccagttacagagaaccaaaatcagggtcctgtacaagagcaatatgctctcttaactgccccgacatctctccagcaccccagctttcttctgaggtcttgtatgtcatacataatgaactcagatagggcacacccagtgtagctcagcgtagccagtacagccacagctagagatttgaagaactgggccatccttccagctgggcactgtggcctggtttctgctcaattagagcttcaatcctcaagatgaaggaatcgagtctgctgggccatggagcaggcctgagtgcttgctctctgtgggcaagcatgtgtcctgtttgttaccacagctagaaacagatgcttctgctgagaagctgcctgcgaggaggctgttgatgcagagtcgtgaagcgtggcgaccgcggcaacccacatgacaaggctgacttacagactgtggcttcagtgctggggcaaacaacaaccaagaggtcctacagacactccagagccacaaggtcaccacatgtctggagcagatggatttcagtcaacacttctaccacccaagaagcttttgtggtgctgggtatagatgaactcaagtagcaaggttcgggctgtgcttgggaatcccggcaacagaagggtttgctggagtggtaccacaagcattgctgtagtgcaatttccatcttctatgtggagaaaagcccaagtacagactgtcaggacaaaaccaggcagcttccatccccaaaactgcccatgagtctccagccttggtaccctatggcctccgaaaccgcccaggggtgtgtgtatgtggtctctaatgaaaaacatcaagccaaaaatccagaaaggaatctgggcacaacctcccagtggccacaatccttccaggaagattttcttcagtaggctgaggtaaacagtcttacggaaagtgccatccagtatctccagtggtctggaagaccctgagaaacacttgctgaccaacatggtcatttgtctactcattactgcaggcgtttgttttttaagtgtgcatccgcctgcgcgtgcccgtgagcctgagcgtacgcgtgtgcgtgcgtgaggtgcggtgcggtgcggtgcggtgcgtgcatgcgttgcttgcgtgcgtgtgggcgggcgtgcaggcgtgcgtgcatgtgagagagagaacacatgccgcaggacacaaagaaaccagaggacttgcaaaagtcagttctctcaacaggtcagtcctagatacggatcttcggcagccttacccgctgagccaccacactggcccattctttcagtcatttctccatccatctggctctcctgaggtgagaaaccttggccctccaatccttgcagtcagcattggaagcagattgacagtgatgggcacataggagagggagcagtgccagatgacagggcaccgggagacattgcccatatcttacaaagggtgaagatccaaggactggtttgggagccttaggggatcagccagggcctctggtgtagcagagacccagcactcctggtcaactgtacctacagaggtttaatcatttctctttggtaggctgctatgaccaatggatgctttgaaaggtctgtactgacctgtggggctcacgcagaactgggcctagcaggtggggtttgaagtttggcagcctccgtgggaaggatgtgaggaggtagacaatgctctggagagactggagccctgaaaggggggcactggatgtttgctgctcagattgggggtgatggccactcctgggtcacaaagaaaggcagggacttctcatgggatcactcaggaaagagatctggagaacctggaaagagagattatcaggaaagtactccaaagccctctgggagcttttgctgagtctctaggttggtaccctaaagcttgccagggccacaaacctctcttggtgggattaagctgctgcaagggtcccagattttttttctttcacatttgagttgttacttatgggtggcacataaaattactcttgttttcccatcaacgtcgtagggtaggaacccaagatcggagaactgatttcttccatatagtcccaaattcacacccaagtgacttgcttcctctcttagctcctcccccaccatcaccacctcccagtaacactgtcatgctctggatccatcaccaagggcttgacccgatggttagttcagagcactcacgatctcacagtctctggaaagtcctgcatagacagaagtcccatcacttaatccactcgaggggacaagcaaatgaaccgtctcatcggaggatgaagaatcttactaccgggtcccgacatcagcttccatcctgctgccttgtcccaggaatgtcagacttaacacccacgtttccaacccaactgcatggctagtcccttaaaactcttcattccctccccagtctctctgcatctgtgtccatatctgtctaaagaaccatccttccgcaattggagctgtggccataaattttgcgtgtgtcatttatcggttgtttatgtcaaccatctcccttctctgttcctgttgtctgcctatcacctccatcctcatcaccctctgtccctatcatatatatatatatgtatatatatgtaaatatatatatacagttgatatgcaggaaatatatattcagtttatatgcaggatatatatatgcagttgatattgatatgcaagatatatatacagttgataggtaggatatatatgtgtatatgtatatattgtatatatatacagttaatatgcagaatatatatacagtttatatgcagaatatatatgcagattttaagtggactagcaagccccgagccctcaagaaccgctaggatccctgcccagtcatgttactgtcattggaagtcatcttctgtttccactccaccaccacagaaaagatccacttcatctgttgggcagggtggttgaggagaaccaagaccagggccctttaattctgtggaggaaccaaagacagctcctgctacataggagcctgtccggtggtatggggaccagggagaagttagaggtgtggaatacagggatagaatggtgtacaacgagggatcatggtgtaagggagggtactgtgaggacagtgtgtgaacagagtgtagacagtgagaagaacttggaggacagcatccgcagcatgggagagcaaaggaaggtgtgacgacattatgaagatattgtgggaactgcacgtgagtgtgaaagacagcatggggtagcaagggaggagctgtgggacactaagtgtataggagggaagtagcatgagacgctctagagcagttgttctcgaccttcccagagctgtatcctttaatacagttctcatgttgcggtgacccccagccataaaattatttcattgctactttgtaactgtaagtttgctaccgctatggagtatattggaaatacttgttggtatgcaggatatctgatattcagagtggctacccatggcataagaaccactgtgctaagtgggtagaagggccaccatggaaatagcatggggacactagaaagacagcatgatgagagtattgtgatagcattgggatggtgtggggtcttgtgaggatagggtggggacagaagagtagacagcataggtcgtcacagggacagtataggaacagtgtgaggacagtgtggacactgtggagatgttgtggctgaccttgaagagtgtgacagctgcactgtagtacacactgagcaggaagaggctgatgtagatgatgatggccgtccagaccccgtccagctccctgtcctgggagtcagcacaggtcttgtccagttccagccctggacaaagagggtagtcagtctctgtcccaacaaggctgggacaattccctctatggcaggtgcatcagcaatgaggtacccactggactgggccagtagattgtttctggggccagccttctgccctctccagaccagcagactacactctcccaactgctccaacccaagtcccggactcagccagacacaagatggcaatctggactgtgtaagaacccttcccacctgctccactcctcagatttggggctgtctgggctgaatcagagcctgtgaccactgaccctctgcctatgaccaagcccagaaagccagtgtaatggtggaccccaggcctagtgatgcctggccttcagagttccacactgggaagtgaattgggccactcagctatgtgggaaggggactgtcatctctatgggatgaaagcatgggtctgaaggtccagaagcagaatggcatgagagagtgtgtattgtgggacaagttgcctttggaatcctttggcagtgctatctgtctcagctgagccagatgtgaggaagagcctcagagaaggcctggtgccttgatgggtctgagttctgtactgggagctcctatgaggtctcggagtgtaaggcttgtgtctgtgctcatgcacaccagtgtacaagtctgtgtaaatgtcatgtgggttgaccgatggtcatcagactgctaggcactggagtcatctgatggctctgaattctgcattctgtgtcttcaagataagagacataggtatctagcccagaaaactagtctcaaggaggagagagggtcatggcaaaggtagacagacagaaattccagtgctttgacctgagatcctctccctgggcacaactgttcatcctggttgatctagagaagaaaatgacataagcctgacctccaatgggccatacctctgctgagcatcctctcatcagttttcctgtccatcttggtactgctgaccagatgggtcacacacaggtaatagcctggctcgtccagaagctgccaggcatgatcactgagctcctgaaggaagacagcttgaactataagacagatgtcgagtttcacataccagtgaacaaagctccagacttccaagacatgattgctggctcagggaagtagcccttgaccaaacaacccatgttgccatgggaaccaggaaagagatggacagggccatggctcttgctgcaaaggggggaagagatgtgaacatactgtccagcctggagaagtctttttctccatgcagccctgggtcttctaagatgggatctgctcctactcttcacgaacctagccagtttctgttttctctgaccccagcccctactcttagtctcaggaccttgcttttcacccccatccttacactgtaccccagccctgccagcatcgaatctggtcccaatgggttctttccttccaatctatagggttaactcccctgagcattcccactctcccctgttcctgtgaggccccaggatcagaattgtggaccacaaccccagaaataaaacccatggaatcccagcccccagagaccctccctgtgcacggcctccctcagtttagcaaagagttacttctggacccctgcctagcttctctctgcagccatatgacccactgcttataaacacagccagaagcgccagttccctttctcctctccacctggcttcactctgcactctgtactctcactccagacttcactttcctcctggagccacagacacttctgggctctagagagattgcatcagctggagagggaatggcagaggctgccaagtaggctggttagaggtcagacctgagagaaggtcttctccaaaaaggtggtcaggagaatggacataatcactcagccccaagcaatccaggaacactgggtgacagctagtctctacatcttcttctaagggtctcaagaggaccacttcacctacccctacaggaggtaacccagaccatgtctggactccccctggtctccccctaccccaaacactgaaaccaacagaagaaagaggaacctcaggaagtgtcccgtgtcacccagtttcgatcctgttcttagtctgtactgggttgggagaagtgtgatgttcacacctctggggcaaggactgtgaatcctggaaggatgagacagatctcagagctgggctgttagcagcccagcaccaatgcaaaaagagcagcagtcacaaggttccacacgtgaatgtagtcagcagagaagctggagaaagccacagcctagggagagcagtgagcttttccagacctaatagacggcagaacacaggaggatgaggagttgacagatcagccccaacagaggggcctgtctgttgcaaagaaaaggtgcctacctgcaacctggtgccaaccaggcagacaccagactttccacggacagaagccaagaccactaaagccgtgcccacctacagacaaccagagtaagcctcaaggagttaatgggatagacccggaaacctgagggtctagccaggcctagaggccggtggacccaggacagctgaaccaacagagaaaagaaaacccagtggagcaagggcagaggcatacagaattgagagagttggtaaagaggggatggggaacgttcacctgggaggactgatacacctattagaaagagctagagtcagagtggatgcccttgtgactcccggcattggatagcagatcccaagaacaaagctgaaagaaggtaaatttctcaagagaaagtcttccagaggaactatgggtaccaggcaataagtagtacatccgtaggagggaaccagacagtagtacatctgtaggaggggaccaggcagtacagctgcaggtagggaccaggcagtatatctgtaggagaggaccaggcagtatatctgtaggaggggaccaggcagtagtatacctgtaggaggggaccaggcagtatatctgtaggagaggaccaggcagtagtatatctgtaggagaggaccaggcagtatatctgtaggagaggaccaggcagtagtatatctgtaggaggggacaaggcagtacagctgcaggtaagctaaggacagtaagagtagtagagagccatgatgactccaaaagctcagaagacctggcagagcagctacagggaatccggggctggtggagttgggaggaccaagccaaagagctataggtaagccgaggctggtgaaggcacaaaaacaagctaaggagctacagagggggcaagggctgtggcaggtgtggctaagagaggtccagggcacccccaggaaccagaaagagctttacaggagttctagaggaggaaggagttggggagacaggctgggcatctgtaaagataaggtagcagttgtcacagtttgggtctcagagctgcccaggggattaggggaaaattctgagaagctgtgggagagtaggggatggtaggaatgtggaggaccagtcctagcagctgtggggaagctggggatggtaggaatgtgggggatcagtcctagcagttttggggggagctggggatggtaggaatgtgggggaccagacctagcaattttggggggagctggggatggtaggaatgttggggaccagtcctagcagctatgggaaagctggggatggtaggaatgtgggggaccagtcctagcagctatggggggagctgggatggtaggaatgtgggggaccagacctagcagtttttgagagctgggaatggtagcaatgtggggtccagtcctagcagctatggagtagctgtagatggtaggaatgtgggggaccagtcctagcagctgtggggaagctggggatggtaggaatgtgggggacaagacctagcagctatgggtgagctgtagatggtagaaatgtgggggaccagtcctagcagctgtggggaagctggggaatggtagaaatgtgtgggattgttcctagcagctatgggggagctggggatggtaggaatgtggaggaccagtcccagcagctatgtggggggctgtggatggtaggagtatgggggaccagtcctagcagctatgggagagctggggatggtaggaatgtgggggaccagtcctagcagctatgggagagctggggatggtaggaatgtgggggaccagtcctagcagctatgggagagctggggatggtaggaatgtgggggaccagtcctagcagctatgggagagctggggatggtaggaatgtgggggaccagtcctagcagctatgggagagctggggatggtaggaatgtggaggaccagtcctcacagctgtggggaagctggggatggtaggaatgtggaggatcagtcctagcagctatgggtgagctggggatggtaggaatgtgggggaccagtcctagcagctatgggagagctagggatggtaggaatgtggaggaccagtcctagcagctatgggagagctggggatggtaggaatgtgagggaccagtcctagcagctatgggagagctgggaatggtaggaatgtgggggaccagtcctagcagctatgggagagctggggatggtaggaatgtgggaggcctgtcctagcagctatgggagagttgaggatagtaggaatgtgggggaccagacctagcagctatgggagagctggggatggtagtagtatgggggaccagtcctagcagctatgggagagctgggaatggtaggagtgtggaggaccagtcctctcagctgtggggaagctggggatggtaggaatgtggggggcctgttctagcagctatgggagagctgggaatggtaggaatgtgggggaccagtcctagcagctatgggagagctggggatggtaggaatgtggaggaccagtcctctcagctgtggggaagctggggatggtaggaatgtgggaggcctgtcctagcagctatgggagagttgaggatagtaggaatgtgggggaccagacctagcagctgtgggggagctgggaatggtaggaatgtgggggaccagtcctagcagctatgggagagctgggaatggtaggaatgtgggggaccagtcctagcagctatgggagagctggggatggtaggaatgtgggggaccagtcctcccagctgtggggaagctggggatggtaggaatgtggaggaccagtcctctcagctgtggggaagctggggatggtaggaatgtgggaggcctgtcctagcagctatgggagagttgaggatagtaggaatgtgggggaccagacctagcagctgtgggggagctgggaatggtaggaatgtgggggaccagtcctagcagctatgggagagctgggaatggtaggaatgtgggggaccagtcctagcagctatgggagagctggggatggtaggaatgtgggggaccagtcctcacagctgtggggaagctggggatggtaggaatgtggaggaccagtcctagcagctatgggtgagctggggatggtaggaatgtgggggaccagtcctagcagctatgggagagctagggatggtaggaatgtgggggaccagtcctaggagctatgggagagctggggatggtaggaatgtgggggaccagtcctagcagctatgggagagctggtaatggtaggaatgtgggggaccagtcctagcagctatgggagagctggggatgataggaatgtgggggacctgtcctagcagctatgggagagctggggatggtaggaatgtgggggaccagtcctagcagctatgggagagctggggatggtgggaatgtgggggaccagtcctagcagctgtgggggagctggggatgataggaatatgggggacctgtcctagcagctatgggagagctggggatggtaggaatgtggaagaccagtcctcacagctgtggggaagctggggatggtaggaatgtggaggatcagtcctagcagctatgggtgagctggggatggtaggaatgtgggggaccagtcctagcagctatgggagagctagggatggtaggaatgtggaggaccagtcctagcagctatgggagagctggggatggtgggaatgtgggggaccagtcctagcagctgtgggggagctggggatgataggaatatgggggacctgtcctagcagctatgggagagctggggatggtaggaatgtggaggaccagtcctcacagctgtggggaagctggggatggtaggaatgtggaggatcagtcctagcagctatgggtgagctggggatggtaggaatgtgggggaccagtcctagcagctatgggagagctagggatggtaggaatgtggaggaccagtcctagcagctatgggagagctggggatggtaggaatgtgagggaccagtcctagcagctatgggagagctgggaatggtaggaatgtgggggaccagtcctagcagctatgggagagctggggatggtaggaatgtgggaggcctgtcctagcagctatgggagagttgaggatagtaggaatgtgggggaccagacctagcagctatgggagagctggggatggtagtagtatgggggaccagtcctagcagctatgggagagctgggaatggtaggaacgtggaggaccagtcctaggagctatgggagagctggggatggtaggaatgtgggggaccagtcctagcagctatgggagagctggtaatggtaggaatgtgggggaccagtcctagcagctatgggagagctggggatggtgggaatgtgggggaccagtcctagcagctgtgggggagctggggatgataggaatgtgggggacctgtcctagcagctaagggagagctggggatggtgggaatgtgggggaccagtcctcgcagctgtggggagctggggcaggtgggaatgtgagaaaacaatccttgagctatggaggagctggggatggcaaggatgaaaaggggcaaatcctagcagctagagggaagctggggcaggtgagggcgggtgtaaggaaccagacctagaaactatgggggaagtggagcaggtaaaaatgtgataaaccagttatgcagtccagaggctggtaggagtgtaagggagcagacatagtggctatggggaactgggatatatgggagtgtaagggaccagattcagtagctatggtggaacttgggagtgtagatgagcacgctgaaaagctatggtgcaactgcaacaggttgtcagggtgtaaagaaccagacccagcagccatgggaaacctggggaaagtagcgatgtgggggaccagatttggcacctataagggagctggggcatgtggacatatgaggggccagaagcagcagttatagggaaactttgaaatataggcaagtgtaccaagaagccgtagtggagctgaaacagatcctaggtcctatggaggagctgaagaaggtgggagtgtgagggaccaggccgagcatctgtggaagggctgaggcagggctctgggtcggatgggagtggcaccccagagaagccctagaagctctggcgatggagctgagcagttacagtggacttggggctggtgggatcgtaggagaccatgtagctgcagaagagctggagaaaacaggagtatgaaagacccagccaagtagccactgaagagctggggtgttattggggtgtgtggggacacagtcccagcaggtttatagaggttggagccttggcagtatgtgcagtaccaaacccagcagcttggttcaggggcttgagtagaggcaggctaatggggtccacggtaaccctaggcacttaggggactggattgcgaatcttcaggggagctggaacaggcaaagttaaaaggaatcaagcacctggaagaaagcaaggaaagataggattgatggggatccaagaaactcccaggaagtaaccccagcagggacatctgggagctcagttcagacactgaatcaaaagcacagaggaaggagaggtggtaggtttccaagctatcctgtccaggccaatggagcagccaggaaggagggaaggagaccaacaggaatggggcagctgtagccagcagggtgtgagagacagggatgaggctaggtggctagcaagaagggcaacttagtgggagaggggtgaattaaccaccctgacctcatgctgacaggggctgagcaacagacaaaagaataagaaagccaagagctcatggctggaactattctggctgtctgctctgactgtgttgaaggggctaagcacctgttagctaatgaggctaaaacagttaaatgagcaaagtagagcaaaaagctcccacagcggagagcatgggagaacgggagactgtgagatcctcggggggtctaggagtttatctcagagtgaagaacagtgaaaagctctgcttgggagttctttggggaatggcgatcatcctgggaactcccttatagacctcatggcatggaggagagcaggagctcaggcagacagagtagctgtgtgtgagctggataagaaagaaaagagacaacagggagagaagagaaaagggatgggaaaggactcagggctctactgaattcaggcagaagagcttggcttcaggatgctgggggccaaggaaggtgtctgattgagcaggaacatagtcaggaaaagaccctggtgctcacattcccagacaaatcttacaggttaaagttctagtatcagaacccctcgctcagatcctaggggcttatgggaacataaggcaggaagtgaaacctcttaggacagcacgaagtagcctgtgttggcccacagaagaagagcaaggtaactctcagagtttgagcaggggattgaggaaggtagtgtacaggagaggcagaaagaccagaaaggtccccagagtaagaatgaatcaagaatttatgtgtggtttggttcgatgaaggcaaaggcagggaagatagatgagaaactgatcctctttcacaaccaagaactcattgttcagtgtgagttttgatatatagaaggggggggaatgtgctattaaaagtaaaaaagaatgaaccagattcaaaagggaaaggggactaaatgtcttcctgaataatgcagcatacattcctatttcaagagctaccggcaagagaaagggacacttctgggatgtgcccagtaacattagcactgtcagagagaacccagggcagtgcgaagggtgaggtgggggaggaaggtgtctgcactcatcagcgtctcatcagggggcactgagctgtgtagaacaagagtggccagctaggtcaagacagaaaggatgcccacacacagaaggtgtagggtagagggttggtagtaatccccaggaagcagggagcaaggtccaaggagagctaaagtcacggatagagacctagggcacagatttaggagccagagtttgtgtaatgttagtagattcagtaggggcttctgaagggcctcatcactgaaagatcaaggctcctagggctggagagttggctcagtggttgctgctcttccagaggacccaagtccagttcccaacaaccacatggcatcttacaactatctgtaagaaactccagtttctcgagattcaataccctcttctaacagcacaggcatcaggcacacacatagtacacatagtcatacatctaaaataaaatacctaaaaaaaaattaaggtcagagtgcagggtctagaagtggaagctgctgacaccacttaccccagagcaacttgagaagacacagtctttttagagcaaagctaaggccagagcctctccaaatatctgaggccacgcatgttggaaaagctcacactccctcctctcttgcagcccaaacaacagccccatctgtctatccactggctcctggatgtggtgatacaaccagctccacggtgactctgggatgcctggtcaagggctatttccctgagccagtcaccgtgacctggaactctggagccctgtccagcgatgtgcacacctttccagctgtcctgcagtctgggctctacactctcaccagctcagtgacctccagcacctggcccagccagaccgtcacctgcaacgtagcccacccggccagcagcaccaaggtggacaagaaagttggtgagaggacaaccaggggacgaggggctcactagacgtgaggataaggcattagattgcctacaccaaccagggtgggcagacatcaccagggagggggcctcagcccgggagacactgtctctgcctccctcctggaggcctcctggaggcctctgcctatggccacccaccccctaagacatgatcctctggtatagatgtctgtgtcatgcataggatcataccagggacaaactttcctctctggtttggtgccttctctccttgaaaacccagtaacatccagtcttctctctacagagcgcagaaatggcggcattggacacaaatgccctacatgccctacatgtcacaaatgcccaggtaagtcactagacctggaccccagctccacaatgatggcaagagctgtaagcatcccagcactgcaggataagccacgtactgacccatttctatctctcctcatcagttcctgaactcttgggtggaccatctgtcttcatcttcccgccaaagcccaaggacatcctcttgatctcccagaacgccaaggtcacgtgtgtggtggtggatgtgagcgaggaggagccggacgtccagttcagctggtttgtgaacaacgtagaagtacacacagctcagacacaaccccgtgaggagcagtacaacagcaccttcagagtggtcagtgccctccccatccagcaccaggactggatgagcggcaaggagttcaaatgcaaggtcaacaacaaagccctcccaagccccatcgagaaaaccatctcaaaacccaaaggtgagagctgcaggccgactgcctggggactgggataggtataagaatgaatgcccgtgtggacggccatgacctctgtgtctgtttctatccccacagggctagtcagaaaaccacaggtatacgtcatgggtccaccgacagagcagttgactgagcaaacggtcagtttgacctgcttgacctcaggcttcctccctaacgacatcggtgtggagtggaccagcaacgggcatatagaaaagaactacaagaacaccgagccagtgatggactctgacggttctttcttcatgtacagcaagctcaatgtggaaaggagcaggtgggatagcagagcgcccttcgtctgctccgtggtccacgagggtctgcacaatcaccacgtggagaagagcatctcccggcctccgggtaaatgagcacggcacccagaaagctctcaggtcctaagggacactgacacccatctccacccttcccttgtgtaaataaagcacccagcactgccctgggaccctgcaaaactgtcctggttctttccggggtatagagcctaggtcacgggctttaaggtctggctggggtttaaggccagagttgtcttcaggaagagagtgaggtttccacactgccagactcagagctcatgagtcatcagggcctggagtgttggggcttagctttaggaagtgcctattccttgacttcaaactaaccagcagctgccagacggagagatacacctaggaaacctccaagggaagaaacacacaaactccaccaccctctgcctgttcctatccccatgtcccactcctctgcctatgggtttctctgagtctattgcacacatggccatgggcgtgccagagacccttgctatccctacactcaactaaacccaggcagcttttcatgggctaggtctgcacacccatacagactgcccactcatgcctgtgccacgtgagactgaggcagatggctcttgccgcccaaagggagggtctgttagccacatgcatactgaatcctgacccattcaaatcagcctgccgaacatcatccagtccgtatagcacatgtatccacgtgcacatgtgcacacacatttaacacaccaggactccgcctgtgtgccctgcacagcacctacacccagcagtgtatcaggatacccacaaccaccacttgagtgcccacgtttctgccatcacaaccagacacacctttccccttctaaggtcactgcattctaggctcagcacaagtcctctgaagccagatccgtctctggtacctcagggtcacgcttcaaccccacatgaattatacaacccagagccataatggtctgagtcacttcacactctggaattttctcaagttcaggcaagaccaggcacaggctccgctggtgattgagggacaggtaaagggtcagaccagctgtatagccactgtccactggggtcacaggccctgctgacccttcaccttctcctgtactgcaaacagagagggcccttgcacaatccaggccgccatgaggtccactgtgtctggcaaaccccaaggccttatccaactcagccggagggaacttagactgatgtcccagagggaaaagaaaggaaagtagggagtagaaagtctcccagggagactctgctggcccagcccaaatggagctttctcctctgccacatggggaattgctcccagccccccactttattgggacaaattctgactgccctctctgtccagggctagaagtggatgatgattgtgctgaggctcaggacggggagctggacgggctctggacgaccatcaccatcttcatcagcctcttcctgctcagtgtgtgctacagtgcctccatcacactcttcaaggtcagccacaccatcccccaccatctgctgtgatgcctgtgtcaaccctgcgatgtcctcacactcctctcctgacgtagtaggatgttcccttgctgtccccactctgccccacacaccattcccaccgttccctgagccgtcccacattgctctgtgtggctacccatggcgtccatactgtctgacattctatctctcttgctgtcctatgtgatctccatactgtcttacgaaacctccttgcatgccacactacccttcatgacgtccctgctatctaccatgctacccctctgggtgtccccatcagcctcaccatgtattctttgagctatcctcataccatctcaacctcaactcccacgatgtctccacaccggctcctagtctatgtcaccctgaccccttgccatccccagtctcctgcctgtatgaaaggaactgcaggagggacgggcctctgtcttgcccacagggctgaagggcctaagcatgggtgtgttctctgacttactcccacctccccacaggtaaagtggatcttctcctcagtggtggagctgaagcagacaatctcccctgactacagaaacatgattggtcaaggagcctaggccacttcctctgggatgagcttcctgggccccgcacaaccccatccatcctactgtgcagcctaatgtggaggccacactgccgtctgacagtgccaccctctagccctgtgactctgatccagaactctagactgtcttccttttggaggatcatgtggacaatgagctataccccagacccaaacagcacctccacagcagttgccaggaaactaactggttgggaccagaagaaccatctctaggatgtttgcctcagaggagctgggagtccacggtgcctgagtcgagctccatgggaatcagccgtgtctgaaatgggtcttcccagaaagagcaatgttttcagatccttgaaaggaaacatctgctaggaagaccatggtcgccacagccccaaagagtcacttcactctggtagcctttgaaccagttatatctggacaccttctttcccggtacttctgtgaaccctgggctgagtaaggggtttatgtttctcaaactgttgggatgagcctccccgagatgaagctccttgtgcagtcttctcttcccgaaacccactcaacatgctggactcttgggttcaggatccgatccgaagacaccattgacgacgcaacctcaagacaaggccactgtcacctccatagagactccatccacactctgcagggacaggaggactgctttgtgtaacctccgcaaagccctagcagggacaagtgcacagaccactgagtattggtgaggtgaccaggcaggaaaacctccaggagagggccctgatgagaagattcatattgggctcaaaaaatgggatggggggaggggggcgggtgggaaagaacagtgggcagggtgtgaacagatgattagaagacagtcacagtgccgcagatctgccctgcaggcctgctttccagactggaccacttacagcagaaaacaacagttacagtaagcatctaggagagtggacctggaataccagggctgctgtggccagtggagagtagccctgcatctacttctccattacctctcatggccaataagaagccagagcatccaggcagaaagaaagagtgtgcgtttctgtgactggtaggaaatgcttagagaacttggatctttaaaacagcttttttctagactgtgaatgtctttaagcactctctttcctctccattccctccctctctctttctctctctctctctctctctctctctctctctctctctctctctctctctgtgtgtgtgtgtgtgtgtgtgtgtgtgtgtgtgtgtgtgtgtgcactcacacacactgttgttttggcattttaaacaataaaacattcttttaacattttgtatctcatggtgtcccttcttaatggattagccctaacaccaaggaacagggcacagttaacagatcaattagccatgcacatccctcctgaccctgtcctcccagggttccctcagtgggtccctcatggctgggttccagccctaccagagccacaaaaagcttgggcatattcctccacacacacagcttttttccccagctggagactgctctgctgccatgggcaggctgtggagcagggctgatgcccagggtagaccctaggctagccagacaaaggtcccatgacagcagagaagcatgtgcctctcactggccttgggctgctacagagtcagcaaaggacatggatccagctacctccacagctggtgctcattgtctcaagccatgtccagagaagttccagatcaggcattgacagggtggagagctctctccttggttggtaggtgtcttctcctccatgtgacctcagagccccccccctttctgtgtgtgtgtgtgtatgtgtgtgtgtgcgcgcgcgcgcgcgcgcgtcctagcctcttctcataagtgcacagtcaggccggaagaggtgcatcctagccctaatcataacttaccagtttatgatcctgtctgcaaacataggcatagtctgaggtcctggtgatttaaatgtcaattggtgagtcttctggggcttcctacatacaatgccccttccccatgccaacatcccaaagtctcacccatccagcattcagctctatcccaagtcacctccaaaggcctgctagtcaagtaaggatcagatcgtgtggggttcgtcctgagataggattcagccatggtttccaggaggaaggggcaggagagaggcacaggggagagacgtataccgtgatgaactggacagactgataatgtgctgtccagaagaaagctgagggcaaacaggggcccctcccacttacactgaggtgacagttcctaagggagagtgagggatttgtagagagaagtggaggttccacagagttggagaagcaaaagattactagaggtagcctggtgtttgcaatgtctgttttctgttatggttgacatcaggattccatgctactctgtagatcaagggatacaggttccacatctttgtgtggcactgtggtggaggggcttgggcccagatactcccgggacatggaaaatacagacatcggcaggggaagaaatgggatgattcacaaccaaaggcctcctcatccgatgcttactgatctccgagagcaggagtcgggtgctggctgggcagttatcatctcccagtatttcccaggtggcatttagtagctgagacatcttcagattgtggccttggctgttagacactctatctgtttgggtctgtgtaggtgatggtggaggctgaatgaaggactggacaagggacaaaaggatcaggtcaacaaagctgcagcagagacaggagccaacctgaccaacaccactgtggcttccatgggacagttctgttttagccaggacagaagggaacagagctgcgtgaatggcattactcctatgggagtcacacagacaggctaatcacccagacaacaccaactggccagtgagaccagtgagatcctgcccacgcttcctcttaggtctggctctgtttctctagttgtcttccctggagcaaatgttgggaattgagcccatatcctctgcaagaccagtaaatgttaactactgaggcatttctccagccctgcctcaacctcttactggaagatggtcccaaaccaaaactgacggcatggtctcagaaagtacagattcgccacctccaaacccttctctcatgtctgtctgtctgtctgtctgtctgtatgtatgtatgtatgtatggccctgcaccatcacccaccacctcctggtgtcctgcagcaggggcttcccacagcaggacgtaccatagctcccaccccttacacctccatcagcactataaacatatagacacaagtgccataaccctggacacaccttctgaccccgcccccatctctgagaccaactgatctcaggctgtgttttactgaatgtgtccattcggtaaaagctatctgagtcctgccctcctgacctctatagtgtgacatccatggtgtgtgtcctgtgtcataacacgtaggtatgtcataccgtgtgttaccacatatgatatgtgtgtgaaacatccccacatgatgcctgtggtggacatgtatatatatatcttttatgacttctataggggacatcaattgcagaatacctgtgctagccagtagccatgactgaccagacagctactgacacttgacccacttgcattctgtcacagtctgggaatcataacatgacacaaacgccgattgtagcaccaggtcatgggcctgcatgagacttgacatgtgtacacacatgacatgtgtacacacaaaccacacgaaaaagtgtctcggaaaacacacacagacacatccacatgagcatcatagtgtggtcacagacatgtccacatgggcatcacagtgtggtatcatgtagtagccacagcatacatgacacagtcacacaagttcttacaagaacatacatgtctgccagttcccagaactcctggcctcaggctcagcactggccaccctggcccagcacacttcccatgcttcaagctttgcacacacagatccactgtattcccttcctgtgtttaccccattaccttcagcacaccacccacctctcttccatgactgcccccatcccacctagcacggcgccccactactgtgctagctttgttcactcagtgaccatgtgtgtccatcttccagtgaagcttgagctctggggacaagaacgtccctccagattcatgttcctgcagttctatccaactgttcagcatctgtgatgaagtcacaccaagtccctcaccccctaactagtcttctaatctggcatagttatgtgctgggaactaagtagatggtcaaagtaggatatgatgctggccaatggtgcagaccagtaggtccatgtgctgacccttcaactctaaagtcttccccacgcctaccatgtagccataagatctttcccccaaggcagggtacagacaccacatagaggaagaagaccaagtggatgggccccccatagcaggtatgggagagtcaggctgacatagcaagtgtgggagagtcaggctgccatagcaagtgtgggagagtcaggctgccatagcaagtgtgggagagtcaggctgacatagcaagtgtgggagagtcaggctgacatagcaagtgtgggagagtcaggctgccatagcaagtgtgggagagtcaggctgacatagcaagtgtgggagagtcaggctgacatagcaagtgtgggagagtcaggctgacatagcaagtgtgggagagtcaggctgccgggcacaaaggatatgctggacttagggaagccatcctccctgttttctgcccaagcacatatgtatcctactatcagctctctcattgttcactccatactcaagcatctgcccataggaggaagacctcagcctcaagtcaggatgtacatgagagcagccacagagtgagtccatatagttctgttcttttgccccaaaatgtcatgttccagaactacttgttcctttgacctagaccccagaaaagagaccagacactatagtagacacggaagtaagaacaacacagtgctgttgtttctctgctggcaaaggttgttgccacacttatccctggcaaagatataaaacagatgtcatcaaaatgccagtcctggttgtaaatacatatttagaaatgtctgtgtgtgtgtgtgtgtgtgtgtgtgtgtgtgtgtgtgtgtgtgtgtgtgtgtggagacaacaggtaaaaaaataaagacgatgttagagggaggaaattaaagttggaaatgatataatcatatttttattggataatttatatttacatttcaaatgttattccttttccaggtttctcgtccataagccccctgtcccatctccctcccccttcttctataagggtgttccccctctccaaccacaccccattcccgcctccctgccctgacatttccctgcattggggtgggggggatggggttccagccttggcaggaccaaggacttctcctcccattggtacccaacaaggccatcctctgctacacatgcagctggagccatgggtctgttcatatgtacactttgggtagtggtttagtccctgggagctctggttggttagtattgtttgttcttatggggttgcaaaacccttcagctccttcaatcctttctctaactcttccaacagggaccccatgctcagttcaatggtttgctgctaacatccgcctctgtatttgacacactctggctaagcctctcaggagacggctatatcaggctcctgtcaacatgcacttattagcttaatcaataatgtctagttatggtgggtgtatatatatggactggatccccaggtggggcaggctctgaatgtccattccttcagtctctactcagaaatttgtctcaatatctcctcctgtgcatatttttgttcccccttttaagaaggactgaagcatctgcaccttggtcgtcattcttcttgagcttcatgtggtctgtggattgtatcttgggtacttcaagcttctgggctaatttccacttatcaatgagtgcataccatgtgtgtgtttctgtgattgggttaccacactcaggatgatattttctacttccatccatttgcctacagatttcatgaagttattgtttttgatagctaagcattcattgtatagatgtaccacattttctgtatccattcctctgttgaagggcatctgggttctttccagcttctggctattataaataaggctgcaatgaacatagtggagcacgtgtccttgttatatgtcggggcatcttttgggtatatgcccaagagaagtatatctgggtcctcaggtagttcaatgtccaattttctgaggaacctccagactgatttccagagtgtttgtaccagcttgcaatcccaccaacaatggaggagtgttcctctttctccacatcctcgccagcatctgctgtcacctgagttttttttttttttttttagagagacatggaagaagattgtttgttggtctatatttatggcttgctcagcctgtggttttgttttttattaacttgagtatttcttatatacatttcgagtgttattccctttcccagtttccgggcaaacattcccctcccccctctccttccttatgggtgttcccctccccatcctccccccattgccgccctccccccaacagtctagttcactgggggttcaatcttagcaggacccagggcttccccttccactggtgctcttactaggatattcattgctacctatgaggtcagagtccagggtcagtccatgtatagtctttaggtagtggcttagtccctggaagctctggttgcttgacattgttgtacttttggggtctcgagccccttcaagctcttccagttctttctctgattccttcaacgggggtcctattctcagttcagtggtttgctgctggcattcgcctctgtatttgctctattctggctgtgtctctcaggagcgatctacatccagctcctgtcggcctgcacttctttgcttcatccatcttgtctaattggatggctgtatatgtatgggccatatgtggggcaggctctgaatgggtgttccttctgtgtctgttttaatctttgcctctctcttccctgccaagggtattcttgttccccttttaaagaaggagtgaagcattcacattttgatcatccgtcttgagtttcatttgttctaggcatctagggtaattcaagcatttgggctaatagccacttatcaatgagtgcataccatgtgtgcttttctgtgattgggttacctcactcagtcacctgagtttttgatcttagctattctgactggtgtgaggtggaatctctgggttgttttgatttgcatttccctgatgactaaggatgttgagcatttctttgggtacttctgagccattcgatattcctcagctgagaattctttgattacctttgtaccccattttaataggattatttgactctctggagtctaatttcttcagttctttgtatatattggaaattagccctctatcagatgtatgattgataaaaaatcttttccgatctgttggttgccattttgtcctaatgacagtgtcctttgtcttacagaagctttgcagttttatgaggtcccatttgtcgattcttgatcttacaacataagccattggtgttttgttcaggaaattttccccagttcccatgtgttcgagggttcttcccactttttcttctattagtttgaatatatatgattgcatgtggaggtccttgatccacttggacttaagctttgtacatggtgataaaaatggatcaatttgcattcttctacatgctgacctccagttaaaccagcgccatttgttgaaaatgctaatttttgtccattgaatgattttagatcctttgtcaaagatcaagtgaccatacttgtgtgggttcatttctgggtactcaattctattccattgatcttcctgcctatctctgtacgaatatcacacagtttttatcactattgctctgtagtactgcttgaggtcatggatggtgattcccccagaagttcttttatggttgaggatagttttcgccatcctggattttttgttattccaaatgaatttgcaaattgctctttctaactctatgaaaaattgagttggaattttgatggggattccattgaatctgtagattgctttaggcaaaatggccatttttactatattaatccagcctatccatgagcatgggtgatctttccatcttctgagatcttcctcaatttctttcttcagaaactcgaagttcttatcatacagatctttcacttgcttggttaaagtcacaccaaggtattttatggtatatgtgactattgtgtcataatttctttctcagtcttttatccttggagtagaggaaggttactgattggtttgagttaattttatacccagccactttgctgaagttgtttgtcaggttaagtagtctcttgtggaacttttcgggtcacttaactatatactatcttatcacctgcaaatagaggtattttgacttcttcctttccaatttgtatctatttgacctccttttgttgtctgatttctctgggtaggactttgaatgctatattgaataagtaggaaaagagtaggcagccttgtctagttcaattttagtgggattattcaagtttctctcgatttagtttaatgttggctactggcttgctgtatattacttttacattttatattactttttttatgtttaggtataggctttgaattattgatctgtccatgacttttatcatgaaggggtgttgaattttgacaaatgctttctctgcatctaatgaaatgatcatgtggtttctatctttgagtttgtttatatagtggatcacgttgatggttttctgtatattaaaccatccctgcaaccctgggatgaagcctacttgatcatgatggatgattgttttgatgtattcttagatttggtttgtgagaattttattgagtatttttacgtccatattcgtaagggaagttggtctgaagttctctttctttgtcgagtcttgatgtggattaggtataagcataattgtggcttaatacaaggaattgggtagtgctccttctgtttctattttctggaatagtttgggcatagtttagtatgaggtcttctataaaggtctgatagaattctgaactaaacccatcctctcctgggcttttttttttttttagttggagacttttaataactgctcctatttctttagaagttatggtactgtttagatggtttatctgaccctgatttaactttggtacctggtatccatctagaaaattgtacatttcctccagattttccagttttgttgaacttaagtttttgtaatagaatctgatgatttttttaatttcctcggattctgttatttctcccttttcagttctgactttgttaatttggatacgttatctgtgccctctgattagtctggctgaggatttatctatcttgttgcttttctcaaagaagcagctcctggttctttgtatagtcctttttgttactacctggttgatttcagccctgagtttgaagggctcttcaaactcctctactcctcttgggtgtatttgcttctttttgttctagagcttttaggtgtgctgtcaacctactaatgtatgctctcccctgtttctttttggaggcactcagagctatgagttttcctcttagcactgctttcatttgtgttccataagtttgggtatgttgggccttcattttcactaaattctaaaaagtctttaatttctttctttatttcttccttgaccaagttatcattgagtagagcgttgttcaacttccatgtatatgtgggctttctgttgtttttgttgttattgaagaccagccttagtccatggtgatctgataggatgcatgggattactgcaatcttcttgtatctgttgaggcctgttttgtgacagattatatggtcaattttggagaagctaccatgaggtgctgagaagaaggtatattcttttgttttaggataaaatgttctataaatatctgttaaatccatttggttcataacttgttagtttctctatgtctctgtttggtttctgtttccattatctgtccattgatgagagtgggatgttgaaatctcctactattattgtgtgaggcgcaatgtgtgctttgggttttagtaaggcttcttttatgaatgtaagtacctttgcatttggagcatagatattcaggattgagagttcatcttggtggatttttcctttgatggatgtgaagtgtcctttcttatcttttttgatcacttttggttgaaagtcgattttattcaatattagaatggttactccagcttgcttcttcagaccatttgaggtagtgtctgtctttgtctctgaggtgtgttttctgtatgcagcaaaatgctgggtcctctttacatgtccagtctgttactctatgtctttttattgggaaattgagttcattgatgttaagagatattaaggaatagtgattgttctttcctgtttatatttgttagaggtagaattgtatttgtggggctttcttcttttgggtttgttgcaagaagattactttcttgctttttctagggcataatttcctttattgtgttggagttttccatgtattatcctttttaggactgtgtttgtggaaagatattgtgtaaatttggttttctcacggaatatcttggtttctctatctatgttaattgagagttttgctggatatagtagcctggcctggcatttgtgttctcttagggtctgtatgatatctgcccaggatcttctggcttttcatagtctctggtaagaagtctgctataattatgataggtcttcctttgtatgttacttgaccttttttccttactgcttttaatattctttctttgttttgtgcatttggtgttttgacttttatgtgatggaaggaatttcttttctagttcaatctatttggagttctgtaggcttcttatatgtttatgggcatctctttctttaggttagggaaattttcttctataatttttgttgaagatatttactggccctttaagttgagagtcctcactctcttctatacctattatccttaggcttgatcttctcattgtgtcctagatttcctggatgttttaggttaggaactttctgcattttacattatctttgatggttgttttctatggtatcttctgccctgagattctctcttctatttattgtattctgttggggattctttgcatctatgactcctgatctcttccctaggttttctatctccagggttgtctccctttgtgatttctttattgtttctgtttccgtttttagatcctggatggttttgttcaattccttcacctgtttgattgtgttttcctgtaattctttaaggggtttttgtattttctctttacaggcttctacttgtgtttcctctttaagggcttctacttgtttatctatgttgtcctgtatttctttaaggaagttacttatgtccttcttaaagtcctctatcaccatcatgagatgtgatttttaaatccaaatcttgcttttcctgtgtgtttggatccagtatttgctttggtgtgagaactgggctctaatgatgccaagtgtccttagtttctctttcttaggtgctgcgcttgcctcttgccatcaggttgtctctggtgttagattgtcttgctgtctctgacactggcttgaccctcctgtaagcctgtgtgtcagcactcctgtagacctgttttctttcagctggatctgggaacagagagctgctcctgggtttgtgtgtcctgaggccaccaggcaggtcgcttggagcagaagtgttggtcttacctctgctctcaggtgtgtcagcacttctggcaactggctttcagctctggacacaggcagaaaccagaagatttctgcccctgactgctcctagcttcctatgtccagagggcacagagggcactaggtgggttcctcttggtccatgaatgtcagcagaagtagttgtctcctctgagctctcaggactgtccacacttttgagagtccatctctctcccccacaggatttgggaacagagagctgtgggagcggttcagctccgggtgcaggtagaaaccaaaagtatcctgtactagacttctactgcctttattgatataaccatattttaatcccaaaagcaaaaataaatgctttatttctggtcttgagctaagggtatagttcaattgttagagtacttgtctgtaatgcaggagccctggatctgatctccattacagaataaaccaaatgtggtaatgcatgcctgcaatcccaaatcccaaatctccaaaggcgtacacaggaggatgagactttcgaagtcattcttgtctacatagcaaattagagaccaaccttatctttaaaaatagtaataatcctgatcttccacttgaagtaaatgtatccagtaactgtacctgataccattctatgttagattttgtttcagggtttcgaagataagttctccagagaagcacaagtagtgggagatggcggagagagggctggtagatgaacccataaacaacaaacaacagagctggaggacaattaggatgatatgtagttagaaacagagggacagcatataagagacaacagggagataacacataagagacaacacagggataacacacaaaagacagaagagagataatacataagagacaacagagggacagcgcataagagacaacagggagataacacgtaagagacaacagagggataacacataaagacttagagttttatggttcgccttgactagattaaggaatgaatgcctgtggaggtgtctatgaaggactttccagaagtgttaggtcttagggggctctgacttagccctttggtggagtgagaatgtggtggcattatagaaaaatgctgaacagtaagaagtccaggtggaggaagcagattactgggggtgtgcatgggccattacatctgaccctggacactacattccctttatctctacttcccatcagtcaagaaataaatagcctcttccacacaaccccactgtcattatggccctaagcacataagccccccaccctttaagtttctttgaggtatctggtcatcctggctcccagctccaagtcacccaaagggttcatataggcaagcatttccacctctaccgtgttccatcacaaaccactggctatttgagaaatttcagacagctaaagaatggttctcttagcactgatggccttgcattcaagagacttgcctgctggtttgcaaacctagaggctatggcactgaacttggacacccggtggcgtgctgcttttggcatagagaaagctgacatccagcagctaagtgactgctcctgagctttggaactcgttctcctgtatcaccctctacatccaactcttctcagcttgtcttctcaatatttccactgtccctcatcaccttagattcttgtagacgctgccctcaatggcttactggctcctcaactacttcctgccactgtcgccctcagggctggaaacctggagccttgtctgctcttggcacagccacacagcttactctacccatgacaaataaggagacttggagaccatttggggaaagcctttatcagggcctaatgggtgcacacttggatcaggagtcatccattggagagaagcctcaaggaatagtggggaacatactgtatctagagacagtatagggtcatgatggcgtggattatactccccacaaagacagccctgcatgtgctctgcttccagtctcaccaatcacaaccctcccgtatgaacccatcacagcccttgcacagattgcaggtctcaaatatgttcacctttctttctgacataaccaggattttttttaatttgcttgcgtgtttattatttctatttattttattcattttttatttattattttacatcccactcactacccctctccccatcatcccctcccaagatccttcccccatcccctctccctttcacctctgagccagtggtgccccctccgtgtatctcccaaccctaataatcaggtggtttgagccaccagggaagatgctcttcttcctttctgaccttgagagctgctattccaaggtcctctggagctgtgtgtgtgaagtcacctggaggtcataggtggagtggagttttaaggccatggtagaggctggagccatagtagttggaacaaggctgtggtttcagcagcagccatgattgttgtatactttgcagctcaaatatggtctcctcagggctctgtgaggtattcaaagcacctagaatcccatgatgacacttccaccagtctctaaaagagacctaagactactagatatagaaaaaggccaacttaagtacatcaaaaggtcaagccttctggcccctaatggctcattttacatgaagaaaaggtgaccattacactatgcccaataaagacatgttacatttacactacggtccttggcatcccttagcagatgatcctagggagagctgagcaatctcgtccatctcacctccacccagtcaccaaaataacactgttctaaggcacacttctgagacttacagagctactagagagttgggggtagcagtaagacctttccctggccctcaagatacgttcacacccacatcacatatatgagttcgcatacactaacacacacagcacatcttggacatggcccattcaggaacagatctgtcatgatcgcttgagttaaggaaccactcaagggaatgactaaaggaggatcccactggagtcctggcccacaggaggaggtggaataaaggttaggtagggcaagacaagggcactaaagccactatgctgctggggccactgtggacactgatggccagaaatggaatgatcagcctgtaggcaggaggggggagggaggatgattcctgaaaaccagaagagtcaccgtggagtctgaaccaggaaggagagagagctcccagtgtaaccctaaggcttaagtagttgcaactgcctcctctccttccagaggaccacccactgccacctagcatagcactctgaggactcagaaccagcagcccagcataagctgagtgtcaaagaagaatcaggcccaagcaggctggacacaaagtttcttggtcctcaggctatgagggagatggagtccttcccactattcggggcacaccacagacagcagcacctgatccagttggagcaaaggctcctcacccctgtgttttccctcagaaccacaagtctttccaggaaactctgtatttacccctcagattcccacccaggtctgttaggctaaaggccaagcctgtcacctcagactatctgaaagagataaaaccaggcaagacccccaattccctcagatctcacaccccgtgttcccaaagtccctaactaactttcctggggccagcccggggcctacctggttcttccactgtcagttagctctctgatgtcttccaaatacaattaaacacccttctgtgggaagtcagacttggcaaagcctaagtcccccagtcccttgcatcccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggaagctgctgggcccacacaccatctttaccctctccccttccctcagtgcagacgtagaccacaggcctggaagagacgttagctgtttctatggtgttccatgagacccagttactccccagatgtgctctgtccttgccagagtagcaagtagaggaccccaagccgaagggcggccacttgtgagtgattaccagggaagcccactgtctctagcatgccagctccaaagctgagacaggaaccagggggcctctatcagaggccctgcgtgtcatatcgtgcccacaggctgttcctctttgtgtatcgttaataacttacaacgtgactgccacactgccccgaaggactgccaagggaacagaaaaggcaatggcttgagtccagtcccttttcagggcagtagcactccaaaggggcaggcatcgtgactgcaggaacatgcaagtttctaacgtgagagctgtgcagaacaccagacaacgaaaagtgccctgaccagagcgtgcaggtgtgtctcctagaaagaggcctcacctgagacgccactgtcccttagtcaacttcccaagaacagaataaaaaagggaacttccaaggctgctaaggccgggggttcccaccccacttttagctgagggcactgaggcagagcggcccctaggtactaccatctgggcacgaatgcaataatggttactaaagattcacaacgtctgggagcctgcacagggacaggagatggctgcagatgagaagagcctggctagccacagccacttaccagcggacctcaggtatcatagcctgtgggaccctgagccaaagggtttgcccaaggagaatgggcaaacaggttacagggtcctggatggggaagggggcacctgggctgccttctaacaaggacagagtctcttggtcattgcctgtccttcagctgtcactcctctgcattaaggcacacagttattagacactactaccgctatccacaaagacaggggactgtggatctcaaccagacatggctgaaccaagagaaactgaagatgtcgtgagaagctcagaaaacgccaggagaagctgaataggaatctgcctgcaaaccatcagggcaaggaggcaataacaagtgacagagccaacgagtgacagcaaggaattgccctgtgatgaactaacaacaaagctgggctgacctgggctaagctaggagtgggatctgtgctgcactgggctggaaggagccgggatgagccaagcaaagtgggttggactgagttgaattggcctggactagtttgtgttgggctgggctggcctggaataggtaggctaaaccagcttaaactagggtaggctgggcttaactgaatcagactaggctagactaagcagaactgggctgggttgaactgggctacactagcctggtctgatctaggataggctgggctaagctgagctggactggctggactgggctgagctaagttgcactggacagagctgggctggagtggactggactgggttggattgggctggactgggctgggctaggctgagctaaattgcactggacagagctgggctagagtggactggacagagctgggctagagtggactggactgggctgggctgggctgggctgggctgggctgggctgggctgggctgggctgagctgggctgggctgggctgggctggactgggctgggctggactgggctggactgggctggactgggctgggctgggctgggctgggctgggctgggctgggctgggctgggctgggctgggctgggctgggctcagcaggcctaagtaggcctagctgggtttagctaggtttggctaggtaaggctgagctagattggactggactgaaccaggtggggtatattcagctgacattgtttggtctggtctggactgaactggactgagccgggctagcctaagctagatggggggtatactcagctgagatgggctggtctggctagattgaactggactggactaggctgagccaggctgacctgagatgtcctgatctgggctgaactgggcagggctggtctcagctggactacactgagttaacctgggctgaaccagactgggctaaactaggttgtactggctggattagacttggctaaactgggcttggctaaactgagtcaggatggtctaggttgatttttagttgggctaaactaagctgaactacactgaactaggcaagactgggctggaaaggtctgagttaaattaggagggacttggctgggctgggctgggctgggccaggctgggctgagctgggccaggctgggctgagctgggctgagctgggctgagctggattgagccgggctgaactggactgagctgggatgagctggactgagctggactgggttgagctgaacaaaactaaactggaatgggctaaattggcctaaaattggctaggctaagctaagtaaggctgccctgagctgagaaggactggattggcctggactgagtttggatgagcatcattggactatgctaagctaacttgggtgaagtgggctaagcaggactaatctggcctgatctgagctagaccaagctaggccaagctcagctaagtttagcttagctgaattaggctgggctggactgtattgagctacactaaatttaacaggctgagctgagctgagctgagctgagctgagctgagctgagctgagctaagctgagctggttttgtctaaggtggattgacctgggctggactgaactcaattggactacactgaacttatctggacctcactgagctgtgctgcactgggccaaccctggatcactctagatctagcttagctggactgggctgagctagattgggtggactgatctaggctgaactagactattcttgcctgaggaaggctgggctatgctgagttgaactaaactgaactcagctaaggaaggctaagctagactgagctgagctacgttgggttgggctaaactgggctgagctatctcgggtagactaggctgagctagactaaattgggctgagctggagttggttggactggactgggttgggctaagctgagctgatttggtgtaatctgggatcaggtggcttgagctggactggactgtctgagctaaactgggttgagtggagctgagtgggtctgagtgaggctaggctggaatgagctaggctaaactgggctgaactggtttaggttgaatttagctgagatgagctgggctagacttctataagatggctgaactctgctagggtgaactgagctgtgctgagctgaacttggattaactataattagttgagctgggctgaactaggctgagtttagctggaataagagtcaactgggcccaactgagctaggctaagctaggctgaactgggatgagctagaattactgttctagtctgatctggactaaggtagactgggctggggttgagctctgttgggctaagcaaagttgagctatgagatgaactaggctgaattgggtacttctagatcattccaggctgttctgggttgacctgaactgggtgggattgagctaagtggggtaggctatgctgagctctgccaggctgcatgagtttattgatctgaactgggacaggctggaatggactggcctgagctacaccaactgggctaagctgggataggtcaggctaggaggagtcaagctggactaggccaaactattataggtcttttggtctagttgaactttctggtgcttaactgaactgtgtttaagatcgattgctcaaaccagagggaggagaagcccttggccctgccaaggctggaccccacacacacaccagtgtaggggaatgtcaggacagagaggtggaaaggggtgggtggttgggtgggggaaaagtgataacatttgaaatgtaagtttaaaaaaaatccaaaaaataaattaatttaaaaaaaaatagattgctcgaaattttttatggatgtttttaactgttctccaagaagattgtcctgatatagtagccagactatatcagggtaggtagagacaatcaggtttatcagaaatatcctatgctttctgggggcctggcacagagctgaactgggccccaggctcaggagaatgtcacgggcatgcgggcactccagaataatttaggcagccatcaaggtggcttctgaagtggttgtattctctaactgtgtgctgtctaggatctgcagaggtcactaggaggcagaacactttgcaggttagcctgtggtaaagccaagagccccatgaatctgaaaggctgagaccaatagccctaggaaacaagggtctcacagttctgtcattaatgtgtcccaaaacagatttaatgtgtctcgccaaggaactggtgctcctgggaaagctctgaatccccaggtcccaaaagtggggacggaagatacaaaagtaattcactggatctctgggttcccaagccctttggggtacctgtgtcttggatttaaagtatagcctggtccctctggcaatatcatacagcctaccttaaagctactccattcaccctgagaacctaatggcttccagtctgccacccagttctcctgcttcatttatgggcatatcagagataataccactgtcaccctgcttaaaggacagacaggaaataactaacacacacatccccaaaagttctcagtcaagaaagagagcaaagttgcctcttcctccaaagctcatacccagccctcctggaagcccctgtgctaagccagctaggggcagtgagcaaagcttggcagagcatcaataatcaggggcctccctgggtttgtgcttgggtttagagaatgaagacaagacccagaaggagactgtctcctagactggaagagaatccccagaaccctgctcctgtcacagctgccctaatcagtcccctatgctgcaggcatgcagtgatctaaacaaatctaacctaggtccttcctgtcccacagtttctgtcaaggccccttcactctatcccttgaagccctgtagcagcgaaaacacggcttcggtgacattgggctgcctggtaaaggactacttccctgatccggtgactgtgacctggtattcagactccctgaacacgagcaccatgaacttcccgtctatcggttctgatcttaagaccaccaccagccaaatgaccagctggggcaagtcagccaagaacttcacttgccacgtgacacatgccccatccacattcgtcagtgacttgactatccggggtaagcagggttgagctggttacagttaccacaagagggaacatggtcagagcagaaaggaccgctcatatatacctataacagggggccaggggacccaacatactcaggggcctggtttgaggcttgaggggacataaggttagggagatactcacagctcactgcctctgccctagctcgacctgtcaacatcaccaagcccactgtagatctactccattcatcctgcgaccccaacgcattccactccaccatccagctgtactgctttgtttacggccacatccaaaatgatgtctctatccactggctaatggacgatcggaagatatatgaaacacatgcacaaaatgtcctaatcaaggaggaaggcaaactagcctctacctacagtagactcaacatcacccagcagcaatggatgtctgaaagcaccttcacctgcaaggtcacctcccaaggcgagaactattgggcccacactcggagatgctcaggtaggcccacactcgcctgatgctgagacctcagagttctgaagggaaggcaggctcttacgcagcccttcctctcttacagatgatgagccccggggtgtgattacctacctgatcccacccagtcccctcgacctgtatgaaaatgggactcccaaacttacctgtctggttttggacctggaaagtgaggagaatatcaccgtgacgtgggtccgagagcgtaagaagtctataggttcggcatcccagaggagtaccaagcaccataatgccacaaccagtatcacctccatcttgccagtggatgccaaggactggatcgaaggtgaaggctaccagtgcagagtggaccaccctcactttcccaagcccattgtgcgttccatcaccaaggccccaggtgagcacaggagatggagagtgggccggcccttctctgtgttcagatggcacggttaactggttaactcgtgtctgcccacaggcaagcgctcagccccagaggtatatgtgttcctgccaccggaggaggaggagaaggacaaacgaacactcacctgcttgatccagaatttcttccccgaggatatctctgtgcagtggctgcaggatagcaagctgatccccaaaagccaacatagtaccacgacacctctgaaatacaatggctccaaccaacgcttcttcatctttagccgcctggaggtcaccaaggcactctggacacagacaaaacagttcacctgccgagtgatccatgaggcacttcgggaacccaggaagctggagagaacaatatccaagagccttggtaacacttccctccgtccctcccaggcctccatgtagctgtgatggggaaggtgaatggcagacatctgcccactgttgtaacactgggaagccaccccaataaacactcagtgcctgattagagccctgggtgcccttcttcggggaaggtgggttgtgggcagaagtatcttggcctgaaagaagggaaaccccaagagagggacaggagtgaagcatggctcacccatctgtctatgtgttgggtatttgacaaataggacatcacagggcttcagcatagataaccctggtccttcctgcccttcactgtatcatgcacctgaaagggatccaaagagccagagaggtggtctctagagatgtaggtaaaatgaaccaacctgagaggcctcggcacccacccctcagtcttgcaagctcctgctcccaggtattcctggatgctggaactccttaaggtagagaaacagccaaagtcaacatctggaaaggcagaagtcagcatggccctgctccttccctctgtactcagcagccattgaggctgagcctacggccctgacctcctgtgtgccatgtgatcataccagacccggatcagaacctggtgctcctcatctttcaacccaaagtcatcccaaggcccagaatgggaagccagcttcacacagttgggttctcccatctatgccatgttctcacacacacacacacacacacacacacacacagagccacaaacactcaggccaccaagtcttaaagagactccaccaacagcacacacttgcagccacctgacacaacaacacacctcacccatgttcacatgtggcctgcgctaggcttcagtctgtttccagtcctttaccttttacacttgagtccaaaataaaaacagaagacttacgccctgagggagagaccagtgtcttcttcctgtggcctcagctcccagaacactcttccctaccttctacaacactaagacagtaagatacacccacacgaacataaatacatacacacacacacacacacacacacacacacacacacacacaccccaagtaggcttcatcatgctctttggtttagcaatagcccaaagcaagctatgcatccatctcaggcccagagggatgaggagaccagaatcaagacatacccacgcccatcccacgcccaaccaccaaccaccagcacatacggttcacacacctgagaccagtggctcccatcacacacacacacacacacacacacacacacacacacacacacacacacaagcccgtacacatccaccatatccagagacaagtgtctgagtctgagatacctctgaggatcaccaatggcagagtcggccagcacctcagcctccaggccaatccttatactttggcccactgcaggccatgagagatggaggaggtggaggcctgagctgtggaaaaccagagacaggaagatggtctgtatggagagagtagtaaaccagattatagggagactgaggcaggagtagagctcctacaaggccagtagtctaccttagagtcctataagtctgggctgggagtccatgtgtcctgacttgctcctcagatatcacaaccaagattcctggagccagagtgtgcatgcaggccttagaaatggagcttagagcccttcctggagggccctgggcactctgaacaaaaggcaattctgtaggctgtatagaggcatcctgtcagatacacacacacatgcacacacatacacacacagagacacagacacacacacatgcccacacacatgcatacacacatgcacacacatacacacacagagacacagacacacacacatgcccacacacatgcatacacacatgcatgcacacacacacacatacacacacacacacacacacacacacacacacacacacacacacaccccgcaggtagccttcatcatgctgtctagcgatagcccttttgagggtgggagatactgggtcatggtgggcactggagtagaaagagggaatgagcagtcagggtcaggggaaaaggacatctgcctccagggctgaacagagacttggagcagtcccagagcaagtgggatggggagctctgccactccagtttcaccaggactgcctgagaccagtgagggatccaccctgccacactgtcacttggagtctggggacgctaactggctggtccccccatcccagagctagacatccaggacctatgtaccgaagaggtggagggcgaggagctggaagagctgtggaccagcacttatatcttcatcagcctgttcctgctcagtgtgagctatggggccactgtcactgttctcaaggtgggatcctgcacctcggtgggtgggtcagggaggtctaggccaagctgcagcgccatcctcacatacacctttcccccaggtgaagtgggtcttctccacactgatgcacgatacaccccagaccttccaagactatgccaacatcctccagaccagggcatagatgcgatgccagcacccgtgcaggcctgcagccatgtgtgtctgagcctcctgaggtgcctgtttgccttggatggtaggtgggagcagagacccctaaaggcaccagagttggtgagatgtcaacatgtagaaggtgcggcttggggcagcaatgtgggctgtcccgcatggatactttgagacaggactttgaagagcctcaatttgacctatcaaatgctggtcacccaggtctttcagcatcagggtcactccatattgactgaataaccacaaaagcacaagaacccagagcctagagtccccactaggccccacctagagcacagagtcaaagctgggacactcagaatcaacccaaagtccagacccttgctcctcagaaggaatcctgccccactgcttccagacagacctctggcctaggcagatcgtcctactgccagataaggagcctcccacagggcagcagcagactcaagctctgaggccccatcaaccccagccccagcctggcagtcctactttgtctctggtctctttagtaaagttcttttccataactcctgagagtgctttgagaaggtatttaaggctaccattatggtgatgacaggtcccaagaacatggacaaggaccagatggtaagagcctggggattaaacatccacctctatgccatcctcctcaaaccacagagttctgccccagtctccatccggtccatcattcctgctgaccagactcacctcccaggggaattgaggtggaatcagggctgggcccccgggaacctggctgcaggtcactcttcaagaccacaatctgcccacccagtaagtgcagactgacaggccagtcccctgacccaagctgggacactagagggactaggtaacagcacgcaagtgtacaagaaccatccaaaatgggttgtgccatcctcaagacatgatctcacatgacaaaagacaggcttctctcatatataatgattgctcagggactaagaagaaagacctcttcatgggacggaaaaaccagcagtcactgtttttttcctgaagaaaatgcttcaatggtgagaacacttctagaaagaaggatgttagggtgagtgtggccctgctgggccctgggtaaagaaaggcatgagaactacttagaccattttgagggtcagttggccaaacactcttgtcatcacaagtgacagtctcacaaagaggtccacactggggtgtcaagctcagcaccaggggactttgggggaactaagatagggataaaccagccgggatcaggccatagtccacaggcatctgagccctctgctgctgagtccggcttctacgggccttggagtagggcccagatggcaaagacacagaaagctacccctcctgggtgcagaagacccaggactgggagaatgactgttctgatgagaaaagaggctctgtttaggatgtgtcccaagccattagtgtggccagcttactaatgtgcattcatgctgcaaaccattgctcacaatcaaatgtataccacgcacacagtcacgtagtttgcgcagacccactcatgtggcacatgcctgtgggcacatgggaccacacatacacgtgatgctttaaaacacagatctgcacggtcttgtacttagacacacattgtctcaggaagcccaggtgtggaccaccctgtcctcctgccacattctcctaagccatatcccctgccaagctgaggcctaggtgcctcttcctcaaccagctcctagaccaacatccctgaggcatagctcagtgtcttcttctaatcactatccctccaagccacgagaccccatagacactggacacgggcagcaagggttcagctcaaagaacacggtgtggcaggaactcctaccaaatcccaactagaaggaaggaaagtcccacagagagctagactcactctagacaacccagacagtgaccctggcttctacataccatgaatgaatgaccttctgagactaagaggtcgctttcttctctattcctacattatcagtccaccatggagggctacatggaaaaccccaaaagacataatcacattttggaacccataaatgtagcctcttgggaatagttcttcatcaatgtgaccaaggtaactatctcaagacgaggtcatcaaggactagctagtggactttaacctggtgacaagagtcataagagacagaagcaggacctagggggtaaacagggcctgcattctccaaaatcaaagtgtcaaaacagaaatatggcagcaaaacagaagtaccgtgcccaacactggtcaagaccaatgggggaggctcatgaggggttgcctaacaagagcaggcacaagtgcttagataaaaccacaacctacactcggccaccgtaaccctacatagaaaatgtacctatgggacgtcagctcaacgtcagtcccacctcgttgctgtgcgcagacagctgcagcctgaataacctgtccaagtgtgcatgtcacatccttgatgacacactgtaaccagtgatgccatgttagcacgatgtcctgtgagggtgtcttctgactcgggatggcaaaccctaagaccaaaaggaggtgcttggttcacgagagcggcctcgtggctggacacatggcgttaaatgagcctctgtggactaggaagcagctttaaccagaaagactataccagcaccctgcttcacgtttccacctttgagcctctactgactaagccactggcagccactcagcctgtggtattctctaacggcaacagaaatgactaagacaggcaaccacaatgtcccccactgctgatggctccagggcattcttggcctgatgacaggacctccagagcctccttgagacaggcagatctctggagggcaggaccaagctttctcctctctacctccccaacatctttgactagcttcacagataaaaggctagggggacatcagtttattccacactttctaagtctgatgcaggagcccttcctctgcgaagtatctatccaagaacccagaaaaggctaacttccccaactcaacacttagcaccactgacacacctgaccatacccactgatttacaacctttctcccagacagggccattcctgggcaaagactgtggtgtgagggcccagagtcctattgttgtataaatgaggcacagtggcagaggcaagctacaaagagtgacattgtggagagaggacactggggacagtcggatgtgtagaggatcatatgaagggtggagccctaccctgacaatctacaaagagtgacattgtggagagaggacactggggacagtcggatgtgtagaggatcatatgaagggtggagccctaccctgacaatcttcaagaggctccataggtcaaaggcccatcctgagaaagctgtgataggaaattgactcagggcagatgggatccaaatgagggtagcacctaactgtgacctacagacctccatgttggtcctcaagttggggcacccactttctcatggacgtagccatggaggtagccacagctcgtgacaagccattccagacacttgcctcaccccgttgtcaaccctgtgacctcaaagctcttctctgaggcccccctcagcttagggacccctctggagtagccctgttactttggctccttgacaacaagctctcaggtctcccttctacccctaattgtcctctccctctccatctctgccttggagtctctgagaaactagatgttcatttcattccctcctgcatctcctgcccaacctacccctgtggccatgcatgtggagtcctggccccatccaggcccgtgtggtcagacacacctgtctccaccacagccagaccacaggccagacatgacgtggaggtaagcggccacaatgtggaggtggaacaggaagtgggtgagggaccccatccaggggccagacacacagtcgtgcagccccctcaccgctcagtctgacccatccacaggcaaccacacacagagaaaaccagtttccagccaaggcttcacccagtcctaagctctctccggtagggcagacggcctttagccatgagaatggaccttcagggtgggaccacctggccatgggaggcctggctgttcccctatgaatgacactcaacaaccttgagcaggtgggtcccggtaccatctggactgctctgctccttggtgcactggggaatctcaaccaggccagacctgagaacataaggcagagaagcattagcaaggagaaggtgattcggagagcaagaaccagaggaatacaggacatgaacacaggcacgaggcggggtcatggtctgagctgcagagaagagagaaaaatggatgaaactcagcttcctggaaagcagcaacaagagactcccaggctagactgaggcaaggataaggaggcatcaacaaagaatgggggtgactcgggctgccatggctcagctgagctggatttagccaggctgagctgaactaagcttagctgaggtgaatgagactgagctgagctgagctgggacaaggtaggccaagttgggctgactgagctagtctagactggtctgggctagtctgatctggactggtctgagctgaactgagctaagttgagctgggataaactgggctgaggtgggataagatggcctgacttgggtaactaagccagtctagaattggataaactgaactagactggtccaaactggactagactgagctggactgagttagaatgaggtggactgggctaaactgggctgagctaggttaagctagggtggactagaatgctgatttaagatggcctggggtgggaacgctagctaagccagaccaagctgggctaggctgggttaagttgagttgagctacagtaaactagcctgggctgtgctgaccttactacaccaggctgggtttggttggcatgaatggagctgatttgagctgggctagaccaggttagtatgagctatgctgtcctggtctaagtagactgggtgaggctgagaaaattcgagatggaaactggactgagatggaaaaagataggcttagtgttggcttactgaaccagtctagaatgagctgaactggacttggaatggcctgaactgggcttagcttatctagcctgggcttggctaggctggcctaacctaggctgagttgatctgaactggtgtaggctgggataggcttgctgaaatggactaggtcaagctgggctggagtggggttagctaaaataggtggactaggctgagatgagttaggatgacctgagctatatttaggggatggatgggatgggatgggctatcccaagctaagctgggctagaatgggctagtgtaagctaaactggctgggttggaatgtgctgggctgtgctaagctagaataaactagagtggactggccaaaatcggctgggacggtctgtactgaaccaggctgggctgggctaactgagctagaccggtctgaggtgagctaatctgggatggggcggactgagctgggataggctagattaagctgggatgagctaggctaggctcactgagctaggctggaatagaccggtctaagataggctgcctgagctaaactagactgagatgaactgtaatgagctgggatgagctaagctaatctgggatgatctgggctaggctggaatggactgagccgagctggtctcagctgggctgggttgtgctgaatgggggtaaaccagactaggctacccagactaagctgggctgtgctgggccaagctgggctgagctagggtgggttgggctcgatggctgggctaatccaagctaggctgagctgagctggactgagctgggctggacggagctaggatgggattgactgagctgagctggactgaaatgggctgagctgagctaggctgagattcgctgagctgggctgagctggactgagctggactgagctggactgagctggactgagctgggctgagctgagctaggctgagattcgctgagctgggctgagctgggctgagctgggctgagctgggctgagctggactgaaatgggctgagcagacctggacaatgcaaggctgcactgaactgtccggctaggctatactgggatgagctgagctgggctggtctcagctaggcttggctgtgctgcatggaggtaaaccagactaggctacccaagctaaactgggctggaccaggctgggctggactgagctgtgctgagctggactgagctgggctgggctgggctgagctgagccaggcttggtttggctgagctgagctgagctgagctggactgagctagactgagctgggctgagctgagctaggctggactgagctggactgagctgggctgagctgagctaggctgggtttggctgagctgagctgagctggactgagctgggtgagctaaggtagactggaattggctgagctaagctgagctggactaaactggactaagctggactgagctgggctgagctgagctaggttaggattggctgagctgagctggactgagctgggctgagctggactgagctggactgaaatgggctgagaagccctggacaaagcaaggctgcactgaactgtctggctaggctatactgggatgagctgagctgggctgggctaagttgacttgggctaggataaactaaactgggatgagccggggtgagctgcatgaggtaggctggaatggctgagctagactaggccaggctgagctggaatgagccgagttgagctgagctgagctgagataaacttagtaaggctagaatgaattgagctgagctaggctgggccgacctaaagttgctctgaggtaggttagacatggttgtctgagctgggctgagttaggctagctataccgtctgggctgacctaatatgcccatattagttgtaatgacgtgacctaggttgaaacgggcttgctgatctgggctggactgggccaaactggagttagtctagcctgggctgacttagtgtagcctgggcagagttagactggaatgggctacactgagctgaactaggatgggatgggaagggataggctgaactgactgagctgggttcagttggccttgctgggctgagctgggctggatagtctagctgggctggccagaatgaggcagagctaggctggaattaggctaaacttggtttggctggttaagatgagctaacataaattaggctggctgaactacactggactgtaagctagcctgggtgagttcgcatggctggacgtcttcacagctctagtctgagttttactggtttgttctcctcagtgctgaggtaatagaaagactttggagtaaatgtgaaccaactcttgtttcatgggtccagactgtggcctcagtttgtcttatatgaacggagccacgccactcagtgtccaattctcatgccctcttctccttccctgattacctggtggaaactcacatgtacctgtagatagtgcctacatggacagaaccactgctcagatttagtcctctggccttttggtccactgcttgctgggtggatgggcaggtggctggagtggtgggtctgaagccaggacaaggcaagtataaagtaaaaacacaacaaaatggcccccaccccccagtgtaacctccaagccagctgttccccaaccattcctgccctgtgctggctgaggttggccgtccctgctcaggcccaccagttctggacctcctaacctgggactgagaacacggctctacccactgcccaagcaggagtggggctcagaaatctggggcgctagactgctcaggagcatagccatgtttacaaagacactcacagtgcgtacaagccctgctggaggcatctagccagatccttgaaaaagacaacctgcaggtcacgttcaaaatctatgcagccagtcggtcagctccaactgcgggtacatgatgcaacccctatgtgatactgggcctaggttctccggtataaagaagaaaaaggcatggtcctttctccagagattgtctcaagatgggcagtgtgaggactactatctcactcatgttttatgttccagagtccgcgaaagatcccaccatctacccactgagacccccaccatctccgtcaagcgacccagtgacaatcggctgcctaattcagaattacttcccatccggaactatgaatgtgacctggggcaagagtggaaaggatataagcgtcataaacttcccacctgccccagcctctgggccatacaccatgtgcagccagttgacattgccagctgcagagtgcccaaaaggaacatctgtgaaatactatgttcaatataacacaagccccgtcagagaattgagtgtggaatgccctggtaaagaaggttgggggggtctggggtgggctaagtcctaccttaacctggtatctggacccatatacccctctgaagcacacatcccactcagaaacctcccatgggggatggggggagggggtgtgaacaggcagagggagcagaggcctcagaacatccagaaaaggggacagcaaaggagaaaaggagactattctgatttgctaaaacttctatgttacaggtccaaaaccctccttagtctgccgccctcgcctgtcactgcaacggccagcccttgaggacctgctcctgggttcagaggccagcctcacatgtactctgagaggcctgaaagagcctacgggagccgtcttcacctggcagcccaccactgggaaggatgcagtgcagaaggaagctgtgcaggactcctgtggctgctacactgtgtccagcgtcctgcctggctgtgccgagcgctggaacaatggagagaccttcacatgcacagctacccaccctgaatttgagacccccttaaccggcgaaattgccaaagtcacaggtgggcccagatgcatacctgggacattgtatgatgttccctgcttgcgtacctgctttcttcctctaatacagatgctcagctgctcaggcccttgtgtcacagagggaaactggagctatccaaagaactgcccagaagggaagggcagagaggtctctgctctccttgtctgagccataactcttctttctaccttccagaaaacaccttcccaccccaggtccacctgctaccgccgccgtcggaggagctggccctgaatgagctcgtgtccctgacatgcctggtgcgaggattcaaccctaaagatgtgctggtgcgttggctacaagggaatgaggagctgccctctgaaagctacctagtgtttgagcccctgagggagccaggcgaaggagccatcacctacctggtgacaagcgtgctgcgtgtgtcagctgaaacctggaagcagggtgcccagtactcctgcatggtgggccacgaggccttgcccatgagcttcacccagaagaccatcgaccgtctgtcgggtaaacccaccaacgtcaacgtgtctgtgatcatgtcagagggagatggcatttgctactgagccaccttgcctgcccctactccttaaataaactctgtgctcatccaaagtatccctgcacttccatccagtgcctgtccatcatccttagggtctacaaaacactgggaggggtcagggcccagggaaggaggaacccccaccacctgagcttgtaaggcctcagagactctgaaggacctacatgcctagagtatatgtgtatgcatgtatacgtattagtgagtgcctttgcgtgtgtacctgtgtgtaacaagagaggagtgagtttgtgcgtgcctacgggtttatataggtatgtatatgggcataagtgcatacgcctttaagtgtgagcatatctgtgtccccgtgagcacatgtgtgtctgtgtatgcctatgagtgtgcacgtatctgtgtatgctcatgttggtggaaacatgtgtgcctatagtgtgtgtacctgccaggtggatgtgcaatgaaagggaggtgagaatgggggtgaagtccgagatgagcagattcagccaagacaggcaaacctcaggggagagtcccaagagcagtgggttgctgcagaggtactctgaatggtacttctgaatggtggtgtggctgtctgagtataagattacagcttttgtcccaaacaagaaagggatagatggagcaagagagtagcaagaccaaggctggtactgcctgggagtcacaataggaacggtagaggagtgaggagatgaatccaaggggcactgggaagaagatgccacccaccctcagtgggccagccctgaatggagacgtgcatagccactcagggtgaccactgactcatgagaaagagacataacatggcacagacagccctcagcagcaccctgctctgcatatatgcacatgggcatacaccctggtctgcatacaggtacatgggcatacacgcacatacatttgcacactcacacagacccgaaccctggaggaggacgaagttcacagcccacacgcagcttctggaaagcaatgggagtcccctcccaagcccaaccatgacaactcatggacaagtctataagctcctccaggtggcccctttctaacctaagtctcccttcccatcctgagcccaagtataacaaaccagaaacagggtatgtggcaagctgggaaaagacaggagcaggccatagagaccactctcacacaggccttggcctcctccatgggcacccctagaacacaaagttctacaaccaggtacacttggcacccagatgcccacaagagggcagtggggcccctgctcctgtctcacgggccttcagaacctctccaggggcctggtttctagcaacttccctctgctgtcagagcaaggcccatgcacaccctggataccctccagcttgaaagtccacttccccgaggatagcaaaagcgacaggccagctttggaaacctgacccagaaaagcacgatagccacccatggaacccaaggcctggtccaaaacagaattctagtaaggaggagccaataggtgaaagactgaacacacacagggagagaagacagaggagcacgatagtcgagagaggggggctggtgggtgaggcgatgagtgagtgactggaacaaggttgggtggatatgcagatgaatgatgggaatggtggatggactgatggatggctgcagtgacagaaatatgagtgactgagtatcggcacacagtccctacctccacttaaaatcaaagttctatgcgcggagactctgagggcagtggggttgtctctaccgggagactttagtgttggttaacccccccccaagttctttataatgcaacagaatcctctgaccacatgtccaccccttggtattccaacctcggcccagaaatcaccttggcctgtatctgtttgagagtgtccgatcttaccgaaccctagtacccaggccaagttcaacctaagaactggggcttttgtgaggtgttgctaaatgtctagagaggtctgagacaagtggccttgggctcaaactcttctcagagcctcaaagacagaaacaactctcttaccatgatagttctctaattaagatcccctgagggaaagagagagagtcaggtcttggggggcatctcaagaacttcaaggattccagccccttacctgggaccctgccttctcattatcccagaacaagtcccttctcagagataaggaacccctgccaccaccgtccccaaagcccaagggggcatagaaacagaggccttaagcctgagcccccatccccatgggtttggatctagaaggtcatctatgtcttacagaatgccaagagccaccttcctacgtgatactggaccagtcacaagacatcctggaggaagagaccccgggtgccagtctgtggcccaccgctgtgaccttcctcaccctcttcctactgagcttgttctacagcacagcactcaccgtcacaactgtacgaggcccatttggcagcaaagaggtcccccagtactgaccaggagccagccacaggtggctgtcatggagacggtggggtacagggtgggggcaggggccttgaggatttactcagcccctccacatgtggccttgcaacccttcacagacatcaaggaagtggaaggaagtagaaggaaattatggcagcacttcctgggtttaacccagtcttccagaagccaggctgagacctcagcaaaagcaaagacataacccaactccaggatcctcccctctggctgaccacttgtgtctttgcacggatgaagcttggagaaagtcctctatgtttcagagactgatgtgacagcttcccacccgactcccatactttgctgagcaataaactggtgcaaaagcacagtttcttactctcaaaaacaaaagttaacaaaggattgggtgagggggtcagagatagtgtggtggtgccatgctaaactgttgcttacggtatagaatgtggcagcattgggcagggcagacacagggtgaccactgtctagtatccgagacaaccgtgtgtagctgtagccaagatgaacactgactgacttcaacaagtatttgtggcctcttcagacccaataccaggccattagcttgatctctggacctgacttctaaacatttggcctctgtgaacacccttgccaaacactggtcctggttgtgaaccttggtcctgaatactgagccttatcttggtaactgaaccataatcctgatccctgacctcagtcacgatcatgaaaccctggtcctggccactcgttccaataactggtccctagtcctgagccctgagtcctggtccaggtcactgaatcctggtcatgatcaatgggtttggtcctcattcctgagcctagtcttgatcactgatcactggttctgatcattaacaactaacctgatcactagtccccattcctaatcactgggccgcgatactgatcactgaaccctgtttctaaacaatgtgtagtgaaatgtatggtaaaacctttgcatctggctttgagtgaaatgtttcggcagacctttgctatgttttgggttagtcaggaaaggctgagaaatggttttgaggctgtttgaaccttgaagaaatgttgtctccctggacaatctgcacttggtactacattaaggtttgcagttgcacacaccttggtcctaaacactcctggcagacttagaactcttacgtttgattatggctagccatagttgaaaagggctgagagttgtatgggtggtctgctctctctcgcagcaagggcaagatgactttggtagttgaaaactttcccagccccaactaactctgtataatgtttgaataaagtaacggcagtaggctagttgtggttaatttttattccaagaagaatgaacccctctgctccttcagaaaaggaaggcttagcattttggtgagcttctctctactgaggcacctatgaccaactcagtgttctttgattcctgtcaccacatccagtcttgatcactaagtgccagtcctcatcactaaaccctggtctccaccagtctgcttgggttctgataatcagactcacattctgataactgggccctgattctggtcactagctctttgccctggtcatggacatttgaccctagtccacggcactgagttctgggcatggaccctgggccctagtcctaggtactgggttctggttctaacaactaggtcctgtactgatcaatgggccctgacctagacattgggccctggtcctcaacatcaacttctaagcctgaactctagccccaaattctgcttatcaacactggtcctggaccttggtcctcatcacacatccattctctgagacccaaggaatcagtggtattttgcaagaagtccctttgatattccaagcctcattctcattaggaagatctcttcaggggattcctgcagaaggttccagaatccccaccacactgttcacatactgggctgcaactgggacagtgaccccttttgctcatggaaacaaagcaggcccaggccctgtgagctggagcctctggcctggggtctacagatgtggggtcagcattgtggagaaggtttgcagggcaggtgtgggggtagggcagggatggtcacattagcatcttgtttttctttcttctgaagtctctgttttctatcacctgctgaaacattcaaagtagctccaagctgaggccagctgagtcatcctgagcctatctcagcccaggtgcctcaaaacagagctactgttctgagaatcacaccaccctggaccaggccaggtgggtctggggctggatgaggggtcagagccaggggagccctgacagggactgagaaggccccaacccccatcactcaaggttctccacaaccatccacagtcatgccttagtgaggccatgttctgtcccaatgagaacaagtccaattaagattaagtctggtcttcccagggtcattcagtgtcaaggagtgtcaaccaaggccagccaaggccagcctgaggtcagccagcatcacccaaggacacacaactattctagtagacaactagaatagtcagctcaacagggccctggtgatgcaaaatggagagtgtattcctgccagacagggctccacagataggctccctcactgcatatgacctccctgaatgtttcccacactgcagttggttctagactacttcttgataagcatgcagaaagataacaggataagaaattttatgcagagaacagaagtatctacggaatagaatagaagatagatagtagaagtctgctacaggccccagtggagtctctttgtagagtcaagagatcaaacctaaactgagtctcaggattgagtccagtacagaagcaaccttcaggatgctaaagaccatacaggcaatggacagaatggagtccagacagaccaatgagtggacagtccaatctcacataatgaaccatgtcaagagcagatagtgagccaaagaaggctctgggacactcggagattctcggcctctggatctcctgatgtatataccaggtgatcaagtgacagtctagtggagccattgccatcacagtgtcaggtgtcctccccttcatgggttccggtgaggatgtggcacctccctttagttggacgtgtacaataaattctcaggcctggtatgatttttaatgatccatgtgtttctatagtcttaattatctttaataaaattatagggtgacaccaaatttagggataagttatttatcaggctgtgcctttggaaggtgacgttatttacatagccaccaaggtgcccagtcatcggcccatcttccaaacggagtcaagggccatttgaaacagtgaaatccctcagggcaagggacacaacatggaggaatttaaaacagagtacagcttgatcttaacacacacacacacacaaacgtaagagatggaaaaggggatcaagggacacagaagtacagagaaaacaagacagtaagggatgtagagatgagaggtaaccacagggaaaggtgagacacaaagacgagaggagaaagacacagggacagaaagacccatgcaagcaagagagacagacataaggaagaaaaggcgagaagagacagacaaaggtgcagcaatgtggcccacctggtactcacaagaaggccctggcacacactccgatgagagccatgcacctacaaacacgtagacacagctccacacagacacacacggcatctgcacaactgtctgaacctcaaacaggtctgcccactccctctcctccaggcctttgtccttaggaaggcacgctgagggtaactcagtcgggatacttctgattggggctcactgaacagcctgaggctgggtccacagttgctctcactgtctggccctgtaccccaggtcatgcttcagagggaattaactgaatgcagtaaacaccgtctgtggtcagcatgtactaagggatagaaccctatcaggatttgtccaactaaggtccaaatacagagtgaagaagacgatgggggagatcagatggcagatgggagcactctggatagagctcagggatatggtggctgaggaacattacagctgccaggcttggcctttcatctcagctctaggtcaaggggaactacccaggtctctgctttgttgctggtaactatacctaagtctaagaacctcagtaagacacagaaccagtaagacgacagcctccatcgataagaaagaaaggagaaaggcagaatggataagtctctggacagatgagagcctacacccaaaaacagttcgttcagccagttaatagggtgtagccctagcacacgagagaaaacagttccacaggtgtaagggagtaaatctgtgcgaaggggtactgcttgagctcctcatggcctggtccagaagcagaagctgggcaggggcaaaggacagggtaaggcagggagacaggggcatgaaggagcctttgggactgtgtggtgagaactaggctgtgcttttactgagcctgagtttgtggcagttgcctcatggggaaggcacccagaggtaaggcagaggaaaggagtaactagggctgagggcaccacagggtctgaggaattagaggcagctatgacccatttgtcatggtatttggacatgtacttcatggacacagatctgagaaccaggcctggctctcactaaccagcaggaggtgtcccacttgtggctgtaggtctttcagcacaccatgccatgggcctctcacactggacgatctgtctgaaaggctgatgttgggaggtgggagcccaggcctggggtctgggacactgggtgacagaggtgtccagaatgtagagtgctcagagtgtgggtggggacaagctgtagagtgtccccatgaggggacaggctgagatagggactgaagtccatctacaggcttaccacactccatgctctggatgagagcactgagctctgccaccctacaacagcaggcagagcggcctccatgctaggaaagccaggcagcagggacagagttcctggatggggcaggtggaattgtctctgctcggcatcaaactaagtggaccttcagcagtaaggtcttactgtctagtcatggtggacagccaggaacatagtcaatgaacagcctgctttgtttggattcctctggagacttcctgatcaataacttgtaggcctccatgtttcatgtgacaacttacatctctctatgtataacatgggctttctgtgtagtcctgggtatcctagaacaccctgtgtagaccaggctggcttcaaacttgggacatcctcctgtctctgccttctaataaatgctgggattaaaggctgtgccaccacacacaatctaacccatttcttctgggaataacactgttcacccagccatacactgagttaaaattccttaataaatgttagttcatttacaaaatagtggatttccataaggcttcttcatggatcctaatccaacttttaccttctcttttccccaatcctccaatccccctattcccacttaaatctgaaatccccctccctccattttcaagctgcctgtgttctatgtcccctcatattgtttttttcttgtgtggaggtttgcagatttgaatgcaggaacccttcactggggctaagcctcctgccacccagcacttcccatccccacacctcctcacgcttgatttagcccatgtcccctcatgtgtatgggtgtttctcttcagtctgaggcattactccccgtgtcctctggagagctgcctactgtcacagatacctttcttctgtttctgctagggaaagcttttatttccccttgaattttaatcattgtctgggtgtaataccctgggttgagagctgtgttctttcagaacttggactacgtctatccaggcatctggctttaaagtttctactgtggggctgcagagatggctcagtggttaaccacacatttcttcttgcagaggacttgggcttgattcctagtacctccgtggcagctaagaaccatctgtgactccaactgcacaggattcgatgcccttttctggaggtcatctggagtagtcagctcaacagggccccgggatgcagcatggagagtccatgctgacaggcagggctccacagagagagaaagacagaaacacaggccactgaaagagacagtaatggactgaggggacagagagaaacacacggacagacagacagagataacaaaacaccgacactcatagacacagagaagagaggggacagggaagttttgagagcaatgggtaggaggtgagagagacacagaggcaatacatacagagagtgactccagaagacagagtctgagaggagacactgcaagagacagagaccccaaaagggttgagagcactggatgctttcacagagaatccagattcgattcccagcaggctcatggcagctcatactgcaatcccagttccagagtgccctgaaggatccttcatgcatgtggagcacagaagcgctctctctctctctctctctctctctctctctctctctctctctctctctcagatgaaagccatgaaccagaagacagagacatgagtgaacactcctcagagacatagccacagcactcacacccagttccacacagacacatacagcacctgcctgcctgatccaaaccccaaacccattgacccactccctctcctccaggtctttgttctcagagtagcacactgagggtagctcagcctggatacttcccaaggggcctggacacacagcatgcatctctggtccacagcccccatcccttgttggccctgtaatccatgtgatgtctcaggagaagatgttgtctgagagcagggcctggtacagtgtccctggtacagtgtccctggtacagtgtccctggtacagtctctctagtaaagtctctctggtacagtttccctggtacagtcttcctggtacagtgtccctggtacagtctctctggtaaagtctctctggcacaggatgcctagtatagtctttctggtacaatctgcctggtacagtctgcctagtacagtcttcctggcacagtctatccctggtgcaggcttcaggtcaggcccaagtgtgaagagtgcagaagacagtgggcagagctgagagagcgctagtcagttttgttcagagaacagtgatggccgctccaggctactggacatcccaggtgtgcttcttacacttctcaaagctgtgggaacacaaccgaccctctactcacttcagtgtaattgcctatagcagggcatgcctctgggcatcagggagtcacacagaggcaggtaagactctagacctggggactgagaggggaaggcatgtacaagagggcctcatccttaggacacagggattcgaggcctctggatagccagtgagcaacatatgcagagtgatgaggccccaggagtctaatggacgccaggaggtcacagagctagaggcctggagggctagagtctgtgggaagggggactgcttaggttcttcccacccatgtccaggagcagaggctgggcagggccacaggacagggtaaggcagggagacaggggcatgaaggagcctttgggactgtgtggtgagaactaggctgtgcttttactgagcctgagtttgtggcagctgcctcatggggaaggcacccagaggtaaggcagaggaaaggagtaactagggctgagggcaccacagggtctgaggaattagaggcagctatgacccatttgtcatggtatttggacatgtacttcatggacacagatctgagaactaggcctggctctcactaaccagcaggaggtgtcccacttgtggctgtaggtctttcagcacaccatgccatgggcctctcacactggacgatctgtctgaaaggctgatgttgggaggtgggagcccaggcctggggtctgggacactgggtgacagaggtgtccagaatgtagagtgctcagagtgcgggtgggaacaagctgtagagtgtccccatgaggggacaggctgaggtagggactgaagtccacccaaggctcaccacactccatgctctggatgagagcactgagctctgccaccctacaacagcaggcagagcggcctccatgctaggaaagccaggcagcagggacagagttcctggatgggacaggtggaattgtctctgctctgcatcaaactaagtggaccttcagcagtaaggtcttactgtctagtcatggtggacagccaggaacatagtcaatgaacagcctgctttgtttggattcctctggagacttcctgatcaataacttgtaggcctccatgtttcatgtgacaacttacatctctctatgtataacatgggctttctgtgtagtcctgggtatcctagaacaccctgtgtagaccaggctggcttcaaacttgggacatcctcctgtctctgccttctaataaatgctgggattaaaggctgtgccaccacacacaatctaacccatttcttctggaaacaacactgttcacccagccatacactgagttaaaattccttaataaatgttagttcatttacaaaatagtggatttccataaggcttcttcatggatcctaatccaacttttaccttctcttttccccaatcctccaatccccctattcccacttaaatctgaaatccccctccctccattttcaagctgcctgtgttctatgtcccctcatattgtttttttcttgtgtggaggtttgcagatttgaatgcaggaacccttcactggggctaagcctcctgccacccagcacttcccatccccacacctcctcacgcttgatttagcccatgtcccctcatgtgtatgggtgtttctcttcagtctgaggcattactccccgtgtcctctggagagctgcctactgtcacagatacctttcttctgtttctgctaggggaagcttttatttccccttgaattttaatcattgtctggctgtaataccctgggttgagagctgtggtctttcagaacttggactttgtctatccaggcatctggccttaaagtttctactgtggggctgcagagatggctcagtggttaaccacacatttcttcttgcagaggacttgggcttgattcttagtacctccgtggcagctaagaaccatctgtaactccagctgcacaggattcgatgcccttttctggaggtcatctggagtagtcagctcagcagggccccgggatgcagcatggagagtccatgctgacaggcagggctccacagagagagaaagacagaaacacaggccactgaaagagacagtaatggactgaggggacagagagaaacacacggacagacagacagacagacagacagacagacagacagacagacagagatagataacaaaacaccgacactcatagacacagagaacagaggggacagggaagttttgagagcaatgggtaggaggtgagagagacacagaggcaatacatacagagagtgactccagaagacagagtctgagaggagacactgcaagagacagagaccccaaaagggttgagagcactggatgctttcacagagaatccagattcaattcccagcaggctcatggcagctcatactgcaatcccagttccagggtgccctgaaggatccttcatgcatgtggagcacagaagctctctctctctctctctctctctctctctctctctctacactgtccccatgaagggacacgctgacgtacggactgaagtccacccaaagctcaccacactccatgctctggatgagagcactgagctctgccaccctacaacagcaggcacagcggcctccatgctaggaaagccaggcagcacggacagagttcctggatggggcaggtggaattgtctctgctcggcatcaaactaagtggaccttcagcagtaaggtcttactgtctagtcatggtggacagccaggaacatagtcaatgaacagcctgctttgtttggattcctctggagacttcctgatcaataacttgtaagcctccatgtttcatgtgacaacttacatctctctatgtataacacgggctttctgtgtagtcctgggtatcctagaacaccctgtgtagaccaggctggcttcaaacttgggacatcctcctgtctctgccttctaatccatgctgggattaaagcctgtgccaccacacacaatctaacccatttcttctggaaacnnnnnnnnnnnnnnnnnnnnnnnnnnnnnnnnnnnnnnnnnnnnnnnnnncagtggcacacacacatacacacacacacacacacacacacacacacacacacacacatacactctaatgaaggcagtggcgcacacacacactctcagatgaaagccatgaaccagaagacagagacatgtgtgaacactcctcagagacatagccacagcactcacacccagctccacacagacacatacagcacctgcctgcctgatccaaaccccaaacccattgacccactccctctcctccaggtctttgttctcagagtagcacactgagggtagctcagcctggacacttcccaaggggcctggacacacagcatgcatctctggtccacagcccccatcccttgttggccctgtaatccatgtgatgtctcaggagaagatgttgtctgagagcagggcctggtacagtgtccctggtacagtgtccctggtacagtgtccctgggacagtgtccctggtacagtctccctggtacagtctccctggtacagtctctctagtaaagtctctctggtacagtttccctggtacagtcttcctggtacagtgtccctggtacagtctctctggtaaagtctctctggcacaggatgcctagtatagtctttctggtacaatctgcctggtacagtctgcctagtacagtctccctggtaaagtctgtccctggttcaggcttcaggtcaggcccaagtgtgaagggtgcagaagacagtgggcagagctgagagagcgctagtcagttttgttcagagaacagtgatggccgctccaggctactggacatcccaggtgtgcttcttacacttctcaaagctgtgggaacacaaccgaccctctactcacttcagtgtaattgcgtatagcagggcatgcctctggacatcaggaagtcacacagaggcaggtaagactctagacctggggactgagaggggaaggcatgtacaagagggcctcatccttaggacacagggatttgaggcctctggagagccagtgagcaacatatgcagagtgatgaggccccaggagactgatgggcaccaggaggtcacagagctagaggccgggagggctagagtctgtgggaagggggactgcttaggttcttcccacccatgtccaggagcagaggctgagcagggccacaggacagggtaaggcagggagacaggggcatgaaggagcctttgggactgtgtgatgagaactaggctgtgcttttactgagcctgagtttgtggcagctgcctcatggggaaggcacccagaggtaaggcagaggaaaggagtaactagggctgagggcaccacaggatctgaggatttagaggcagctatgacccatttgtcattgtatttggacatgtacttcatggacacagatctgagaaccaggcctggctctcactaaccggcaggaggtgtcccacttgtggctgtaggtctttcagcacaccatgccatgggcctctcacactggacgatctgtctgaaaggctgatgttgggaggtgggagcccaggcctggggtctgggacactgggtgacagaggtgtccagaatgtagagtgctcagggtgcgggtggggacaagctgtacagtgtccccatgaggggacaggctgaggtagggactgaagtccacccaaggctcaccacactccatgctctggatgagagcactgagctctgccaccctacaacagcaggcacagcggcctccatgctaggaaagccaggcagcagggacagagttcctggatggggcaggtggaattgtctctgctcggcatcaaactaagtggaccttcagcagtaaggtcttactgtctagtcatggtggacagccaggaacatagtcaatgaacagcctgctttgtttggattcctctggagacttcctgatcaataacttgtaggcctccatgtttcatgtgacaacttacatctctctatgtataacacgggctttctgtgtagtcctgggtatcctagaacaccctgtgtagaccaggctggcttcaaacttgggacatcctcctgtctctgccttctaatccatgctgggattaaagcctgtgccaccacacacaatctaacccatttcttctggaaacaacactgttcacccagccatacactgagttaaaattccttaataaatgttagttcatttacaaaatagtggatttccataaggcttcttcatggatcctaatccaacttttaccttctcttttccccaatcctccaatccccctattcccacttaaatctgaaatccccctccctccattttcaagctgcctgtgttctatgtcccctcatattgtttttttcttgtgtggaggtttgcagatttgaatgcaggaacccttcactggggctaagcctcctgccacccagcacttcccatccccacacctcctcacgcttgatttagcccatgtcccctcatgtgtatgggtgtttctcttcagtctgaggcattactccccatgtcctctggagagctgcctactgtcacagatacctttcttctgtttctgctaggggaagcttttatttccccttgaattttaatcattgtctgggtgtaataccctgggttgagagatgtggtctttcagaacttggactttgtctatccaggcatctggccttaaagtttctactgtggggctgcagagatggctcagtggttaaccacacacgttgttcttgcagaggacttgggcttgattcttagtacctccgtggcagctaagaaccatctgtaactccagctgcacaggattcgatgcccttttctggaggtcatctggagtagtcagctcagcagggccccgggatgcagcatggagagtccatgctgacaggcagggctccacagagagagaaagacagaaacacaggccactgaaagagacagtaatggactgaggggacagagagaaacacacggacagacagacagacagacagacagacagacagacagacagacagacagacagacagacagacagacagagataacaaaacaccgacactcatagacacagagaacagaggggacagggaagttttgagagcaatgggtaggaggtgagagagacacagaggcaatacatacagagagtgactccagaagacagagtctgagaggagacactgcaagagacagagaccccaaaagggttgagagcactggatgctttcacagagaatccagattcaattcccagcaggctcatggcagctcatactgcaatcccagttccagggtgccctgaaggatccttcatgcatgtggagcacagaagctcgctctctctctctctctctctctctctctctctctctctctctctctctctcagacacacacacacacacatacacacacacacatacactctcaaatgaaagccatgaaccagaagacagagacatgtgtgaacattcctcagagacatagccacaacactcacacccagttccccgcagacacacaaatcacctgcctccctgttccaaatcccaaacccattaactcactccctctccttcaggcctttgatttcagagtagcacaccgagggtagctcagcctagacacttcccatgggacctggttacatagcgtgcacagggccacctcttgttggccctataacccatgtgatgattcaggaaaagatgttgtctgagagcagggcctggtacagtccccctggtacagtccccctggtacagtctctctggtacagtctccttggtacaggcttcctgatacagtctctctggtacagtctctctggtacaatctgcctcgtacagtctccctgatacagtctgcctggtacagtctctctggtacagtctgcctggtacagtctccctggtacagtctccctgatacagtctgcctggtacagtctctctggtacagcctctctggtacagtcggcctggtacagtctccctggtacagtctccttggtacagtctccctgatacagtctgcctggtacagtctgcctggtacagtctctctagtacagtctgcctggtacagtctgcctgatacagtctgcctgatacagtctgcctggtacagtctccttggtacagtctgcctggtacagtctgcctgatacagtctgcctggtacagtctctctggtacagtctccttggtacagtctccctgatacagtctccttggtgcagtctccctgatacagtctctctggtacagtctgcctggtacagtctccctggtacagtctccttggtacagtctccctgatacagtctgcctggtacagtctccctggtacagtctccctggtacagtctgcctggcacattctatccctggtgcaggcttcaggtcaggcccaagtgtgaagggtgcagaagacagtgggcagagctgagagagcgctagtcagttttgttcagagaacagtgatggctgctccaggctactggacatcccaggtgtgcttcttacacttctcaaagctgtgggaacacaaccaaccctctacccaattcattgtaattgtctatagcagggcatgcctctgggcatcagggagtcacacagaggcaggtaagactctagtcctggggactgtagaaggtatgtaagtacaacagggcctcatccttggaacactggtgtctcaggcttcaatacagccagtgagaaacacatgcagagtgatgtggccccaggagactgatgggcaccaggaggtcacagagctagaggcctggagggctagggtctgtgggaagggggactgcattcactcttcctatgcttgcccaggaacaactgtctatgcagggccacaggacagggtaaggcagggagacaggggcatgaaggagcctttgggactgtatgatgagagtctaggctgtgctctgactgagcctgagtttgtgacagctgtctcatgaggaagacacccagaggccagacagaggaaaagagtaatcagggctgagcggaccacagggtctggggacgtggaggtggctggcctggctcccacaggccctcagatggagctgcacatcatcccatagcatatcactctggagggcttatcaaaatggttgtgctgtgggactgggtttcaggactgaggcctgagatactgggtagcagaacatgttcagtatacagggtgctcagagtacgggggggggggggacaagctctgcagtgttcctccatgttgggacaagcagaaagaggtcttgaagctgtttgtccatccataggcctaacccatactggccctgctcatggccctagcttgggccacatatctagtgcccactgaatcatcaccatgaagactgttggaaaaccagagcctctgatgtcttcctgccttgcttgctctccctgactctcatagctcacacaggctctgccctggtccaccactgtcctcaactgtaaaccatgccaggcacagagagcaaggaatgtggtggtctcagactgtcacacacaacaatcttgtgcctttcacatccacacgcacaagcatgctcatacccctctgtcaggggtcagtggggtcttccttgggctcactcccatttctagctgctccttggtattggtgactgcggctgctgtgtcggtggctgccagagatgcttgatcggcatgacctcagatataggaatggcctggggtcaacagagtgcacacacttagggcactggccagagttctatgtagaccaaggcctctcttcctagtgtgttatttcacaaaaccttatgcaacaacatcttctattccttttattcctctttgtctgctaatggggaattttctagaaagagtgtcccctctctgtcttcctgctgtgtagacagatcttgtaggtgtgatcacagagtggtgtttcccttcttggccattttcaggccaggaactcagggccagagacagaaagtcaggaaggtaggaaagacagggagacataataaaggtgagatggagacagagaaagacaaagggagaaaagcacaggattgcagggagagacaaggagacgcccgacggaaacagacatcagggaaaagacatgattgttcctttagtaaattgctttccggagaaaagagacagcagagagacatggataggcacacaaagatacaaggagagagacaggaaacagagaaagagagaaacagagatggagaaacaacgagggagagagaagagtagagagaaagacacggagaaaaaaaatcaagaaacagaaaagacaaaagataggaagacagagaaataggccagaaatacagacagacagagagatgcctgaagatgttctctctcacctagagaaagaaagcacaggcagagataatacagagagagagagagagagagagagagagagagagagagagagagagagagagagagagaggagagaaagaggagagacacggtgttagaggagaaagcattatgttttgatagagacagagatacagcaactgaggaacagactgagcagaaagaatcccactcagagagagacagaggctaagctgggagaggcaggggtggccagagagggagacagaggagagcctgtgggacaggtcagacaccatcttggaagacccagtgacaagccagggaggtgacaggttagtgcagtttctaccccacagtccacaggctggagccacaggcctgtgtccatgtggccacaggctagctcccagcctgccaagcctgtctgtggagggattgcggagtggggctgggctgaggcaggccaggatttttccagtggagcagccagtgactgggctgagggtcactgcccaccatccccgtgattctgggtagacccaggacctggagcacacacagccttcctgtctctcccacttccctggggtgtttggaccttgcctatctcctgtcattccctcctagggtcagattccagcagtgtcgataaatgggaaaacactgaattcaatgtcaccgttaggggtcatggaacccccagccccatccccaaagctggtcaacctggccagggtggggtgaacctgcagctgcaggtgggggaatcattgatgctatttttggctcagagaatgagaaacatgtttttctgcatggaacaaacatccatttgcatgtgccccgagggccaaccctgcacagagtgagtcactcggcaggtgtgtgtgtgtgtgtgtgtgtgtgtgtgagagagagagagagagagagagagagagagagagagacagagacagagacagagacagacagagagacagagagacagagagagagacagagagagacacacacagagacagagagacagagagagacagagacagagagagacacacacacagagacagagagacagagagagagatgttgtgagcaagccctgtttcaggtactgatatctgtgcccccgtgccccagcccatgtggaaaaactacccttaggggcccattaactcatcacagtccaggccatcatggtgagccctagctgacctaagcaggttccaccctaaacatgaaggaaaataataaaggccatctgttacccagaatcctagggatggtgggcagtgaccctcagcccactcctggccgctccactggaagaatcctggcctgcctcagcccagccccactccgcaatccctccacagacaggcttggcaggctgggagctagcctgtggccacatggacacaggcctgtggctccagcctgtggactgtggggtagaaactgcactaacctgtcacctccctggcttgtcactgggtcttccaagatggtgtctgacctgtcccacaggctctcctctgtctccctctctggccacccctgcctctcccagcttagcctctgtctctctctgagtgggattctctctgctcagtctgtcagccatagttggagagagtccatctatgtttgcctctgtctctgccaattccatcagaggtctctctactaacacttgcctctgcatgtgtctcttggtccttctcctgtcttcccatctctctatctcctcatctctctgtctttctgttactccctgtctctgtctctctgtcttttctctcactgtctttatctctctgcctgtttcatggacttttctctgtctctctgtctctgtctctctgtctctctctctgtctctctctgtctctgtctctctctgcccctatctcttggtctctatctctatcttcaactccctatctttgttcctcatactcacatttacctctttcccaagcccccagtctccaggtctgcctgtttctgtctctcccttgccatgtttccctgttttattctctctcctcctgaatgctctggcttgaaactggccaagaagggaaacaccactctgtgatcacacctacaggatctgtctacacagcaggaagacagagaggcgaccctctttcaccctacagtgtctggacttggttgattccaggttactcctatactcaagtccgggactatggtggtcaagcatctctggcagccactgggacagcagctatagccaccaacatcgagccctgttagctaccaacattagctcctcaaagaggttgggtctataggcctctggtgtgaggagatgttgacagtgagaattagttcccaaggaggacaccactgtttcctgttagatggagaactacagtgggtacgaacatgcttgaacacatgagtgtcaaatgcacaagactgttgggtgtgtcacccttcccctctctgttcatggcatgactgcacactgaacacaatggtggattgggacagagtctgtgtgagttgagaatcatgaagagtgtagacacttcaaggatagtgtagacccttctagttcgtggtgatggctcacttggcactgagtttctgaccccacagggaccatggacaagggcagtatgggctgtgcctatggatacaaaagagacttcgaagcctgtattagcctgtcccctcatggaggaacacagcacagcttgtctctacccacactctgagtactctacgtcctggacacctctgtcacccagtgtcctaggtcccatccttggctcccacatcacatctgcctttcagacagatcttccagtgtgacagacccatttcatggtgctgaacaacataaacccatttcctgagggttggtgagagccggcctggttctcagatctgtgtccatgaagtacatgaccaaataccatgacaaatgggtcatagctgcctctaattcctcagaccctatgggccctcagccctggttactcctttcctcggcctggcctctgggtgccttccccatgaggcagctgccacaaacccaggctcagtcagaacatagcctagttcctaccatacagtcccaaaggttgcttcatgcccctgtctccctgccttagcctgtctgtgctcctgcacagacaagagttcctgggcaagcataggaagagtgaatgcagtccctcttccaacagaccctagccctccaggcctctagctctgtgacctcctggtgtccattagactcctggggcctcatcactctgcatgtgttgctcttgtacatgccttcccctctcagtccccaggtctagagtcttacctgcctctgtgtgacttcctgatgtccagaggcatgccctgctatagacaattacactgaagtgagtagagggtcggttgtgttcccacagctttgagaagtgtaggaagcacacctgggatgtccagtaacctggagcggccatcactgttctctgaacaaaactgactagcattctctcatctctgcccactatcttctgcacccttcacacttgggcctgacctgaagcctgcaccagggacagactttaccaggcagactgtaccaggaagactgtaccagggagattgtaccaggcagagtgtgccaggcagactgtacaaggcacactatatcagagagactttaccatgcagactgcaccagggagactgtaccagggagactgtaccagggagactgcaccagggagactgtaccaggccctgatctcagacaacatcttttactgagacatcacatggattacagggccagcaagaggtgggggctgtggaccagaggctcatactgtgttaccaggtcccatgggaagtgtccaggctgagctaccctcagtgtgctactctgagaacaaaggcctggaggagagggagtgggtcaatgggtttggggtttggatcaggcaggcaggtgctgcgtgtgtctgtgtggaggctgggtgtgagtgctttggctatgtctctgaggagcgttcactcatgtctctgtctctggttcatggctttcatctgagagagagagagagagagaaagagagagagagagagagagagagagagagagagagagagagagcgcttctgtgctccacatgcatgaaggatccttcagggcaccctggaactgggatttcagtatgaactgccatgaacctgctgggaattgaatctggattctctgtgaaagcatccagtgctctcaacccttttggggtctctgtctcttgcagtgtctcctctcagactctgtcttctggagtcactctctgtatgtattgcctctgtgtctctctcacctcctacccattgctctcaaaacttccctgtcccctctgttctctgtgtctatgagtgtcggtgttttgttatctctgtctgtctgtctgtctgtctgtccgtgtgtttctctctgtcccctcagtccattactgtctctttcagtggcctgtgtttctgtctttctctctctgtggagccctgcctgtcagcatggactctccatgctgcatcccggggccctgctgagctgactactccagatgacctccagaaaagggcatcgaatcctgtgcagctggagttacagatggttcttagctgccacggaggtactaggaatcaagcccaagtcctctgcaagaacaacgtgtgtggttaaccactgagtcatctctgcagccccacagtagaaactttaaggtcagatgcctggatagacaaagtccaagttctgaaagaccacatctctcaacccagggtattacacccagacaatgattaaaattcaaggggaaataaaagcttcccctagcagaaacagaagaaaggtatctgtgacagtaggcagctcttcagaggacacggggagtaatgcctcagactgaagagaaacacccattcacatgaggggacaggggctaaatcaagcgtgaggaggtgtggggatggaaagtaatgggtggcaggaggcttagccccagtgaagggttcctgcattcaaatctgcaaacctccacacaagaaaaaaataatatgaggggacgtagaacacaggcagcttgaaaatggaggatgcttttagcattaaagatttacagtgtagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcattcctctttttttggcggccgatggcggttatattccttgcgtctcccgtatccagaaataataatcattcaaaacggtgttctcctcagccagtgtatgccttttggattttgcttccagcagcaccgagtggagaggagaggagaggagaggagaggagaggagaggagagatgttcagttatccaaaactaaggatccatgaagaagccttatggaaatccactattttgtaaatgaactaacatttattaaggaattttaactcagtgtatggctgggtgaacagtgttgttcccagaagaaatgggttagattgtgtgtggtggcacaggctttactcccagcatttattagaaggcagagacaggaggatgtcccaagtttgaagccagcctggtctacacagggtgttctaggatacccaggactacacagaaagcccgtgttatacatagagagatgtaagttgtcacatgaaacatggaggcctacaagttattgatcaggaagtctccagaggaatccaaacaaagcaggctgttcattgactatgttcctggctgtccaccatgactagacagtaagaccttactgctgaaggtccacttagtttgatgccgagcagagacaattccacctgccccatccaggaactctgtccctgctgcctggctttcctagcatggaggccgctgtgcctgctgttgtagggtggcagagctcagtgctctcatccagagcatggagtgtggtgggcctgtggatggacttcagtccctatctcagcctgtcccctcatggggacactgtacagcttgtccccacccgcaccctgagcactctacattctggacacctctgtcacccagtgtcccagaccccaggcctgggctcccacctcccaacatcagcctttcagacagatcgtccagtgtgagaggcccatggcatggtgtgctgaaagacctacagccacaagtgggacacctcctgccggttagtgagagccaggcctggttctcagatctgtgtccatgaagtacatgtccaaataccatgacaaatgggtcatagctgcctctaaatcctcagatcctgtggtgccctcagccctggttactcctttcctctgccttacctctgggtgccttccccatgaggcagctgccacaaactcaggctcagtaaaagcacagcctagttctcatcacacagtcccaaaggctccttcatgcccctgtctccctgccttaccctgtcctgtggccctgcccagcctctgctcctggacatgggtgggaagaacctaagcagtcccccttcccacagactctagccctcccggcctctagctctgtgacctcctggtgcccatcagtctcctggggccacatcactctgcatatgttgctcactggctatccagaggcctcgaatccctgtgtcctaaggatgaggccctcttgtacatgccttcccctctcagtccccaggtctatagtcttacctgcctctgtgtgactccctgatgcccagaggcatgccctgctataggcaattacactgaagtgagtagagggtcggttgtgttcccacagctttgagaagtgtaagaagcacacctgggatgtccagtagcctggagcggccatcactgttctctgaacaaaactgactagcgctctctcagctctgcccactgtcttctgcactcttcatacttgggcctgacctgaagcctgcaccagggatagactgtgccaggcagactgtaccagagagactgtaccaggcagactgtatcagggagactgtaccaggcagactgtatcagggagactgtaccaggcagactgtatcagggagactgtaccaggcagactgtaccacacagactatactaggcatcttgtaccagagagactttaccaggcagactgcaccagggacactctaccagggacactgtaccagggacactgtaccagggacactgtaccaggccctgctctcagacaacatcttctcctgagacatcacatggattacagggccaacaagggatgggggctgtggaccagagatgcttgctgtgtctccaggccccttgggaagtgtccaggctgagctaccctcagtgtgctactctgagaacaaagacctggaggagagggagtgggttcatgggtttggggtttggatcaggcaggcaggtgctgtgtgtgtctgtgtggagctgggtgtgagtgctgtggctatgtctctgaggagtgttcacacatgtctctttcttctggtgcatggctttcatctgagagagagagaaagagagagagagagagagagagagagagagagagagagagtgtgttgctgccttcatttgagtgcttggtgggctccatgctgtacctctgccttccctgtgtgtctgtccttttgcctctcccttcctttggcctgtctctcttgtctgcatctgtctctcttgtctctccctctctgtgtctcttttctctcctgtctctgtgtctcttctttcctgtggtctctcctcatccccatgtctgcatcagtgtctatcagtctttaactctgtgtcctcttgttcccatttctgtccctctggatatttctgtctttctgtgtgtctgtcctcatctctcccagcgtccatgtctttgtgtccctttgtccccacacagtatcttctcaaatactctgtgtgcctggtcccctgtctctcattccttttctcactgctcccatcagtgtttctctgtgtctctgcttctgtgtctctgtgtgtctgtctcatgctatctctttctctctcattatctctgtctccctcagacttctctgtctttcttggtctctgtctccctctgtgtctctgtctttctgcatgtctaatgtctctgtgtctcccttagctcatctctgtctctctcaatattcccacaatcccctttattctttgtgtctctgtctctgtggtgtctctttctcagtctctctgtatttcgctctgtctctcagaatctctgtgtccctcatattatttttcgaagtgtctccctatctctttcagtaacactatttctgtttttctcagtctctctctctctctctctctctctctctctnnnnnnnnctctctctctcagaaagtctatggcacctcttctatgtgtgtcccactctggacctggatcaatcttccttcttggacctcagtttcatcagttgtgagacgataccttgccagaagtccagaggactgtctgtcctccatagtctagaccacctgtgatctgagagatattgggacaacggatgtgcagtgagggacctgcctttctgtggagccctgtctggctggaatacactctccattctgcatcaccagagccttgttgagctggctattctagttgtctactagaatagttgtgtgaccttgggtgatgctggctgacctcaggctggccttggctggccttggttgacactgaatgaccctgggaagaccagacttaatcttaattggacttgttctcattgggacagaacatggcctcactaaggcatgactgtggatggttgtggagaaccttgagtgatgggggttggggccttctcagtccctgtcagggctcccctggctctgacccctcatccagccccagacccacctggcctggtccagggtggtgtgattctcagaacagtagctctgttttggggcacctgggctgagataggctcaggatgactcagctggcctcagagtggagttattttgaatgtttcagcaggtgatagaaaacagagacttcagaagaaagaaaaacaagatgctaatgtgaccatccctgccctacccccacacctgccccgcaaaccttccccacaatgctgaccccacatctgtagaccccaggccagaggctccagctcacagggcctgggcctgctttgtttccattcagtgcctctgggaaaggcagatgagtaaaggggtcactctcccagttgcagcccagtgtgtgaacagtgtggtggggattctggaatcttctgcaggaatcccctgaagagatcttcctaatgagaatgaggcttggaatatcaaaggtacttcttgtaaaataccactgattccttgggcctcagagaatggatgtgtgatgaggaccaaggtccaggaccagtgttgataagcagaatttggggctagagttcaggcttagaagttgatgttgaggacctgggcccattgatcagtacagaacctagttgttagaatcagaacccagtgtctatgaccagagctcagtgatagggaccaagtcccaaggccaaatgatcaagaccaggacccagttgccaggaccaagatccaggtttcacaaccaaacctagttacgcagaccagaaaccattcgttggaatctggatctgaatcagagcccaatcacactactctaaaccagagttcagtgttgaggaccagggtacgtgatgagcccaagattcagagatcaagaggtggattcagtaattaagaccaggattcagagatcaggatcagggctcagttagcaggatcagggctcagtcatgtggtcatgggctcacggtccaatgtccatgcccaaaacacaactaaggacccagtggtcagaaccaaggcctgatgatcagagacaatacacactgctcagagctgaatttcagtggcaaggatgaagacataatgataaagactagggatcagtgagcagaaccagcgatgaggacccagacgcatctctgaagactagagtcagtgaccatgaccagttcaacgatcatgagtaggacttaattctgatcatacgagttcagtgatcacgaacaaggctcagtgatcatgacaagggctcagggaacaagagtgaggctcagcgatgaaaactggacctcagttatgagcccagtgatgagtaaccaggtctcggtcattagggccaggattcagtgataagaaccaagggtctctgcagggctcagtgcatcctctccccctgagactggacaaagccgcccagccacagggatggattctccagacaggcaacagcttcagggacagcccccccgtgatgcgccagagtaggggatacccaggggacttccacactctcaaagaagaaggggagaatggaacatgaagaagggactgtgaggggggaccgggaagtgggggacacagtgactgggatataaagtgaataaataaattaatggaaaatatcacatgggtgtagggaattttgaaagaataaataaaatgttaaaaatgaaaagaaaaaaagaccaagggtcaatgatcagggtgataataaataaataaataaataaataaataaataaataaataaataaataagaaaggaaagagagaaagaaaggaaggaagaaagaaagaaagaaagaaagaaagaaagaaagaaagaaagaacaaacgaactgaatgtcagaatttagggtaagatctcagtgatgaggatcagggatcagtggtttgaacgcagacacactgcccagggccattgttcaatgacgagagtcagggatcagctatcagaaccagggccagtaacgaaagccagggcccagtgaccccaaccaaaaaccagtgactaaaaccaaataaaatagaaactaggcagccacgatggtgcacacctttaatcccagaactcaggagtcaggggcagggggagttcaagacaaccctggtctacacagtgagttccaagacagccagggctacccagagaaaccctgtctagataacaaagactagaaaccatgagctcagtgatcagtggcagttcttgatgactaagaccatggtcaagaggactgatcagcaggactcagtggttagactcaggacatggtgatgatagcctctgttccagggatcagaaccaaggccaagggccaaggccatgactgagtcatcagaacagggcctctccatgagcactagtcaggcgcagccaggcctagcatgtcaatcaggcaaaattgggtatgtgtgtggtggtatgactgactatacatcgtcttagtatctgtctgaccccaccaccatcttccctgcctccgtccactcacagatctctgacgcgtcaccgcagggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcctgcaggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaagaaaccgaaatcaaaaaaaagaataaaaaaaaaatgatgaattgaattgaaaagcgtggtgcactctcagtacaatctgctctgatgccgcatagttaagccagccccgacacccgccaacacccgctgacgcgaaccccttgcggcc

SEQ ID NO: 11 - DNA, 547891 bp, Artificial Sequence
  BAC6-3 BAC3 Annabel  seuqences in tandem
  misc_feature (496443)..(496572): n is a, c, g, or t
  misc_feature (528461)..(528510): n is a, c, g, or t
  misc_feature (540084)..(540488): n is a, c, g, or t
  misc_feature (543645)..(543652): n is a, c, g, or t
atcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaataaagatcccccgaacacaacccacagctaccaccatcaacaatatttatatatataacgtacacatagaaatcacacaaacagagtatttattcttaactacatgaactaccatcagaccgtctgggccactatataatgtgccattcataaacgtgatcactttacgtagcaggcaaccccaggtgaaaatttttcagcgagctgccagattgtcaggtgaaaaactgaaaaaaacttctgggcgatgagcttgtggcgggaaattaagtatataaagcagttagtttcttctgcttcttgtggttctgggtattcttgtaatatttggaagaatagaaaatcaagactactgcctttcttttcatattatagaggaagaaatacgcacgaacacgatatagaggtaaagggggagtctggcaacccttcttgccactcatgtcccagctctcaccatgtgacatagcctgttccccctttgccttccatcatgattgtaaagtagatcctggtgccatgcttctcacacagccttcagaactgtaagccaaatgtgcctcttttctttgtaaatcacttggcctcaggtattaatttataggaatgcaaaagagactaacacaccgtccaaagcattacacagattcaactctatttttatcaaatgaccaatataattgattacatatttagaaaaaaaatactaaaattcctatagaatcaaaaaagagtctgaatagcaaaagcaatcctaagcaaaaagaccgaagctggaagcaccacattctctgacctcaaattatactacatgaatataataagaaagacagcatgctactagtagaaaaaaatagcccagaaagaaagccaaatatctaaaaccaactgttgtttgacaaaactgacaaaaatatacactggagaaacaaccctctattcaataagtggtgccgggaaaattaggtggcttatgtggaagaatagaactagacttccatatcaccgtagacacaaattaactgaatatggattcagtgtttaaatttataaactaaaactataaaaatacttgaataaaatctaaaaagagtcctctggacattggtctaagcaaacaatatatgactaagacttcaaaagcaaatgcaataaaaacagaagtagacaaacaggatttagttgaactaaaggtcttctgcacagcaaaagaaataaccaacatggtgaccagacaatctgcaaatggaaaaaatatctggaatctattcatcttgcaaagggctaatatatagaatctacaagtaactcaaataagtcaactaaaaattacaaataacttcattaaagaatagacataaacagacatttatcaaaagaatacacagaagtggccaacacaaataagaaaatatactcagcatcaccaatcatctgataaatgtaaattagaaacaacatgatacggcatcttccaccagtcagaatggctgttattacaaataaaaacagcaggtgtttgcagacaaacataggaaaaataatgatttatatatgcttggtgagaatgtaaattagtacaacctccatgaaaaacaacatagaaatttctcaaagaactaaaattagaattaccatttcttccagtaagctgtcccagtaggcatgttcctcccaaacttttatatcagagaatgttgcctgcactcatatgtttatttcaacaccattttcaatagaaaagtcaaataatctaagtgtcaatcagtggatgattagataaaatatgatatatgtaaatcatggaatactatgcagccagtatggtatgaattcagtgtgaccagcccctggacaagggcttgagtggatgggatggatcatcacctacactgggaacccaacatataccaacggcttcacaggacggtttctattctccatggacacctctgtcagcatggcgtatctgcagatcagcagcctaaaggctgaggacacggccgtgtatgactgtatgagagacacagtgtggaaacccacatcccgagggagtcagaaaccccgagggaggaggcagctgtgctgagctgaggcagtggtgcagcagtttctttaacttccatatgatctcattttgcatcatcttctacttttatattagctaagaacttggggtagacaggtgctcctaagagatccttaacttgcccattttgatgggttttccagaagacgtgagaagccactttgttagcaaagcatcccaaatccatgccctgttctagatacatgtgagcccatttcctggtctttgcttaactgacaagctctcatcagtgcacctgggctaatttcacatcaggtagaggaacgcgttataaaggaaagctaatgttgtaatagcaattcctgcttaaaaaccttcagcttcattgtttttgtgtaatccatcagcaaattatgttagttcaaggttctcaatgggagtttctaataaatagaaaggatgtataaagcttcccctaattaaaatgaaacaattgtgaacacaacctcggtattcagccatgtctccacccttcacacccttcgccacaaaggaattttcacctctcctggaagctgggttcattttcaaattagttatttttttcaatgtaatatctcaagattatcgtatatgactattttagcagaaagtgaattatgggaacttgaactaaacaactgaaaacaaattcacaactaattaaacaagatgccagaatgtgattggctccaggctttgtaattcagcagttcatgtacccagactggaaatttacatgtcttcttgttaccttcacagcacagtcaactcccattatgtaagaaatggtgactgcattcccaagggttatgcatagatatgaaaatagactgggtaaggtgaggagttgattgtttaaattcccctctgaagaagcagcatcaactcaacaaaccacctctcttcactctgtgactagagctatgtcacaggccacatggacctaaatccttgatggatataacatgactacataaattgggctgatcatttttatgctataaaattaatagatgacactgcactccagcctgcacaaccaagcaagtcttcatctgtaaaatctaaaaaagaaaaattaataggtactgacttcgaaatttttgataataatattttcaccacccaaatttaatcacacccacatgttacctgcatcttcactgaaaagttcccagtcacgatgagttccttcaatgctccatgtgttcaaatctggacatcaagagagtccagagaataaaacacaatgacggcagtgaaactgatatatattcagcacctcttaactcaggaggactccatacaccctggcacacagctgcttttctaaatggctcacaatgactccagctcactcacagagctcagacagaaacctcccttcagggtgggagctgggtggcagggggcactcagtacccgcagaggtgaaaatgagctttcagatggaacttccctgtcacctcaacatggaatttattgtttcatttcattacctctctttccataatggttcatttcttttggcctgttcattactgatatttttcagagcaatctcacttgaatctttactcttttgcattttgtctccttgacaatgttgggaagttttacctccagcatcataacatgatctagtgatctgacacattgtgcaaacaatacctacaaattcagaacctctttgtttttctttccacaaaatataattctttctgttctgtgtatgagcatgtcttagcaaccctgtacacacccacatagatgtctacaagcctatgaattgttctctgtaaataaaaatttatctcaaattccttcaatgttcataattctgagagtgaggaaggtccttctcaatctgttcaaacaaaatgcccagagaccatccagtaggtaaggagttcacctggctctggtgtggggtctgtctctttccctctgttgtcccacaggtcagcccagttgttcacgtcctaacaagaaagcccaggtttgtcctgattttaaaacacatcaaacttctgatgactctcctgttacccacatccatggagatagattatttattatataattcagcaaactaatgtcaaatgcccaagttgcaataccgcacatcctagggtatgttcatgcaattcaatggaggagaaaatctttcagagacagatggatctgaaatgataaatatgtgggtaaggactctgggcttgagtatcattgtccagccatgtttcacaagtgtgtcctgtcagggaaggatcagagttccttgtgctctcagagggaaggggtcacagagttcctctctggttcccaggaaaggtaatcgcactaatcttcatgatcttcatgagactatcctccagtgctgacctgttacggagtttttgtctgaagttctcactgcaatccccaatctacatattttcaatcagaagtgtttagaggccaggacacatcttcaaggtcacacattgagaagtatggagatatgtcccactaccttctcctacgatctcagacagaatcccaaatttcaaaaggacacagaaggacagctctcaggtgcttttaaaaaatgacccacttccagggacagtgagcttccctgtaaccatggtggatgttctgaactacaataaacattggatggatccagtattgtttgaagtcactgtcattattacattcagctgttgtttcaatgtgtctgaaagggtaaatgactatttagatggcctgggtgtgtggttggttttatatgaatctttaagggttgaacagtactgaccctattccaaaatctgtccttgatccaggatcacactcatctctcagaccagctccttcagcacatctctttacctggaagaagaggactctgggcttggagaggggaggccccaagaagagaactgagttctcaaagggcacagccagcattctcctcccagggtgagctcaaaagactggcgcctctctcatcccttttcactgctccgtacaaacgcaccacccccatgcaaatcctcacttaggcgcccacaggaagccaccacacatttccttaaattcaggtccaactcataagggaaatgctttctgagagtcatggatctcatgtgcaagaaaatgaagcacctgtggttcttcctcctgctggtggcggctcccagatgtgagtgtttctaggatgcagacatggagatatgggaggctgcctctgatcccagggctcactgtgggtttttctgttcacaggggtcctgtcccagctgcagctgcaggagtcgggcccaggactggtgaagccttcggagaccctgtccctcacctgcactgtctctggtggctccatcagcagtagtagttactactggggctggatccgccagcccccagggaaggggctggagtggattgggagtatctattatagtgggagcacctactacaacccgtccctcaagagtcgagtcaccatatccgtagacacgtccaagaaccagttctccctgaagctgagctctgtgaccgccgcagacacggctgtgtattactgtgcgagacacacagtgaggggaggtgagtgtgagcccagacaaaaacctccctgcagggaggctgagggggcgggcgcaggtgcagctcagggccagcagggggcgtgcggagctcacggaatacaaggccgggtcaggagcaggtgcagggtgagcggggcttgctcatcttctcagtcgtctccctcctcgccagcacctcagctttccgtagaggtcctctttctttattgtgtgtggttctacttcctcacatccttgtgccaggaaagaaaggagtaaggcaaattttcctgttacaattgaagtttcaccaattactaagaactttcctgcaagtacctgcacagcccattataccttatttatatatgtatatattctaatgcttctcaccatctcttgatttgtgtcatcaatttaattgtgccctttttgaaattcatatgctgaaactttaaatccaatggatctatatcggaattttaatggtataattaatgttaaatgtggtcataaatgagaccctaatgcaatagagctgttgtctttataagaagaggaagagacaccagatacctctcacttctcacatgcactcagagaagaggccacgtggagacatagtgcactagaaggtgggcctctgcaagccaggaagaagccgcaccaagaaccaaccctgccagcaccttgatcttctacattcagactgcagaattgtaagaaaatcaatatttgttgtttaagccacccactccttttgtcttcttacgaagacccagacaggctaataccacacaactctgttagctccgtctcctggagggagaagcagccccctgaagctgggcacatcgctcagattttcacatgaattaggcaaaaacagtagctctcatataaaaactgtcacgtccctgttgggacaaggtcttttaaacaagccctggggctttgtcacaaatgttgcattttatcctttattaggacttaactaattgacaatgagtaccagctggatggaaactgaccactgaccatcttctgctgtctccttattatatcacagaaaaccacagcaacattactctatgtcttcaactttctaaatttgtactgaatctattgctaaatgaggagctacatggggtctgagttttgttaccttcttcccagtcttccccaattaccaagcatagaagatactttcagtgaaatttagctgtcaatgcccccgacaccacatcatgttttaaggtccaaggactttctttggggggctattgaaaaacacttttgaatggaaaatcctaaagcatacaacagctgaaagaatggcccctgtgcacatgaaggctgaagggatggatgatagggtacgttcctccaaggtgttcctgggcatgtgatggttggatacctcatgcatacgaaaacaaggactgaactgagatagaaacaagggccatatcctataggaaaacaagaaaaaaacgggcatccctgaagagagttaattagacttggtgggtttaagatgaatttttttccaaagttttttaatgttctaagctaaatatgaatattttcaataaactgcaaattaaaaggagaatgaatttagaagtttagacagaaaaaagccatgagggtgtagaaagcaaatccacacaaaactgtcacatggcagaggccagaatggagctgatgcagctacatcattattctgcagacctagttgagaccctttggtgtttaaggcaggtccagcagtgaagaactcctttattttttgtctggcaaagttctaatctaatcttcatttctgaaaaggatttacatggtaaagattcgtcttggcaggttttatttatttttagtcccccccaacccacgtcaatttgagtaaagtcatgtgttacgtaacaatgctgcagtcaacagtagaccacatatatgtttgtggccacataatgttgtaataccatattttcactaaactttttccatgttttgatgtgtttagatagagagatacttaccatggtgtttccatttcctgcagtgttcagtgcagtaacacgctgtacaggttagttgtctgggaaccctgcgctaatccacataccctgtgtgtagtagggtattccttgtaggtttgtgaaaattcacccttgatgcttgcacaatgatgaaattgcccagggacacatttctcaaaaagaacctctgtcaataaaccacacaccattgaatacaatccctgtgccttctgaactgaaaaccttctgctgagaaatctgttccttttctttctgttttctaaagcctcttttatttccagcaatgtggttttaaactgtgtcacattttttgtcattgggtttatcttacgtaaaatttatagagcttcttcattgtggatgaatatttgcttcccttctccaaatttggaaatattttttgctattattttgaataatttatctcttctctctctctctctctctctctctctctctctctccctctctctctctctctctctctctctctctctctctctctctctctctccccctctctcccttcactaccccttttgtcttgtctttgtataactcctcaaatgcgtagttgagtgtttagtgtctttcctggcccataagtcttgaactcttttttatttctttcacttaaatttttcttctctgtctctactatttcaaatgatctttctttgagtttactgtttcttctattacttgatctagtttggtctaaaatcttgttaaaatttttggctgtattcttcaggatcaatatttttgtttagtcatcttttaaatgttttatctttattaaaattctcacattgttcttgcatgctgccactagctcattgaacatgtttctaacatttactttaaagtttctgtcaggtaatccatgttcttccttttcattgatgtcagtttatggaccttttggttgttcttctgtttggaccatgttcccctgcttcttcattttccttgactgtctttgttgttatctgttctttataacaaaagccatcatatacttcttcaaagactaggctcatagagatcaccctcaccaatcagcccagacagtaattgtgggtctctcaaaacttgataggattcaaacttctgtctgttcttagtggcccctaggttttagaggatgatagattgtgccaggactcacaggtaagggaggtagaaactatgtactcatgaccatggggtctgtgctgatctgagcttctcttgtcatcactctcaatattcaacttccccgtggatcaggctcagctgtggctgctccacgtggggctgttctcagtctgttgcctctgtgtgtgcagaagtcctctgtgaagttaactagtggagtcagacaggaaaatactacagaccaagaattctcagactgttctgcaaagcccctggattcactgaaaaaagaacaagtttggtccagcaggattcatggcaagtgttggtgagggagataacagtaattcaagtggaagttctcaatgggactcgccttcagtacaaagaagattaacagtcctcagagacactgttcagaagattctcttttaagataataaaactgagagcccaagacaagtctgtgtattactgtgagggacacagtgtggggacatctatgtgagcacagacacaaaagtccctgcagggagacaggaggggactgcatgttagttgctgctcagaaccaccagggggcattcaggacaccagtaggcactcagaaccaccaaggagagctcagaatcaccagggggcactcaggaaactggcaggtgctcagaaccaccaaggggcgctcaagatcccagcgggagctcataaccaccagggggcgctcaggacactagggggctcagaaccactagggggcgcccaggaccaccaggtctctcaagacaggagggcgcactcaggacactagggggcgctcagaaccatcagggggcaatcaggacaccagagggacttcagaaccaccagggggcgctgagaaccaccagggggtgctcaggacatgaccggccctcaggaccaccaggggatgttcagaacaccaggaagcactcaggacaccagagagcgatcagaacaccagggggcactcagatcctccagggggcactcaggacaacagggagctctcaggacaccagggtgagctcagtaaaccagtgttcgctcagaaccaccagggagcactgaggacaccaccgctcccttaggaggcagctccacatcaggtccctggatccgggcagggagggcggttccttttggatcttgccactaaccttttgggagttttcctgcttcctttgtggtttcaagaatcatttgcagattcttctcatgtacaaagctctgctttcttggattatgtaatgtttttggctttggatgctaccagaattacgttgtactgtgagaggattcattcgtggtgtgtgcaatagtgaatgaaagctccaatgttaggggtggctttgaaagctacgttaggggtggctgagggcagttagcagaaaatgatcatcactatagaaggctactcatttctttgcacatttgcataaacaattgtagtttatgccctaaaaactgcatgttttcttggccctttttcttaaatggctccactctaagtccagtaatctaattaagctgtgtttcaaagaccaccaatcaagttaattctgtttaatgcaacactttgtaaagaaaatgtacatctgttttttagagtcagctttaaattttacattactttacaaatattgatttgtcaaatttagtctcataactatcttcagtaatttaaaatcttagtcatgtcatgttaaattaagtaatcctaggtttctcacttgaattagggttactaagaattagaatagtaaaagagtataattagcttttggtgaggtttataaagaaagatgaggatttttttttttttttgcttaaaaatattctgttttccagtttacagggcttttcaactggttttaagataaccactgtttacatctaaacttttttttgtaaatgactgctgagtttctatacatattccatagctagagtttcaaagtaaaagctctagtatctttgtattagtgtgtgtatgcgtagatgtgttaatatgtgcatgtatatatatgtgtgtgtgtgtgtgtgtgtgtgtgtgtgtgtgtgtgttgtggctactaggtacaaaattggctttgaaataaatattttcaaattaagtaaatgagcccaatgcatttgaagtacatgtgacttaaataaatatttaataaataagttggctttaaaattattggtaaaaacaaattagagatattttaacaattatcagcataccttatagtttatattaattcatcaagtgattttatatttaaaatcacagctagatattatatggtgtcaaaattttttatgatgattataaaattattaacctcgttggccatatgcggtggctcacacctgtaatcccagctctttggaaggctgaggtgggtggatcacgaggtgaggagattgagaccatcctggctaacatggtgaaaccccatctctactaaaaatacaaaaagaaaaaaaaaattagctgggcatgctggcaggcgcctgtaatcccagctactctggaggctgaggcaggagaatgcttgaaccccagaggtggagcttgcagtgagctgagatcgcaccactgtactgcagcctggatgacagagcgagactccgtctcaaaaaaaaaaattataaacctcattaaaaccagaatgatctttgtaattttttgacaaatatgatgtttaatattgttgttttaataaaaaacaggtaaatagttattagaaaaacaattatttgcttaattataaggtttttactcaggcaagcacctgaaattcatgggttataacatggttaacagagaaaaaactttaaaggatgaattacaattttcataagtaatctagataagctacttaaataaaatagggaaatgtaatcaaataaaccttttaaataaacttgttctacaatttaaaaatctaaagtttaattaaataatagatattgactaaatgtttaggtcattactaattgttttaaaaaatatataagaaaatatttttcttaaaaaattattcttagaaaaataatgtaattcaaagttatttatataacatcataaaaagtaagagagttttaaagaaatttattgacatagagaagtacttttggtaagaaaggttaaaataaaaaaattttatatgagaaataatcttgcatggtaattttttatcctaaaataaaatgactaagaaagaatgacgtttagaataaaacaagatgttcaactatgccataaatggtttgtgtaagtgaaaataagatttataaaaagttaatttattaaaaaaccttcatattatcaagttgactataattgaaagggaagtatttataatagtctttatagagatctggcttttatataaaatatagtaatacactgaagactggttagaatgacaaaattgtcttaaagtgttgatttactaaataaaattataagatattttaattttttaacccccaaatttaacttttattgcatcttgccattttgattttttccctttgagaagacttgagaggctctccattttttcatcacgtcctttaacattttttttcttacagcgattagcttcttactgacttaacttctaactgttgttagcttttaactgctattattgtctgatgctaaaaacattttatctttaagttctaaataaaatgttttctttcaatataacattctacactcttggcttatctttaaatgtctacatttttctatgaaaccaaagtcttcacgtgtaatctgagtcacattcttggtatgtctaattaattcaaatgcttttttcattagagttgacctgcaggttatctacatgcattttccaatagggaaaagcaatcacactgtaaaaggttttgctttgctatttggtaactggcataaaacaaattttatattttattgaaataattcctatgttactgttattaaggtttccaacttactgagattttaagaaaatataaattaatgttattacattcatgtagctatctacattacttttaaaggccttgtgctgccacattactgacctttgactcctaggtctaaaaaggacacacagcattttgggagactaaggcaggcagatcacctgaggtcaggagtttgagaccagcctggccaacatggcgaaaccctgtctttataagaaatacaaaaattacccaggcatggtggtggatgcctgtaatcccagctacttggaagcctgaggcagggagaattgcttgaacctgggagacagagattgcagtgagccaagattgtgccactgaactccagcctgggtgatagagcaatattccatctcagaaaaaatatataaataagagaaaaaggacactaagtcctgctaaatcttaaacactgacagtaattaaagccccatctacagacctggaagaaaatgacaataaaaattcatcatactcttaagacataaggccagaaattgaaactactcaacaactccaggcccagggactattacagaagtggatttgtaagattgtaaaagctaattttgagatataatattacttgagagtttctttataagttaagcattaatattaaatgcacactaatggaagtctagcatctgggcccctgtgacagattgacaagggtttcttgaagaagtaatccactctttagcttaaaaaattattaaaatttataaaagacctatgaaaattatattttatggtaaaagtagttataatttaatagacttatttctcagaattgagagatagttttaatttttctcatgatgttcttataaggggttattgtttagaaaattaattctttcaaaaataaaagtttttgcttttttaagaaatcactgagttttcacttggctaaataaataacttactttacaataatctgtaattccattttgtaatatcaagtgttctaaataaacctttgatatttgacctccttcacaaaataaaagtctaaattcagtcatttgacctcattattcttttttgatatttgatctcctgaagccaaaaagaaacatatttagcttctttggtacaattaaattatactggaagcaatgtcaaatttgaaatggtgtttaactttggactatatttatataaatgtggactatataattggagtatattcatataaattaaagagtacatgttctaaaatggtatgaggttcaattgactttgatatgtcagtatattttgtcagtagtacttatgattattatataaaatttttgttcatcacagaaataaccaaactttctcctcaattctgtctttaaccgtggctattctaaaacttcagccatccacaattgttttcctttgattctttatcaggtggcttataataatctatagaattttgaggggtactcttaaatacacaattgtgacaattttataaattgtgccatttatatacagagaaaaacttccaagactctcatggagacctgatgcatttatgatggttgttaatataatgtcaaacaggacaggacttaattgcatgaactgaactaacaggagcctgaaataaattttatggcttattctttaaagcatttgctaattacttacattttgtttttcagaatcaaaaaaaaaattctcttaagctattcattgtttttaacaattgagtatagtatattctagtgagaaaattcaaaaacacaatttcttcttctctacataatttctccaaaatttggaaactgtgagtattgttatatcaaaatattaattcacataggttcaatataaatctgctttcttccgtaacagggcacaattggagacaatgatcattttaccaagactttaacttgaatgacatattttcatatttactttataaaatgaatttaagctggatagctgataaaagccccttgggaaaactggcatgtaacctgttttgttcagggccctgagctgtagtaagtcaataattttactttctgacagacccaggaatcccaagttgtcttggaaaattgaaaaaagaagaagtaacccaattcatatagctgtctgaaggcacagatgaaacaatgtctgggcttgatgcttttaaagattctacccttagatttcttataaaaaatttccagcaaggtcaatttatgaattaaatagcctatgtacaaaaaatagaaaaaaagagagctaatatgttaaattactatttttgcctcatcttatacaaaaaaattaagcctaaaacttatattacaaataaatttgccctactatgattgtgtctctaataactttggggaattatagagagaaatactgtttcaaaataaacaacagtgcatctgttattagattctaaccttgtccacttgtttttcaatttatattattttctacaatttatattagtttctacaatttatattagtttctataaaaatttatatttgcagaagcctccaaaatatttttcctgatttaaaattaccagaagttaaactgtgctttcttatagctagacatcttatactctaaagaaaataaaatcaatgacatgatttggctctgtgtccccaccccaatctcatcttggattgtaataattcccacatgtcaagtggaaaaaggtgggaataattgaatcatggaggctgttttctccatgctgttctcctgttattctcacaagatctgatggttgtataaggggcctccctcttcccttggcacttctctcttgcagccatgtgaagaagcacgtgtttgctaccccttccatcatgattgtaaatttcttgtggctttctcagccacgcagaactgtaagacaattaaaccttttttctttataatttacccagcctcaggtatgtccttatagcagcatgaaaacggacaaatgtaagcaacttaattatatacaaaaactcttttatacctgcctactgtgaaaggaaaataagtcttgagaccgcaaaatcaccaagctaaatggaagagtcaaactggtgttacaggagatagaaagaaattattttggtagatagttaggatgacagaatttctgccgaaaacatttcttctaacaaaaatcagcttggcaattacttattttctattcacacagagttcaaagaaatcacttctaacaaaaagcagcctgaaagatcaggctgtaaaacatataagcaactctgccacagagagggtgtttctgggtgtaatcaccaaacttcacatacatacactgggccctagtaaaaacagtgggccttaatgagcacattcctttccttttctgggggcactataacatcagaaagctggaaacttgcacaagtttaggatgcctgcacttgcaaggaggtacctgggacctagcatggaaaatcctcttcccctttttagcactctgggagtggagccccagccttgggattcccaggtgtttcccttcagtgatcaggactgaacacacacaactcatcatgcagtttgtgctgagctgggttttccttgttggtattttaaaaggtgattcatggagaactacagatgttgagtgtgagtggacatgagtgagcaaaacagtgggtttgtgtggcagtttctgaccttggtgtctctgtgtttgcaggtgtccagtgtgaggtgcagctggtggagtctgggggaggcttggtacagcctagggggtccctgagactctcctgtgcagcctctggattcaccgtcagtagcaatgagatgagctggatccgccaggctccagggaaggggctggagtgggtctcatccattagtggtggtagcacatactacgcagactccaggaagggcagattcaccatctccagagacaattccaagaacacgctgtatcttcaaatgaacaacctgagagctgagggcacggccgtgtattactgtgccagatatacacagaggggaagtcattgtgcgcccagacacaaacctccctgcaggaacgctggggggaaatcagcggcagggggcgctcaggagccactgatcagagtcagtcccggaggcaggtgcagatggaggctgatttcctgtcaggatgtgggacttcatcttcttccaacagtttctctaatgaacctccctaattttagaattctgtggttcctaatgtcatctctacatattttcaaaagatcattttaatatgaggacataacctctcatgtaccaaatgcacattgatgcttacaaagatgaaaagttctcaaccattgtcaccaggatcgcagtcctgaggaagctcacgggtgtctgatgagtctcctccattcaggcccaggacagaaacctcagggagactcctggactagaacggcagggattctgatcacagccaatagagagcctgggccagggtcagtgtcctgtagaagctcacagggttcacatctgacccttctcctgaccctaaagccaatccgcatcagcactgatctggtgctccttttgctcccaatacatgttctttctttggagtgtttgttctcccttttttatttgcttttctttcttcctgaaaaagaaacacatggtctctatgctctacactccagggctcaaggcattttcttagaactcaggcaaggctcaggcttggctactccagcccacgtgggagaggctgatgggatttccttctctccccatattctcagggccctcctctgtgttgtgtgtagactcatctgggaatgcaattggccgttaatagtgaaggggataaactcatttgatcaaaatgggatgtggatgtggaattaaccctgttctatgcacactgtcagagtcatcttcttcagaagtagtgttagaaagagcttgtgaactttatcagaatcaaaatggatccacttgtgttaaaaccctaatgaatgaagctggggaaggccatgaaggagggttctaacacacatattcctgataagaagaactatcataaatagaccctgcacagccacaaccttttacacagaggccaccacagccttaaaagctttatttctccaagtaaatctgccccgcaactgcctattcaaccttacaccgctatctcaaaatagctgctgtcaccctcctcatttttccttaattctcttttttattattttttaaattatactttaagttctagggtacatgtgcacaaagtgcaggtttgttacatatgtatacatgtgccatgttggtttgctgcccccattaactcatcatttacattaggtatttctcctaatgctgtccatcccccttcccccaaccccactacaggccccggtgtgtgatgtttcccaccctgtgtccacatgttctccttaattctttatcttccttttcctacctgaatgtacccatacatattttaattgaaacgcacatcctagaaaaaatattattatactttagagtctctgtctgttattcaggttgacatgacaagctacagacggacatgccacttttctgtgagacatagaggatgacagtttttggagatgtctaggaatatccaatgtccataagatcagccatcaataagtgcagactggaggtcccagagagaggcgaagctgctgaatcatcgtggaatttcattttctccagttctgctctgatggaatcaggcccacccattttatcaatgacaatctacctaacctagagtcagctgatgacagtattaatatcatctattaagtaaagtcataactatatatatagtgagagagggagagagagagagacggagtctcgctctgtcacccagggtggagtgcaatgtcgtgatcttggctcactgcaacctctgtctccggagttcgagcagttctcctgtctcagcctcctcccagtatctgggaatacaggcacacaccaccatgtccggccaatttttgtatttttagtagagatggtgtttcaccacattggtcaggctggtctcaaactactgacctcaggtgacccacctgccttagcctcccaaagtgctgggattacaggggcaggccaccaagtccagctaatttttgtatttttagtagagaccaggtttcacgatattggtcaggctggtctcaaactcctgatctcagcctcccaaagtgctgggattaaagatgtgagctactgtgcccggccaacaccacctatattaatgttggattgaataactacaaagtctaccctaaccaagtgtaccatcaaacttaccattacccagaggaaagaatctttaacatgagatctatattcttaaatgttttaaggtgtaaaactgaccacagtacaatcacccaattatgattttgctaatgagttgtagaaactgcatgtatattttggatattaacactttttcagatgcacaccttataattatattctctcattctgtaggttgcaattttttccacactttgcggcatctttttgttgtgatgtagttctgcttgttcaattctgcttttattatctgtgactttaatttgaaatatagaaaatcatccttttttatatactttaaattttagagtacatgtgcacaacatgcaggtttgttacatatgtatacatgtgccatgttggtgtgctgcacccagtaacttgtcatttaacactaggtatatctcctaatgctatccctctcccctccccccaacccacaacaggccccggtgtgtgatgttccacttactgtgtccatgtgttctcattgttcaattcccacctatgagtgagaacatgcggtgtttggttttttgtccttgtgatagacttctgagaatgatgatttccagcttcatccatgtccctacaaagggcatgatctcatcattttttatggctgcatagtattccatggtgtatatgtgccacattttcctaatccagtctatcattgttggacatttgggttggttccaagtctttgctattgtgaatagtgccgcaataaacatacgtgtgcatgtgtctttacagcagcatgatttataatcctttgggtatatacccagtaatgggatggctgggtcaaatggtatttctagttctagatccctgaggaatcgccacactgccttccacaatagttgaactagtttacagtcccaccaacagtgtaaaactgttcctatttctccacatcctctccagcacctgttgtttcctgactttttaatgattgccattctaactggtgtgagatggtatctcattgttgttttgatttgcatttctctgatgaccagtgatgatgagcattttttcacgtgtcttttggctgcataaatgtcttcttttgagaagtgcctgttcatatccttcgcccactttttgatggggttgtttgcttttttcttgtaaatttgtttgagttcattgtagattctggacattagccctttgtcagatgagtagattgcaaaaattttgtcctattctgtaggttgcctgttcactctgatggtagtttcttttgctgtgcagaagctctttggttcaacatactcaaatcaataaacaaaatccagcatataaacagaaccaatgacaaaaatcatatgattatctcaatagatgcagaaaaggcctttgacaaaattcaacaaccttcatgctaaaaactctcaaaaaattaggtattgatgggacgtatcttaaaataataagagctatctatgacaaacccacagccaatatcatactgaatggacaaaaactggaagcattccctttgaaaactggcacaagaaagggttgccctctctcaccactcctattcaacatagtgttggaagttctggccagggcaatgagacagtagaaggaaataaagggtattcaattaggaaaagaagaagtcatattgtccctgtttgcagatgacatgattttatatctagaaaaccccattgtctcagcccaaaatctccttaagctgataggcaacttcagcatagtctcaggatacaaaatcaatgtgcaaaaatcacaagcattcttacacaccaatcacagacaaacagccaaatcatgagtgaactcccattcacaagtgcttcaaagagaataaaatacctaggaatccaacttacaagggatgtgaaggacctcttcaaggagaactacaaaccactgctcaatgaaataaaagaggataaaaacaaatggaagaatattccatgctcatgggtaggaagaatcaatatcgtgaaaatggccatactgcccaaggtaatttatagattcaatgccatccccatcaagctaccaatgactttcttcacagaattggaaaaacctactttaaagttcatatggaatcaaaaagagcccgtattgccaagtcaatcctaagccaaaagaacaaagctggaggcatcacgctacctgatttcaaactataccacaacgctacagtaaccaaaacagcatggtaccggtaccaaaacagagatatagaccaatgaaacagaacagagccctcagaaataatgccgcctatctacaaccatatgatctttgacaaacctgacaaaaacaataaatggggaaaggattccctatttaataaatggtgctgggaaaactggctagccatatgtagaaagctgaaactggatcccttccttacaccttatacaaaaattaattcaagatggattaaagacttacgtgttagacctaaaaccataaaaaccctagaagaaaacctaggcaataccattcaggacataggcatgggcaaggacttcatgtctaaaacacgaaaatcaagggcaacaaaagcccaaattgacaaatgcgatctaatatgaaattcttaatgagttctatagttataagtacattatttctccttattaaaactaatcttttttgctgaatgggtggaagatggtggcttccctccaaaagaaaacatagttggttctgtaaagagttcacccatttcttccactataggcctgccctggcataatacaagctcccaacttaagaacttatgattttccatccatgggagaagccatcttttccatctattataaaaacagaagacacttcattaatatcactcccaaaataggctatgtcatatccagtgaggtaggatggctgacagtggtgagaatccaagtaattggtcaagcactgctatgtgtgaagaaacaccacagcatactctacactgtcactcatgatatggaattgttgcctcctcagcaatgtaactgagcccttaatatgtggctgggatgacaaagcaatgccagcctgcagagtggaacctgttcttccttctgggattagccaaaggccggtggcactcatggctgaccctactttccttacaactggacgaagcgaagcaactggatatgaacttctatcccaggatgtaactgtccaaagtgccttctctttatgtcaactggaaaagtgtgaaagacagacactattctcataaacggatatcctagttattccacccactagccagctcttccccccaggtggcagtcatagatttagaattgcaagtagaggccctggctaagcataccaccagtccctttaacaacacctaccataccatcatcattcttactgaagaaacctcacagatttgacaagtgacactatgaagctatatgaccctaggtattgcaactacagccaaaggtaacacttgtgtattaatgaaccctgaatgttgcatatatatacaagattagtcccacaatataactcaagctatgcaagcattagatacccatatttctgctagagatggatgccctctctcaggaccctgcgacagcatggtttagttgacttcctaacacatggaagactttcatatatagtagagctggtatactcttcattgctatcttcagttgctgtggattttattggtaccttgcactttaagtgagaatgtaatactgaccttctcaaaaactcctaggtccttgcaccataatgctccaacaaacacctactgtaattccggagactccagaatatttccaactccagtttaatggattcccttccaatatatacaagctatgccctttctaagaagtagccagattgactatgacacacgttttccatagaaacaaaatggaatttgacagtggggaatgatatacaggcagcttaatttcaaaatgcattttaaacttattttttgaggttttaatattattttcatactccttgaaacctgaaatttcacacttacattctaattgagacttaataacaaataaccagaacacatgaattgcctgtaatctctataccttgtattgtaagccacatttcaagtgtaaccttacttgtcagcacagtatgtttaccataggcataattgcttgtcctgactgtccagaaggcagggtggtattaagtatgcggcctctggagctgggaagtctggctttgtatactgtctctgccactgctaactgaaggacaatgggccagttacttcctgtaccccagttttgtcatatgtaaagtagggttgttgtaagaatgaaattagttaatatttagtacctaacaactagtaggcattacgtggtagctattcgtattgctatcgtcagagaacacacaggagtccattgttatttttaccctccccctccaaacaaaatgtgtaagacactagacatggtagctctgtaacggggttcgtcatgtattaaactgtgtacccaaatgatatgtcaaagtcctgacaaccagcacttcagaacacgtccttatttggaaatatggtagctggagatgttattagtgaagatgaggtcttacttgagcagggcaggccctcaatgtgggaagatgggtgtctttctaagtacaaggaaatttggacacagagacagagacatacagtgtgccatatgacagcagaggcaaagatcagagtggtgcagcagtaaaccaatgcatgtccaggattaccagtcacctccacaagtgaggaaagggcaaggaagaagtctcctgagtctcagagggagtgcagcccagctcacacttgattttggacttctagtctctagaactgtgagacaatacagtcctgtcatttttaagccacccagtttgtagtatttcattttggcagccctacgatattcatacagagttcttcacccaaaaggaagcactctttctcacaaacagtcaaagtcctggatgacggacaacctggagattgcaaacctccaaggaatcaaaggaggttctataaagtctaggagccccatctttcaaaggctgctcctcaagtccacacacacactttggaaggagaatcctgctcttggacatgggatccttagtgagccaactgccaataatccaacatcatcatgaattaaagatctctgacatttcctcgtcaccaacgggaattctgtcaagtagtaagtaaaacccttcttcaggaatctccacaccaaacagttctgcatggcttgggacgcctcaggaaacttataatcatggcagaagaaaaaggggaagcaaggcagtcatacatggtggcagaagagagaggttaaacttttcagtctctcttgggtgtaaagatacaatcttgaggcaaacagcagaatcaattttcttatgccttgaaattctccctttcaccataaatattcccttcacattaatctaactttatgtttgcatcgaactatgtgcctttttggaagttccggaagctaatttgagacagatagacaaagtcgggagaccctgatgcagaattccagaggtgacttcaatgttgctagttaacaacccaggcattgcccagatgatgccagcccaagatccaggtggactgggatgccagagagctgccagaacaagacgcacagacctggttctcagcccaaatcttgcatgcctttcttaccaactttcccttttttaaacccctgcctttccttcaaaattgaagtggttgcttgggatgggaatgcgttcacttcccctttaccattatggttaatacaataatttttgtaccagatctctctcttgttaattggatcctgcaggtggcagattccggaccagagtgacgttagaaactgaatgcacatactgggtggttcacagacacagtgttctgtgaagtttatgggtggattcctggggaagcctgcaagcctgttagtgattagcagaaccgcatccagctactgggatctgcacgccaggtgccgtgagcccctcaccatgttccctggtcccagctgcccgcggatggttcagccttgacaacgggctcggtgttctgggtggtgggagagcaagggggccccttgggcagcgtgctacagggctgtgaatccaggggcccacccggtgttccctgtggagtcactgagggaatgaggggcttctcagggcacagagctgtaacgcctttgtgcagtggtggctgaatacagtgacactgggcgcgtggtgagaagcggggcaaggtcagttcactggaccctccgccctgagcctcagatgagtcgggggtccccagacaggcccggcctctgccctgcggcggacactggagcctttgctgtggccgccaccgaggagccttgacctcaaaggagggggaacctctctacccacctcggaaacctgaagggagcggcggtctctcccagacaggatctcgccggcctccgcgtctccaggcccaaccctgtaccacataaaggaagtccgcgctgagctaccgggacacagcgccgttgggtgggcgggcgcggcgcggcgggaagcaccggggcagctgccacagagatgcgcggggactgtcgggaagtgggcggtccgggaggcgcggggctgatgggacgtgggcggtccggggacgcgcgggggatggcgggacgtcggcgatcccgagatgccagggggcagctgggacgtgggcggtctggagaggcgcgggggcagctgagatgcaggtggtccgggacgcgcgggggctggcgggttgtgggaggtccagggatgcgagggggcagctgggacgtgggagttccggggacgcgtggggtcgccaggaagcggggtctaggacttagatccgccttctcttcaggccatgcagccccgaagctccgaatcctgggatgactcctgtccatgttggaagggaccctgccagtcctggcaaggttcaacggccttagggcaagaaatgttagtagagtcctggaagacgatgtggggaacgggtagcggccaccggatggtgatcgttcttctacaagaccttgacatggatggggagaaacagagaagaaccttccaagtttgtcccactggacatgcccaccacactttaccagccctttctagaaggcctgtgcgtaacacatgaaaaagctgctctcgacctttccctgaccttttaaaagaaaacatttgctgcatctaatccgcctagatgtaaggaggttcccaaatgtatgacagagtcagacaattacatgtcttgtaagttaccatgtgcttgtcttttgttttccgttttttttcgtttttttgttttttgtttttgagacggagtctcactctgtcgcccaggctggagtgcagtggcaggatcttggctcactgcaacctctgcttcctgagtttcaacaattgtgctgcctcagcctcccgagtagcttggattacaagtgtgcaccaccacgcctggctaatttttgtagtttttagtagagatggggttttgccacgttggccaggctggtcttgaactcctgacctcaggtgagccacccaccttggcctctcaaagtgctgggattacaggtgtgagccaccgtgcctggccgtaagttaccgtgtgctttttaaacaaatcatagcaaaggggtgtcttctggaaatgacattttgaaatggagttactagaccacccctggaagggacacagtaaccacacgtccacgttcgttcagtgggtgagaggacatggaggggagacctgggcaggaagggaagagggttccatgccaggctgctcatatttaaaagacattttcattgtagggacatggatgaaattggaaaccatcattctcagtaaactatcgcaagaacaaaaaaccaaacaccgcatattctcactcataggtgggaattgaacaatgagatgacatggacacaggaaggggaatatcacactctggggactgtggtggggtggggggaggggggagggatagcattgggagatatacctaatgctagacgatgcgttagtgggtgcagcacaccagcatggcacatgtatacatatgtaactaacctgcacaatgtgcacatgtaccctaaaacttaaagtataattaaaaaaaaaaaagaaaaataaaagacattttcatatcgttgtcattgttttcttgtgtgcattttattcctcgctattgtatacatcattggaaattctaagtattcttttgaaatatctagtctttctagatgttctgaagtgcctgatgtatgttaaaattacaggtggtaaaataataaattttgtaaatgtctttttgttaaaattcatatgcagtgttttattttattttgatgttggtggggggtggggaggatggccaaatccctgcttgatcaacacacattgcgtttgtgctctggttcaggggaggagagaggaggagaaagtgcagacttccaggcctctgtgcgcaccgggaggagagattaatgatcatctcttctgtctgtgtgtttgttttatttatctatggatatcctgtgtataaaggatgaacaagtcctatttataacatctaatcttttcaggtgttaagttgccagcgtatgacggaagtagcattattaaacgaatgcagcttgtacatattgtgttaaaattcataaaaagccagtcttctgaaaagaacccttgggccctccctccgcagcctccggcgccagctgcaggaagacctggccaggggaaggcgggcggcagaagctgctgctggctgtggggaaggcggtggagcccaggcctccacaggctccccacaggctccccacaggctcgcgcggctctggttgctgggctccgcacgggccgcgtgggggcgcctgctgggagcgaggaggcgccatcctggctcgcctgctccaggaggacgctctgggcctgcgcagatgcagttctccaggatgggcgcgggcgctgggggcggcgctccttgggctgctgcgcctccactgagccgcctgggtgtgaggacctcgcgccggcgcctccgggaaggacgcggagccgccgcggccgatcccagggctgcagctgctgcccgacgcccgcgggaaggcccttccgccaccgcccgggggttcgaacttggagcagctgctgccagctgaggcgccagcggcgtcgggagctcctcagagtcagtgttttgtgctggattcggcatgtcctctgaaaactcgggaatttgtcactgaaatggtgacaggaggtgagaagtttttttagacgttgccttcgctggcctggcgcggggctcaggcctggaatcccagcactttgggaggctgaggcgggcggatcgcttgagctccggaggtggagaagctgccttcgtggtaactgtggtcttaagttcagctgagaacgataaatggcttttccttgaattggctgcttttgtgatttctctcaggctcatcttttgtcagttaaaaatccagtggtaggtgtagcttagagacgggaaatttttggttttgttttggctacacgtaagtgttggaaattattttcttttacgttccagtgtgagcaaatccagaaggatgtcagattaaacaccgaatttaacaaattcagccgggcacggtggctcacgcctgtaatcccagcactttgagaggccgaggcgggtggatgatgaggtcaggagtttgagaacagcctgaccaacatagtgaaactccgtctctactaaaaatacaaaaattagccgggcgtggttgtgcgcgcctgtaatcccagctactcaggaggctgaggcaggagaatcgccgagattgcgccactgcactcagcctgggcgacagagcgagacttcgtctcaaaaaaacaaaaaaaaatcaatcattggaatactgttgttcattacaattaatgaacgtttgatagacgcataaacgaactaaattcacaagtacatataagtaaaataagccaaaaaaaaaaaactacatcccgtatgatgacacttttatacattctacagaatagaaactaaagtgatatgaaggttgggagttgaatggagaaaaggtgagcgaaaagagggaggacggaggagttgcaagagaacaagagaaaatgttgagggtaattgatctgttttctatcttaataatggttatggttacatcaataatttctaaattgtacattttgtgtgttaattataattttatattattcaagctattacaaataaatacctgtataaatttcttagggacggtttaagggagatggataaatcacataaaaagtcagatatttctgaatgtacaatgaataacccttagctctatctttattttttggtaattctaaaatgcagcagatttttttaatgtttttattacaagaagggtttcttcaaaccacaccaggtgtgtgtaactctgggctaaagttggttaagggagcagtgggatccggtggagaggagcacaggcctcgatcctggagcccattcttgtcacatgtgagctcctggacacatctcatagctccctcatgcttctgcgtttacattctcatctgtaaatggaggaccaatgggcatctgcctctaacaatgtattttcatgtgttaagatgatgtatgttaagtgtttactatagcacaatcttttaataagaaattacatttttttccaaatactatcattgtcttcaagccccaccacccaccagaaaacttaatatgctctgtgccctgccctgtcctcagacatccagcccaagagacttttatatagtaggagatatgcaaatagttccctccctctgctgatgatgaaaaccagcccagccgtgaccgtgcagctctgggagacgagctcaagtgccaggattcccaagtgttttcacttggtgatcagaacttaacacagaggaatcaccatgttgtttgggctgagctgggctttcctttttactattttaagaggtgatacatgaagaactacagatattgttcgtgagtggatattagagaaacagtggatatgtgtggcagtttctgaccaggatgtctctgtgtttgcaggtgtgcagtatgaggtgcagctggtagagtctgggggagacttggtacagctgtggtggggttgggggtgtcctgagactctcatgtgcagcctgcggattcatcttgagaagcaatgacatgaactgggcccaccgggcttcaagaaaggggctggaatgggtctcatacattagtgctagtggtggtagcctatactatgcagacactgaagggtagattcaccatctctagagacaatggcaagaacatgctgtacttgcaaatgaacagtctgagagatgaggactcggctgtgtgagagacatggtgaggggaaatcagtatgagcccagccagaaacctccctgcaggaaccctggggtggggggaaatcagctgcagggggcactcaggacccactgatcagaatcaaccccagaaggaggtgcacatggagattaggggctggattccttccaggatgtgggacttcaacttcttctgacagtttccccagggaaccgctctaagtttagaattctgtgtcatctctatgtatttaaaaaagatcattttaatgtgaggaactaactattctcacatgcacaaaatgcagattcacactcacagagatgaaaagtcctcaactgtggtcactaggatcagagtcctgaggaatctcaggcgttcctggtgagtcttctccaatcagacccaggacagacacctcagtgagattccatgactagaacaggctttatggattttaaaaaaaatagactgagccagggtcagtgtcatgtagaacctcacaggtttcacatctgacccttctcctgacactaaagtgtgcaaatcagcatcaatactgatctggtgctgcttttgctcccaatctgtgttctttcttgagttgtccctttttcatttgcttttcctgctccctgaaaaaagaaagatgttgtctctgtggtctaaattccagggctcaagcccttttcttggagctcaggtgggtctcaggttgtggctcctgcagccacgctggggaggctgatgggactttcttctctcccattgctcagggccctccactatattgtgtggagactcatctcagaatagatgtggccagtgggagctgaaggggacaagcttgtttggtcaaaatgagatacaaatatggaattcaccctgtgctgtacaaactgtcacagagtcactttctgaaacaatagtgttagaaagaacttgagaaagttgtcagaatcaaaattgggtcacttgtgttaaaactctgctgaatgaagctgggaaaggccgtgacggaatgttctcatgctcatatccctgataccaagaactatcgtaaatagactcttaaaaccacaatcttgcacaaaggtgcccacaaccttaaaagaattacttctctgagtaatcttcccagcagctctctgtgtaagattggactgatgccacccttgttattgattcttctatcccggagaagttgtctcaaaacagcttatgtaaccctcctcatttttctttaaacctttatctttctttacctgcctgagtgaacccatgcatgttcccattgcaatgtccatcttcaaataattatcattttactttagagtctctttttgtctgttattcagatttgacaagctgcagatggacacatcacgtttctgtaagacttaggggatgacagttttgaggcatggctggggaagtacaatgtccataagattgaccctcaataagtgcaggctgtaagtctcagagctgaagctgctgaatcaccatagaatttcatctttagttctgctctgatggaatcaggcccacctgtgtaatgaatgacactctacctaacctagagtcaactgatgacaggttaaatatctagacagcaaatttgcaacaccacttagattagtgtttgaataactacaaagtatagccgagccaagtatatcgtaaagcagactattatacatggagaatctttaacatgacatctacaattcttaattttttttacgtataaaactgatggttttacaatcaggctgtcatgattttgctaatgagttgtagaagttacatgtatgttttaaatattaacagttttttcagatgcctggtttgcaactatattctcccattctgtagatttggaattttttccatgctttgcaaaatctttatattttgatgtagttccagtccttcaattctgcttttgttgtctgtgcttttaatcttaaatttaggaaatcattgctaaccttttggtgggagagaattttacaattgcaggctatacatttaactgtttaacccatctagagttgattttttgtgtttattctaacctaatattcttaactatttgcaagtgaaaacccagtttgtttaacaccctctttaggggagagtatgatttagccgttgtgtagaaaatgttataaatcactttgccttcatattggttctcaacttgaaaatgagtttgccatcaatacgtgggtttatttctgagctctctatatgtatttatgccagtaccatcctgttttgattatgtttgtaattaattttgaagtctgagagtaaaatgcctccaagtttattcttgcccttttgcagatattagacaaaatattttaacatttcaccatgaagtatgataacagctatggcttttcataatgaattttattgtgtttaggttattttcttgtatttctattttgggtagagtttttatggtgaaaccttgaatttttttaatgttattttctgtctgagaagttaatgggaccttcttcgtatttaatttggcataccaaatgtattgatttgaggattttgaatcatctgtgcatctcaaaaataaatttgagttggtcatggtgtatgatccttctaaagtcctgtggaacttagttgactattatttggtgtgtggagggggctcatttatgtctactaggaatattggtctgtagtttacttttttgtgaccttgtctattactgaaaatacggtaatttgggccttatagaaagactggaaggttggcatctcaccaatttttgaaaaagttagagaatggttggcattacttctttaaatgttgagagtcctttttttacttaacatgtgacctatcatggagaatatttagtctttgcttcggaagcatacatattacactgctcttggttggaaggttctgtagatgtctattaggtcaatttgttcaatagtgttgttcaagtccactgtcttcttaagaattctcttaatgatgttctatccatcattgaaagtgaggtgctaaagtcttctcctaatttttattattttctatttatctctccatatctcttaaggtttgcttaatgcagttatatttatttttgtacaaatatgtaaaaaataaatgaaataataattgctaagtaattttaatggcaaaatcacataataagaaattatattttcccaaatgctgtcattgacactaagctcctccaggaatctcacatctgctctggacacggctctcctggtgtcctaccccagagcttgctatagaggaggagacatgcaaatagggccctcactgtcctgatgaaaaccagccttgcctgcgtctacgggagaagagccccagtccagaagtaccaggggtttccatttggtggtcaggtctctgaacacagaggactcactatggagtttgggctgagctgggttttccttgttgctaatgtaaaaggtgactcatggagaactagagatattgagtgtgagtggacacaagtgagagaaacagtggatatgtgtggcaggttctgaccagggtgtctgtgtgtgtttgcaggtgtccagtgtgaggtgcagctggtggagtctttgggaggcttgttatagcctgggggtccctgagactttcttttgcagcctctggattcacctttagtacctttattaggtactggatgagctgggtccatcaggctcctgggaaagggctggagtaggtctcatttatgagttgttgtgtaggtagcacaagctatgcagactctgtgaagggtcgattcaccctctccagagatgatgccaagaaatcactgtatctgcaaatgaacagcgtcagagccgaggataggtctgtgtattactgtggtggcattgtgtgcatcccttgtttaggtacatgcagagatgctgctttggtgtgttcaggggctcctgttttggggacaccaattttggagtttgcagtatccttgagtccagtacgttcatggtggcattgggtctggggtgtgcagtggcaatgagtccaggatacatgcagctgatgccgtatcttgtgaggacaagaacaactacaaaacgatcctattaataaataggcaaatgacttgaatacacatttttcaaaaaatacatacaaatgacatatagatatataaaatgttaaatatgagtaataatttttaaaattcaaatgtaatctacaataaattatcaccccatacctgttagaatagctatttttaaagaagatgaaagataaccagtattggggcagaagtggagtaaagggagcctatatatattgttactgaaaatgtcaattagtacagacattatggagaatactatggaggttcctcaaaaaataaaaatagaactaccatagtttccaacaagcccactactggctatgtatccacaggaagtgcaatcagtatgtcaaagagacatctgtgcccccacgttcattgcaggaatatttatgatagtaatgatgtgggaacatcctaaattaccataaatggatgaattactaaagaaaatgtagtatgtacccaatggagtaatgttcatcctaaaataagaagggaatcctgcatttgcaacagcaggcatgactctagaggaccatatgtgaagttccacaggcaggcgcagaagacgagtaattcgcgatttcactgtagtttgtttaaatggtagactcacagaagtagagtggagtgttggttaccaggggctggaggggtggactggaaaaggcgagattttggtcaaagggtgaaatgttccagttagacagaaggagaaagttacagtgttctaatgcacaagatggaaaatatggctaataatgcattatatatttcaaaatggctaaaaatgcaaatgttaaaaattttctcactaagaaatgatacagcctgggcgcggtggctcacacctgtaatcccggcactttgggaggctgaggcgggcgaatcacaaggtttggagttcaagaccagcctggccagatggcaaaaccccgtctccactaaaaacacaaaaaatagccaggtgtggtggcacgcggttgtaatgccagctactcgggaggctgatgcaggagaattgcttgaacccgggagacagaggttgcagtgagctgagatcatgccactgcactccagcctgggtgacagtgagactccaactcaaaaaaaaaaaaaaagaatgaaatgatagctgtgtgaggtgatggatatgtcaaatagcttgattaacaattccataatatatacatgtatcatagcatgtgtgaggtgacctgtatgaaggtgaagtgacctgggggctgtgtaagattacctgggggtatgtgtgaggtgaacacggcacatatgaggtgaccagagacacatgtgaggggacatgggagatatgtcgggtaagccagggggatttgtgaggtgacacagagcaagtgtgaggtgacgtggatgcatgtaaggtgatttggggcacatgtgaggtgacgtgggggatatgtgtgagctgacctcgggtgagtgtgaggtgatccaggatggatgtgaggtgacctgggggtgtgtgtgaggtgacttgggcacatgtcaggtgacatcggggattggtggtgatgtgggtgtgtgtgaggtgacctaaggaggtatgaggtcacctggggcatctgtggggacctggaaatgtgtgaggtgggtacaggtgaagtcacctagggcacatgtgaggtgacctgtggaatgtgtatggtgacctgggaccgtttgaggtgacatggggaatgcgtgaggtgacctggggcatgtgtgaggtgacaaagggcatgtgtgcagtgacctgggtgcatgtgaggtgacctggtgcatgtgttaggttacctgggggatgtgtgaggtgaacaggggcaggtgtgaagtgcctgaggaatgtgtgaggtgaactggtgcatgtatgtggtgacctgggggatttacgaggtgacctgcgggatgtgtgaggtgaccttgggtgagcgtgaggtgacctgacgtatgtatgaggtgaccagggtgtgtctgaggtgatgtggggtatatgtgcggtgacctggtggatgtgtgaggtgacctgcaggatgtgtaaggtgacactggggatgtgtgaggtgactcagggcacatgtgaggtgaaattggggatgcgtgaggtgattcagggcatatgtgaggtgaccttggggatgtgtgaggtcaccttgggtgagtgtgtggtcatctgggatatttcccaacttcgtaaggaaagcctgcaacaacacatggcattagaagcttcacactctagcaccattaatgcgtacatcctcaaggaactctaaatgttttgaggttagcttaaatgccatggagcggcaccttccccaggcacactcatatatgcatcctgggtctccctgccaagctatatctcctcaaatttacagtttatgtttgctctgtgacatcaactctgatatgttcaagtgtgtttttttttctttatttgtagttgttcaggcttgttgtttcactctcattactctgggctcagtcctctcctcaggtgtcccacttcagagctcgctgtgaaataggagacatgcaaatagggccccccctttcctgataaaaagcagcccagtcctgaccctgcagccctgggagagaagcaccagccctgggattctcaggtgtttccactttgtcatcagcaacaaacaaattaccatggaatttgggctgagctgggtttttcttgctgctattttaaaaggtgattcatgaagaactaaggatattgagtgagtggacatgagtgagagaaacagtggatttgtgtggcagtttctgaccagggtgtctctgtgtttgcaggtgtccagtgtgaggtgcagctggtggagtctgggggaggcttggtacagcctgggggatccctgagactctcctgtgcagcctctggattcaccttcagtaacagtgacatgaactgggtccatcaggctccaggaaaggggctggagtgggtatcgggtgttagttggaatggcagtaggacgcactatgcagactctgtgaagggccgattcatcatctccagagacaattccaggaacaccctgtatctgcaaacgaatagcctgagggccgaggacacggctgtgtattactgtgtgagaaacactgtgagaggtcggaagtgtgagcccagacacaaacctcctgcaggaacgttgggggaaatcagctgcagggggcgctcaggacccactcatcagagtcaaccccagagcaggtgcacatggaggctggggtttgtttcctgtcaggatttgggacttcctctgcttctgacagtttctctagggaaactctttaattttagatttctgtgcccaccaatgtcatctctacatttttttaatcattgtatatgaggactcgttctcacatgcacaatatgtatattgccacctatgggaatgaaaggtcctcaaccatggtcaccagcatcagagtcgtgaggaagctcaggggtgcctggtgagtcttctccagtcagactcaggacagtaacctcaaggggattcccttgtgagaactcacacattttcatgagaacagcaccaggagtcagttctaaaccattcatgaaagacccactccatgacccagtcacctcccaccaggtcaccccttcacaactggggattataatacaacatgagatttggggcaggacacaaatccaaaccatatcagatacacattgtgaaatacgcatggtggtcaggtaatttgtatttctatcacctcacagcgctaccattttattattttttttaatttactgcatgagtgagtgtctgatgagaacacctaagatctaccctttcagcaacaatcatttttacaatacagtattaactataggaccattgctgtacgttagatctccagaactcatccaacctgcacaactgaaactctgtacaatttaacacacatcacccaatttccctcacctcccaggtcctgggacccactattctactctctgctttcaagagcttgaatattttagatcccacatgtaaatgagatcatgcagcatttgtctttctgcatctggcttattcaactcagcatcatgtcctccaggcccatccgtgttgttgcaaatgtcagaatttccctcttttcaaagccaaacaaaatacagatgtatgtatacacattttctttatacattcatccatttacagtcattaaattattttacaaatctacactattattaataatcttgcaatgaacatgtctttggcaaagtaattttatttcctttgcatatataacaagaagtgggatcaccagattatatgatagctttatttttaacttatcaagtaaccaatcctaccacaggatatttccctttcccccacattcttgccaacatttgtcatctgttacatttctgataatagccatattaactagtgtgagttgatattgcattgtgcttctcatttgaattcctctgataattaggaatgttgagaactttttcgttttctgtttgccatgcatgtatcttctgaaaaaaattatccaggtttttgcccttttttatcagttcatttgttatttgctgttgaggtgtatgggttatttatacatttggacagaacttcttgtcagatccataattgcacatagtttttcctgtgctttgttattaaattcaaagaaatcagttccgaattaatggcaggaattttttttgctccatgtcatttatgagtttatggcttcaggtattatgtccatttttagttgattttttttttttttgggagacggagtcttgctctgtagcccaggctggagtgcagtggcgcgatctcggctcactgcaagctccgcctcccgagttcacgccattctcctgcctcagcctccgagtagctgggactacaggcgctggccaccgcgcctagctaatttttttttgtatttttagtagagacggggtttcactgtggtctccatctcctgacctcgtgatccgcccgcctcggcctcccaaagtgctgggattacaggcgtgagccaccgcgcgcggcctattagttgatttttttatatggagttagagaaggcctaattttatttcttttgcatatgaatgccagttttacaccattattgaaaagactgtcctttctctactgtgtgctcttggcacacaaaatcaggagagacataatgacaaaaaaaatatgagatcaatagtcctgatgaacatagacctgaaagtcctcaacaaaataccatcaaattgaatccagaagcactttaaaatgtgatacatcatggtcaggtgggctttacccctgggatgcaaggctcgttcaatatccacagtaactctgattcacaatgtaaacagaataaaagcaaaaagcatatgattatgtcaatagatgctgagaaagcttccgataggatctaacatctactcatgataaaaaccctcaacagactagacatcaaagaaacatacttcagaataagagccatctacaacaaacccacagttaacatcatactaaatgagccaattaaaacacttatctttataaatgacccagtctcgggtgtttctttacagtgcgagaatggactaagacagcatccaaataggaaaggaagtcaatccgtccatcttcactgatgatataattctatatctagaaaatcctaaaaactctgccaaaataattctagaataaacaactttagtaaagtgtcaggatacaaaatcaatggacaaaaattaccagcatttctataagccaaccacatccgagctgagagtataatcaagaacacaatcctattcgacttacagtatccacaaagaaaatgaaatgcccgggaatacagataacaaagtgaaagatccctacaaggagaactatgaaacacagcatacataaatcataaatgatacaaataaatgggaaaacatttcatgctcatggattggaagaatcaatattgtaaacattgtcataatgcccaaaggaattcagattcaatgctatttacataaaactatcatcatcattcttcacagaatcagaaaaaaatctattctaaaatttatatggaaccaaaaaagaccctgaatatccaaagcaatcctaaggaaaaagaataatgccagaggcatcatgatactgaccttaaactacaccataacgtcttgctaacaaaaacagcctgtactggtacgaaagcagacctgcaggaaaaaaaatagatcaaaatagaagacagaaataaagttgcacacctgcaaccctttgatctttgacaaagctgacaaaaacaagcaatggaaaaaaaaaactctgtgttcagtaaatggttctgggataactggattctggcaggtatgcaaaatgcaagagtgaaggagcctgtgcagcttctacctagatttcagatgtgtagagagccctgcatgcccaggaagaagcctgctgcaggagtggatccaccacagaaagcctctactagagcagtgccaaagatggggaaagatggagttggagcccccattcagagtccccactagggcacttcatagtaaagttgtgggaatgtggccacaaccctcaagaccccagaatggtagagctacgggcagcttgcaccctcagcctagaaaagcttccagcacttgactctcacttgtgaaggcagccccgtggtctgtgcctagcaaacctatagggattggctgcctgaggttttggggacccaatccttgttccagtgtgccctggttgaagtacataaagtcaagagagattattttgtagcgttaggatttaatatctgcagtgctgggttttatatgtgtgtggggcctgttggttgttcctttggccaatttatccctttgggattggaattatttacccaatgcctgcatcatcattgcaccttggaagtaaacaacttttattttttaaatttgcaagctcacagctggagggacattgccttaagactcagatgagactttgaaaatttgagttggacgttgatgaagttaagattttgggcactattgaaaaaaggtgattatattttgcaatgtaagaagaatatgagaactttgggtccgagagtgcaatgatataatttaggggttttcccctccaaatatcatggtgaaatgtgacccacaatgttggaggtggggccaactgggtggtttgggtcatggggaaagatttttcaggactggcttggcatccaccccatggtaattagtgaattcttgctgtattagctactgtgagatctgattgttcaaaagagtcttgcaatcctgctaccctctcatgtaacccctcctcacaatatgacacagccttctccccctttgccttccaccatgactgtaagcttcctgaggccctcacaagaagcagatgctggtgccatgcttctcacacaacctgcagatctgtaagccaaataagcctcttgtctttgtaaatcacttggcctcaggtattaatttatagcagtgtaaaatagactaatacactgcccaaagcaatatacagagtccatgcaatttctatcaagtaactaattaattatgtatttttaaaaatcctaaaatttatatagaaccgaaaaacactctgaatagcaaaagcagtcctaaccaaaacgaacaaagctggaagtaccacattccctgacttcaaattacacagcacaaagataataagaaaggcagcatggtagtggtagaaaaaaaatcaagagcccagatatatagccaaatatctacaaccaacagttctttgacaaaactgacaaaaatatacactggagaaacaaccctctattcaataagtagtgctgggagaattagatagccttatgtagaagaataaaatgagacttctgtatcatcatagacacaaattaactgtgaatatggattcaatgtttataaactcataaaaatacttgaaaaaatctaaaaataatcctctggacattggcctaagcaaataaaatatgactaagacttcaaaagcaaatgcaatgaaaacaaaattagacaaacaggattaattgaaccaaagatcatctacacatcaaaagaaagaaccaatatggtgaacagacaacctgtgaatggtaaaaaaaaaaaatgtgcagtctattcatcaaatatatagaatctacaagtaactcaaataagtcaactagaaataacaacttcataaaagagtgagcaaaaacgagatatttctcaaaagaagacatacaagtgttcaacagaaataaaacatgctcagcatcacaaatcatctgataaatgtaaattacagacaacatgatatagcatcttccaccagtcagaatggctattaaaaataaaacagatgtttgcagagaagcataggaaaaataatgctttttatatgcttgatgagaatacaaattggtacaacctctatgaaaaacaatacagaaatttctcaaagaactaaaattagaattaccatttgacccagtaacccctcctggtgggtatgtttctcccaaaaggaaacttctatataagaaaaagtcacctgcattcctatttttattgcaacactattttcaatagaaaagtcaagtaatctctctaagtgtcaatcagtggatgattaaataaaatatgatagatgtaaatcatggaatactatgcagccataaaaaatgaaattgtgtctttcacagcaacatgaatagagttgaaggacatttcctaaataaaataactcaaattctcttttataattggaaagcaaacaatgggtacacatgtacatagagaaaaacaatagacactgggtactgcaaaagaaggcaaggtgagaggaaagtgagggttaaaaaatcagctattggctccaatgttcactatggggtaacagttacatcagaagcacaaacctcacctttatgaaatatattcatgttacaactctgcacatgtgcaccctgattctatgaaaataaaaacagaaaacatgaacagaattgttagactgctagctagattgaccaacaaacaagaaaaatgcaaaagtagcaattctttgttttgtaaccctttctcattttctggtaccataagaaattgtagactatcgtcctatattcttttctgaagtgctaccattagccatttctcaaagaaattctggttccttttttcttttattttctttcattttttttagacagagtctgcaacgtccacctcccaagttcaagcgattctcctgtctcagcctcccaagtagctgggattacagacgtgcaacaccacacctggctaatttttgtatttttagtagagatgaggttttgctatattggccaggctggtcttgaactcctgacctcaaatgatctgcccacctcagtctcctaaagtgttggaattatgggtgtgagccactgcacccagccgctggttccttttacagaagaatagtattaaaaactcatatcttgattcttgatgtactttttgttaatttcttgtagaacatctcaagtaatcaatacaggaagtatttgttgtgtattaacccatatatatatatacccacatctaaacggtttttatttatgttcctatattatgctaaacttgcaaatccactgagataccctaagttaataccacatgaatgattttcaccttccttctatgcctttccctaacctagcactccaaccgtggggaaccccctcccaccacacaccatccattccctttgtagtccatttccaggattcctgtagagtggaacccgattgtgtaagttgtgctcttttgtggaacatcatcaagtggagtccagtgctgacgtgcagtttcttttttctttaatcttatggactacactatttctgaacctacttagtacctcttttgatttcatacattagtataatggcataagatattttctatatagtctgcattccatcctggaattcctaatcacctatttttttaaaatttcttgtggattaagattgtattagtcagtgtcccctagagggacagaacaagtaagatacacatacacacacacacacacacggagtttattaaggagtattaactcacactatcacaaggtccacaataagccatttgcaagctgaggagcaaacaagccagtccaagtcccaaagctgaagaacttggaatccgatgtttgagatgaggaagcatccagcaggggagaaagatgtaggctggaaggcgaagccagtctaatcttttcatgttcttctgtttactttttattctggccacacttgcagctgattagattgtgccacccagattaagggtgtatctgcctttttcagcccactggctcaaaggttaatctccttcggcgacaccgacacagacacacccgggatcaatactctgcatccttcagtgagatcaagttggcactcagtatttagcattacaagtccaccctttgtcaacttgaacccatacacatctcctgagattatacataatcttcaaataaagacaagaataaagtcataattatgcctaataatacaattattcttcttacaactggaaacacaccaatccccaatccaaatggtactacatatgctccactccctcaaggacacagccaggatcatctgatgacttggtgtctagatggcttcagcacttttaattttacctccaatgttagactccactttatcaatgcagatgtagcagaatattttaagacattgatatgctgaaaaattcaacagttcataaaagttgccttcccaccacagccagtggttactactgaataaggacctgccatcctctagggagaagctataatggatggggtgcactgttggtggttatggaaatcgatccatcgtggcaaatggcagcatctttctttgataacattatattctattgtgcatatataccacattgtctttattcatttgtctatctactgacagattttttccatatgtttgctgttattaatagtgtttcaataaacataggatgcagatatcttcacaaggtggtaatttcatctcctttggatatactcccagaaacaggattcctggtcatacaatatttctggctttaattcatttaggagcctttatactgctttccataattgtgaaaatgtagaatggtatagccattatgaaaaacagtttcagttttgaggtatgatctgtaaacaaataatgtttgttatggctctcaatgagagtttctactaaatatgatggaaggtcaggaaggtctctcaccttaaagcagggatggattatgcctcttatttcctaaaagcaaaagattggaagcatgcatgatggaggtggttggcaggtttcaggatgatctcataagaggagaatctgttggataaaactgttgggttttcagtcatagacacacctacactcaatatgaaatgatgaaatcaagtgaggatctagaatgtgttcgcttgaagcaacagcatattctcaaaggcacctattgctccatcacaagggtgatgaacttttgaaaccagtaaagtgtgagagcacagtaagtgataaagttatcacatttacatgaagtttgtttaatgtgccaagggctcgcacagattaatcataaataaacacaatgtattttagcatacatagatgtctagagaagaatcttcttagagaaacttcttcaggttacagaaatctgtgtaagttgtagatctaatggagaagtgtctatgaatactggtctgtttttgaagtatggaaagatgatctcttttggagtaggcttgcgattgtgttgatttcttaattgtttcttgagttgtaacaaaagaaccaaaaaaatgactaaccggagtttcatggctgtgttgataaaaatttttcataagctttctgtcaattatttgagaccagatttcctgatttttttctccaatagatacatgttcacaagatctcaggaaaccacctctcaggtgctttagtttaaaagactagcttcctagaaaaagaagattctgtctaaccatgacaagttggtttcatctgcaaaccatcaagtttgagacctcattgtcaagaatcataaaaattttaactccaatgtactgaaaatcataaatctcgaatttaatgttgataggcattgacaaaatggttcattcttggatgcgtcctatgttgctggctcaacatatcagttaattgagaatcctcacttagctccctctgtttgtagcactgagttgattgtcaatcttcagagtcatccgttgaaggagagtcctgaggttcatgggattcttgtagacactcaggggaacaaaagaaagaaacagaattgagggctgccagccatttccacatcactaggaataattaccatctaagtataaaggtctgcatcattcagaacaccctgcatgacaggctgatgcaaaaaatccaaccctacagaggctccacagcaacctttacagttctttccgggaagaaataatctccaagttaagtgagtcagtaaagctgctctgagctacagtaaaaattggattgggcccgatttgtctgagttcagtgtaattattatactcagctgctgccccaatatagactgaggatggataatttaaatgagcctggctatgtggtttgttatatatctgaactaaataaacataaagggcctgtctggactagcgtgagggtgagagatcctgggagccccagccccccatactcttatctcccttcctccaggaacctctaggttctcagggtgagaatccacaagatccattcatggctctattaccaggagaccaaaatctctgaccttgttcatacagacaaacaggcgaaggacatttttagatccttatctatgtggcgaaaggcaatctatccccattacaagccttaccagcaaccttcctttgtcatgaaaatgggtaaaattagccaataggattacatttaagaaaattttcctgtgatgttccagccagaaaacagcaaaaatcagcttcacacctggagacttcttgcatcggtcacagcccagagaaagaagatcaccatagcattaaaatgcaactgtaagaacatgtaatgcttccatgttccacgcattacgtctcaccagtttagtcaatatggattaaatatgagagtgtggcaattcgcaaactctatctgaggaggaaaatcggataaaaaatgttatgaaaaataaagcaatttgaagcctctgacttcagcaacttcaccactaatgaaatgatgtaaccctcattggcctcaaatttagttttcacggggcatctgcagggttccaaagtgagaccaggtgaattcaatgtgcatgcacttcccaagtgtccacttgtattctgtttctttacttctgtttacagaaagtagacacatattcagtcttagtaccagtgtagggagcgctttccatgagatggataccagaaaaaaatggcaaacatgggatccgttaatataaaaattagccacgatgtatatatatatatgtgtgtgtgtgtgtgtgtgtgtgtgtacacacgcgcgcgcatgtgtgagttgaatagcagagttggagtgggtttctatccacatgtacctgcacctgcaggtattctcaggtgccataatcaactgtaggaccctaaaggaaataagagtctcccctcaacccctgaagagtgtttgggttcaccgtgtgtccaatgattctgtgcctcttgagctccaggaaagggctccctggtgatgcatgagatcttttcttggagtctctctgcagagttcactgggtttcctaaaggcaattcactatttcaaaagatggtgtgaggagcatgtggtgtccctaaaggagaattctgagccagggcacaaccactttatactgagctggatacactggtaggaatatactctgtcagctcagatagaaacctccctgcatggttggggctgggctgcagggggcgctccggatacacccagcacaggctcccgccccagagcaggtgcacaggaggctggggagaggttcctcccagggcctgggacttcctttaaaaatatctaaaataagtatttcacaaagactgctgaagtttgtataaatatctattcaattgtgagcatttatcaaactggatgttgtaatgagaaccacttttacaatggggatttcaaactctgctggaggtcaggaagagatcctttcttataaataaatgcaatttttggataaacacagtcattccctaaataacgcattcacatattatggtctagaaatgatgcaagttgaccctgagacagtcaaatgtggtttcaaagtgaggtgctgtccttgaggagcttgttctccagtgggggaagctctgtcaacacagagttcagggatgtgtaggggacacatggcctctaacaggattacggcttgaaccctcagcttctacagttgtgtcacccatgtgtctgtttctcatactgggtcaggaattgggctattaaatagcatccttcatgaatatgcaattaactgaggtgactatagtatctccgttccctgagagcctcacccaacaaccacacccctcctctggagaagcccctagatcacagctcctcaccatggactggacctgaaggatcctcttcttgatggcagcagcaacaggtaaggggctccccagtctcagggctgaggaagaaaccaggccagtcatgtgagacttcacccactcttgtgtccactccacaggtgcccactccctgcagctggtgcagtctgggcctgaggtgaagaagcctggggcctcagtgaaggtctcctataagtcttctggttacaccttcaccatctatggtatgaattgggtatgatagacccctggacagggctttgagtggatgtgatggatcatcacctacactgggaacccaacgtatacccacggcttcacaggatggtttgtcttctccatggacacgtctgtcagcacggcgtgtcttcagatcagcagcctaaaggctgaggacacggccgagtattactgtgcgaagtacacagtgtggaaacccacatcccgagagtttcagaaagcctgaggaaggaggcagctgtgctgagctgaggcagtggtacagcagttttctgaacttccatagtatctcattttgcattgagttccgctttaatattagccaagaatatgggatagacgggtgctcctaagagatccttaacttgcccattttgatgggttttcccaaagacgtgagaagccacttttttcgcaaagcatcccaaagccatgccctgctccagaaacacgtgtatccatttcctggtctttgattaactgacaaactctcatcagcgcacctgggctaatttcacatcaggtagaaatatgtgctttaaagcaaggctaacgttgtaatagcaattcctgcttaataaccttcagcattgttgttgtgtgctccatcaactaattacgttagttcaaggttctcaatgggagtttctaataaatataagggatgtatagaagttcccctaattaaaacaattgtgaagacaacctcagtgttcaaccatatttcaacccttcaccacaaaggaactttcatctctcctggaagttgggttcattttcaaattagtttttttattttaatatctcaagattattgtatgtgactattttagcagaaagtgaattatgggaacttgaactaaccaactgaaaatacattcagaactaattaaacaagatgccagaatgtgattggctccaggcattttaaattcaacaggttatgtaaccaggctttaaatttgcacatcttcgtgttaccttcatgacacagtcaactcccattatgtaagaaatggtgagtgcattcccaagggtcttgcacagttataaaaatagacttgatgaggtgaggagttgtttaaattcccctctgaagaagcagcatcaacccaacaaaccactctcttccctctgtgactagagctctgtcacaggccacatggacctaaatccttgatggagattacaggactacgtaaattggactgatcgtttttatgctgttaaattaataggtgagtctgcactccagcctgggcaacagaataatcttgtctgtaaaatacaaaagaaagataaattaatagatactgactttgacatttcggataataatattttcataaaccgaatttaattatacccacattgttacctacaccttcactgaaaagttcctagttatgttgagttccatcaacactccacatgttcaaatctggacatccaagagagtctagagaataaaacgcaatgagggcagtgaaacttgcgtatattcagcacctcttaactcaggaggactcaatacaccctggaacactctgcttttctgaatggctcacaatgactccagctcactctccaacctcctcaaacatctggcctctgtttgccctaagttcacgctctgctcttagtctatgttctgaagtctttgtagaggtgaaaatgagctgtcagatggatcttccttctcactgcaacatggaatttgctatttcacttaatgaccactctttccacaatggttgatttcttttggcctgttcattactggtgattttcaagggaatctcagttgaatctttactgttttgcattttgtctccatgacaatgttgggaagtttttcttctagcagcataacatgatctagtgacctgacacatttgcagcaaacaatacctacaaattcagaagctctttggttttctttccacgaaatataattcttgctcttctgtgtatgagcacatcctagcatccctgtacacacccacgtagatgtctacacgccgatgaaatattccctgtaaataaaaaaagtatctcagtttctctcaatgttcataattctcctgagggtgaggaaggtacttctgggtctgctcaaacaaatggcccagagaccacctggtaggtaggtaaggagctcacctcgctctggatattgagtctgtctctttccctctgtcgtctcatagaaggccagcccacttgttcagctcctaagaagagagcccaggtttatccagattatacaacacaaccagcttctgatgactctcctgttacaacatccatggagatattttgtgtattatataattcaccaaactaatgtgaaatgcccaagttgcaatactgcacaccctagggtatgttcttgcaattcagcggaggagaaattctttcagagacagatggatctgaattggtaaatatgtgggtacgaattctgggcttgagtgtcattgtccagccatgtttcacaggtgtgacctgtcagggaagaaccagagttccttgttctctcagagggtagagctcacagaggtcctctctggttcccaggaaaggtaatttcactaatcttggtgatgagactatcctccagtgctgatgtactatagagttttcatctgaagctgtcactgctatccccaatgtacatcttttcacacagaaatgtttagaggtcaggccatattctcagggttacacattgagaaggatggagatatattctactaccttctcctgagatctcacacacaatctcaaatttcaaaaggtctcagaagggcagctctcaggtactatttaaaaataacccacttcctgggacaggtagcatccttctaaccatgatggatgttctgaactacagtacacattgcatggatccaggtttgtctcaattcactgtgattattacactcagcagctgtttcaatatgtctgaaggggtaaatgacaatttaggtgacctgggtgtatggttggtgttatatgaatctttaaatgtagaacagtattaactgtattccaaaatctgtctttgatccatgatcacacttgtctcccagaccagctccttcagcacatttcctacctggaagaagaggactctgggtttggtgaggggaggccacaggaagagaactgagttctcagagggcacagccagcatacacctcccagggtgagcccaaaagactggggcctccctcatccctttttacctatccatacaaaggcaccacccacatgcaaatcctcacttaggcacccacaggaaatgactacacatttccttaaattcagggtccagctcacatgggaagtgctttctgagagtcatggacctcctgcacaagaacatgaaacacctgtggttcttcctcctcctggtggcagctcccagatgtgagtgtctcaggaatgcggatatgaagatatgagatgctgcctctgatcccagggctcactgtgggtttctctgttcacaggggtcctgtcccaggtgcagctacagcagtggggcgcaggactgttgaagccttcggagaccctgtccctcacctgcgctgtctatggtgggtccttcagtggttactactggagctggatccgccagcccccagggaaggggctggagtggattggggaaatcaatcatagtggaagcaccaactacaacccgtccctcaagagtcgagtcaccatatcagtagacacgtccaagaaccagttctccctgaagctgagctctgtgaccgccgcggacacggctgtgtattactgtgcgagaggcacagtgaggggaggtgagtgtgagcccagacaaaaacctccctgcaggtaggcagagggggcgggcgcaggtactgctcaagaccagcaggtggcgcgcggcgcccacagatcccgaggccgggtccggagcaggtgcaaggagggcggggcttcctcaacagctcagtggtctgtctcctcgccagcacctcagatgtccccaggactctctttctttattatctgtggttctgcttcctcacatccttgtggcagggaagaaaggaggaagacaatttttctgtttactgttgaggtttcaccaattactagaaactttcctacaagttcctgcatgactcattttgccatatatggattctcaccatctcttgatttgtttcatcaatcgaattgtgccctatttgaaattaacttactgaaaccttaaatccaatggatctatactggaattttaatgatgtaattgaggttaaatgtggtcaaagtgtgagaccctaatgcaataaaccgttgtctttataagaagaggaagagacaccagagacctctcacttttcacgtgcacacagagaagaggccatgtggagacgtagtgcactagaaggtggccctgtgcaagccaggaagaagccatactaagaaccaattttgccagctccttgatcttcgacattcagactgtagaattgtaagaaaatcaatatttgttgtttaagccacccaatcctgttgtcttcttacgaagacccaaactgactaataccacctaactctgttagctctgtctcctggagggagaagcagccccctgaggctgggcactgcatctctcagatttccacgtgaagtaggcaaaaatagtagttctcatataaaaatgtgtcatggctctgttggccatttttgagcatggtctctgaaaccagccctggtgtgtgtgtgtaacaaatgtcccttatcttttatttggacataacaaatagacgataggtaccagctggatggagattggccactgatcatcttctgttctccttagtatgtcacagaaaaccacaccaacatcaccagcatcactgtttttcttctaccacctcaaacggactacagaaatgatccctgcagtatggtctatttcttcggctttcgaaatttgcactgaatctcttcctaaatggggagctacatggggtctgagttttgttcctttcttcccagtcttccccaagtaccaaggacagaatagacttaaaatttggccatcaatgcccccaaacaccacatcactttctaaaatccacatcctgcatccatccttctctggacacccctcatcaggctacccaggaatggccagaatctggtatcagcttatgggctgaggccacgagttatacacatgtgtgatttcagtcacacacactctacttcaggaccacacctgtgttctgaggagctcaggcacctgctgatctcagtaattctctaataaatcacacacctcttattaataaaggtccagatggccccatcagctgcagagcagtggagtaaagctcatgggtgggtccatcaggcagaagtcagacaatggaagggatggctggtcacttccattttcactgatgttcgcaatgaattttaatggaataaaacaatattaactacaaagagacagaaaagaagactggctcgtcaagatatttaaggacaaggaactttatttggggggaaagtgaaagacacttctaaatggaaatccctaaagcacatacagcagctgacagagtggccactgtgcacatgagggctgaggagatggatggtagagtccattcctgcaacatgtctctgggtgtgtgatggttagactcctcatgcatatgaatataagagctggactcatggagaaaaaaagggccatatcccataggaaaggaagaaaaaaaaacagatgggcacccctggagagagctcattagatttggtgtgtttaagatgaaaatttcttccaaaaattgtaatgttctaagctaaatatgaatctcttcaataaactgagaataggagaatggagctaggacttgagagaggaaacaaatcttgagagagcagaaagcaaatccacaaaaactgtcacatgacagaggtcagaatggagctgatgtagctacttcactattctgcagacttattgaccatgtggagaaggggcttgaacaaatggagacgttctccaaccttctgaatcagcctccttcttatgcatgagtagaaatcatagttctgggggtgaccttcccaattttcctgtccatacctcttcccccaggggtagagtgtcttcccaaccacaatggtttctcaccagtgttctcagcttctcctccattgtacttaccctgcagattaagaatttcttctagatggagttctttgggaattttctgttttctttagtttctgttgactccaccacacccccataggatacaggttttattggatttcccctggaaatagtgggggtggatccaggcgttcaacagtcctcgctgttcttcccttcctgtcagcaccacaggacagcagataagggagttgactgtggatttttcaaattcctgggaaaagcctgcaaggactagtagattcacactctaataccattagcacatgtatccaaaaagaaacctcactaaatatttccaggttagcctgttcctctctcagtgccatccagtggcacctgccctgggttcacgaacatgtgggccccagtcctctctgctggcatctctctcctcacatttcagtcttctcgttagctctgtgaaagcagctcagatatgttaaaaggttttcttcttcatttattcagtttttcaggtttactgttaaggaggtcagaataagatcatagtttcctcatttttcacatttgcacgctgagtagccactttctatataaaagccagaaactaagggaacaaatcaaatatccatatccactacaggtgaacgttaaaaaatttgacatatgattatggactaaagtacaatgcagaattagaatcaaggcatcctcattctcataaaagcatgtctacattctcaaataactctgctgagtgaaagtagctgaagaattaagagtgcacttcataaacttctaattgtataaactgcagaaggtacaactattctaaagtaacagagcagatttgaaatttgggagaaatgggtgttgaaagtaattgggtggtgagatgaaattacagagaagtgacagaaagatttaggggttaacttaattgtacacaacctgattaaagtttgcacacatacgttaccattttccaaatggtgcagtgtagatttgaattaattattaattgtacttaaagcagtaacaaagaaacaaatgaatatgttggttgaggaggagcaaaaaatagatgggtatgaacactcaaaacatctcagactcttgaaagtacacatgcttgaacactggttttctctgtatactttaggtaaagagcagaatacattaaaagaaaacagagatgtcctggcgggggtggaatcctgcaaacctcactaggcgtgtcccacactgccctggagttgtctcaggggagcagtctcctctagtggtcagagacacaggcatggataatggggctaatactgtccagctgtgtgaccttgaacacattgtataaacactgttccatatgtaatttatcttccttaaaatgtaacattgacacttgcattaaatgtattctacaaatatgtcaaaaagaagatgacgactgctaaatgattatcaaggcacaatcatataatataatgatattttcctgagtgataagatgactaccaatctcccccagggcactttgtttgctctgagccctgcgcctcctcaggattcccatcccagagcttgctatacagtaggagacatgcaaataggtttctccctctgctgatgaaaaccagcccagtcctgaccccacagctctgggagagaagcgccagccctgggattcccaggggtttctatttggtgatcaggactaaagacagaggacccaccatggagcttgggctgagctgggttttcactgttgctgttttaaaaggtgaactagagagattgagcgtgagtggatacccttgagagaaatggtggattatgtctgggagtttctgaccaggatgtctacgagtttgcaggtgtctagtgagaggtacagctcgtggagtccggagaggacccaagacaacctgggggatccttgagactctcctgtgcagactctggattaaccttcagtagctactgaatgagctcggtttcccaggctccagggaaggggctggagtgagtagtagatatacagtgtgatggaagtcagatatgttatgcccaatctgtgaagagcaaattcaccatctccaaagaaaatgccaagaactcactgtatttgcaaatgaacagtctgagagcagagggcacagctgtgtgttactgtatgtgaggcaccaggtaagaggacatcagtgtgaacacagacacagtttcctgcaatgacaagggaggaggctgggctaaaaggggcactcaggacccactgaaaacgggcagctctagggcaggtacagatggttatcatgggctgctttccttcagggtctgtggcctcctctgcatctaccagttcccctcggagcctctggacatttatgtttctgtggccacccctgacatctctggattagaaaagtttattataggaagaggaaacattctcatttgtcccaaagcagatgtaagtaatggaagcaaaaaatgcacaggaggccaggcggggctgtagatactgtcaccccagaatgtcaatctcaccactagtactggagagggaagggagtttgatggaccttccctaacaaccctgtggtccaagataagtccaggaagaccattggtgcctcccagagcacagttgtccatcagggatgtccaatgcgtcccagcagcagccatgcctcagtgtctccactgtgcacagccactgtctgggaggagctcccaggatgggtgtctttggcacacaccaggtggcgggtgttagagtgcagtgcagcagctggctgcctgttctattgggctccctgatgctggagagatgggaggtgcattcgcagggccagcaccctgtttgtgaatttttatataaaaaccctgattttacttcatttttgcagatgacatagataactaaaaacagaatctgcaaagaaattgtaattttcaactttaccccaaattcattgtttcttaattctgtgcaagatccagacatattattgccttcctcatgataatttattctatgtaaaaccgaaatcattttttctcctactctttgtttctgttcaagtacagagatcttgagcaaagtaagttgggttctttccacacactaaccctcaccttccccagagaatgagcagagattgtcctcagtctgagtctaagggaggagctgtttctggcacaatcagagcctgcagagacccccaggtgcagcttcagtgaagtcagacatttctccatgtgggcgacctccagtgcctgtgactgctgctcaggcctaattgttggttaagtattacgacaccctttaggtgatcacatctcaagcctattctgaaaatcaccatgaacagagatagttcaatggccattctcctgacataagtttctctttattacttggttccaagtatggagaaaaatgtgaccctatatttgtctgaatccaacatcagcatccacggcattacgctaggagactcactaattgagcacaagtgagctcgttattctcatagaaatgtaagtatttggaaatttcagcgtgttctccagaacctgtggctgccaacaactgtatttctcggtgcactcttggcctggtgaagccttcacagaacctctccctcacctgtgccatctctgcattctccatcacaaccagtgtttccttctggagctgcatccatcagcgcccccatgggaggtactggagtggatcgggtgcataggtcatggagggagcacagattactcccctcttctcaagagtccagtcaccatctccagatccatgtccaaaaagtacttcttcttacaggtgaactatgtgagcaacaaacacatagccatgtattttagagcaaaagacacagtgaggaaaccacagtgtgaactcatacccaagcctccctgtgggggtgcataggacagccagggttactcaggacaccaggctccctcaggacaccaaggggcactcaagaccattgtagaggcatgcaggtagctgggggctctcaggaaccatgggggaaaatcaggacaccaaagggtgcttggtacagcagggggctcaggattattgtggggattcagaaagagcaggttcaaggctcaacctcagggcatgtgcagctggtgtgaaaaggggctggatgaggcgttttgtgtcaccatcatgtttcaccaccagacaccctccactacctctattctaatgcatgtgtttgtatgattagaaaatgatattgatataaatatataaccatagctaggtgtgtcaagttgtcctctccatcttatatcagccttgtctgtaaggactaattccccataattacttgagaacctcataaattgtggtcaattatgtaggattcctctctttttctgccttccttcctccctccttctctctctcacacagaaacttatatacagccaccccacaacacacataaatctataacttttattacctgatgtattgataagtaatctaaagttacataaaaatcagtagttcactgtcaatattgtaggagaagggaaggtctaggaaggaggaattacagaacaagaggatattttgagggtaattgacttgttatctatgtggataatgataatgtctatgaccatatttgtaaaattgaacacttcgtgtggagactattatttttttatttaaccccatgccattattttgccgtattctagcatttctctaaaaatacagaaatgttcagcactcattcatgtgtatattcaggagtttctgacttttcatgtattttatttatctctgtctaattgctttgataccaaattttacctagtataattagtactacctttagcactgattataagtctcactcctccatcatctccttttttgccacacaagctgaatctagtttggactcataggagctgcttcattcaatgccagtgggagtttcaaaccctatcaacccccctataaactgtcattaagaaagtttatcaaactccaccagtcatgtgatattagttcgttttcacagtggtataaagaactacctgagacgaggagtttacaaagaaaagaggtttagttgactcacagttctgcatggctggggaggccacaggaaacttataatcatggtggaaggtgaaggcgaagcacggcacatcacacagggcagcaggagagagagggggaagtgacacatagttttaaactatcagctcttgtgagaactcactcactatgatgagaacaacatgggaaaactgccctcatgatccaataacctctcacctggtccctcccttgacatgtggggattagaatttgagatgatatttaggtggggacacaaaacaaatctatagcacatgtccagctgtgtcctggagttgtttcagggatccagtgtgtactgttgatagaaacagtgatcatcattctagctggtgtgagatggtatctccttgtggtttagatttgcatttctctgatggccagtgatgatgagaattttttcatgtgtcttttggctgcataaatgtcttcttttgagaagcgtctgtgaaaaaaaaaaagaaacagtgacaccaagctcacaccatccgttgtagttgacaacatgcaaagccaagagatctcaactgagatttagtgtgtgtgtcatgtctgatgaagtcataagctcagagcaagtgaatatggaaaagtgtattatctgcacagtgtaggtgtctgctgagtgcagggcaggtctcgcaggaaaatctaaaatggcttgaaagaagaggaaaggagactggctcagggtttttataatggtttagtggtggtggcacagtgaggcttcccactcacagatcggggtttataaggtttgaaactcccactgccattgaatgaagaagctcctgtgagtccaaactagattcaccttgtgtggcaaaaaaggagatgatggaggagtgagccttaagtaatcaacaggcatgcaccaaaagatagagcgacaacttattctaggtagcaagaataaaaataatgaaaaagaaataagggttcagtatgggtggacaagacccagatctacagaaatgagatgactttagaaatataaggaaataataatgagaaaaagaaggaggggatggggaattagggtcctggcctaatgtcttgggtagaagcttctcacaatcaaggactatcagcttattctgcaggtcttgggtcacacgtctgcttaaaaacatcagaaatgccaggcaatcaatgaggatgctcagtttagcatctcctatttgagtagatttacagttgtgtggaattcttaattgattctttttggtttgtttttagaggcaggctctcacactgttccacagcttaaagtacagttgtgtgatcatagctcactgtaattttgagctccggactcacgtaatcttcctgtattagcctcctgaatatctagaattagaggggaacgccacccctcacctgcttattctttaaaatattttttcatagaaatagcatctctttatgttgcccaggttggcttcgatttcctggtctcatgtgatttccctcactttgcttctgaaagtggtgtgattatagggaagatccactgcatctgtcctgaattgattcttcagttgtaaaacatgaagccaataattaactgcctgactgttttgtgcagtgagttagttaaaagtttctgataagattccttccaatatgattcaagagcagtattttctgctgatgttcctttcagtttccttgttgaagatcagaagacactgcggaaaagatgtagtaaaaaggcagttttaactcttcatgattggagtggatatcacataggaatccctttccgtattttgtaacacatgcatgcaatagaacaaagatgatcccttggtgtaaaatctataaacgtatgggccttttagctaccaagtcatagggtaataactgatggaccctgaggagtgaaccatgattccatagtgctagtgggagaacccttggccaaggaagtttacattttattaaaattgataatttttatgtagcgatgccattttttaaacattcccagaaggttgtgagtgggattgactctgtcttctgtgaacaatgacagtgccctccatggttagataatattttaaactagattgagctagagtggtttctgtattgaatcactatatttttttagcttcatgttagctttttgtgtgttagcatttgctttaaaatgatattaatcagccctctagtaggtagaaattcatctgagggtttcttcccttgttgtccatctcaataggatttccagaagacgtaagaaccctctctgtttctaaaaatattccaggctgggcgctgtggctcatgcctgtaaacctagcactttgggaggccgaggtgggtggacccctcgaggttgggagtttgagaccagcctggtcagtatggtgaaacctcatctctactaaaaatacaaaaattcgccgggcatggtggtgtacactcgtaatcccagctacttgagaggctgaggtgagaggattgcttgaaccctggaggcgggggttgcagtgagccgagattgtgccactgcacttcagcctgggcgacacagcgagactccgtctcaaacaaaacgacacaaaaaattccaaagttgtgcaccctctaaaagcatatgtacttaattctcatttttaatttattaaacatctctaataagttcaatgtttcctgccttctgagttgatttcctaacacatagaagaatatatcctaaatgaaagtttgtgttcttaatacaaattactagttaataacctttacttttattattgaggtattatacatcaatgttaatcaatcctctcaatgggactcttacctaaagaatatataaaatattttcctgatcatgacatataatagatgtgaacacattcttagcattcagccatgtctcttgtctattaatattataaaccacatgctaactttgattttattggtaattgttctaatttcttttttttcccacttctctggttgttttttttttaactttaagttttagggtacatgtgcacaatgtgcaggttagttacatatgtatacatgtgccatgttggtgtgctgcacccattaactcgtcatttaacattaggtatatctcctaaagctatccctcccccctccccccaccccacaacaggccccagtgtgtgatgttccccttcctgtgtccatgtgttctcattgttcaattcccacctaggagtgagaacatgtgttgtttggttttttgtccttgcgatagtttgctgagaatgatggtttccagcttcatccatgtccctacaaaggacatgaactcatcattttttatggctgcataggattccatgatgcatatgtgccacattttcttaatccagtgtatcattgttggacatttgggttggttccaagtctttgctattgtgaatagggaattgttctaatttcaaactagttaatttttatcttcatgcagctagattattatgtgtggctatttattccgagagggataaagacaacattaacaattttcactgcaggcatgtctaggcaactccctgtgcactatgaccctggggcgttggagattctatggggactcttccctacctgcctaggagagttctctgccttctacctctagcattttcctctttgaagaagtacatctaactgtcattagaatagagacaaagacaagtcttaactgcttccagctgaggagggatgctgtttggggaagatctctcttggaggtctaagggaccccaggaaaagggagccattatcccaggcttcagttgcatgaccatttggagtttgatggtctgaaaatgagaagaggcaaatctggttattagaagacatgtatgaaaaccaaacaaggtggcaaggacagcttgaaagaaaattccaaggctgctgacattcctagataactgcagctgtagttatgcctgctaaggtttgggcgcatggggcttggcttttgtcagctccctgggatttattttcccaaacaaagaaacctccaggttaggggcaccctattcattcccatcacctggcatgatttaaaggataattgcttagaattaaaatattgatccagattttttatattccccatcgctttttgtttcttctgggctgtagccagagatcattgattggcgctcaggaataagcagagttagtctaaaatgcaggcaaatacttaaacaactgaagagattagaatttaaagacaagtgtatgatatgttttgaaatacaatgtttctctttccagttttggtttttgtcggcagcaaataatgataagactgagttgtttgcaaaataaactttagtcttaaacttggcctgattatttgcataaagtgcagcaagaatattaataataattctgtaggaaaagcctgcaagcaccaggagcttcacagtctaacactatgagcacgtgcatcctcacgcaactcactgaatatttccaagccagcctgttccgatcttaaatgccatccagtggcatctgccccaggtacactaatacatgggtcctgcttctctctgcagcctcctctctcctcagatttcaggttttgtttattgtttgttttctctctgacatcaacacagatatgttgaaggttttcttttttttatttgtagttgttcagctttgttgttaatgaggtcagaataagctcatagtttacacatttttacattcccatgccgagtagctgcttttctctatcaaatccattaactgagagaacaatcacatttcgttacaggtgaacagttaaatagtttggcatatatttctgtgctggaatctaatgcagcttgaaatcaagtcatgcctcactcattgaaaaaaacatggctaaattctcaaagaattgtgctgagtgaaagaaactaaggaattaagagtaaattttacatgatacatttgtagaaattttagaagatgccactattataaattaacatggagaagatttaaatgtttctgagaatatgctattgggagtaatggggatgtgagttaaatttcagaggaataagagaaagatttagggattaattttttcaaaccttgattgaagtgctgagtaaatggttgcaaacataggtctacatttttcaaatcattcaccataaatttgaattatttattaattacactcgaataaagcaataaagaaactgatgagataatatttgactgaattgcatcaataaatagatcgatattaacacaaggaatataactgatttccaaaaacatacacatgaaccatggttcactctgcgtatttagataaattacagaaagttgtcataacagatggggaatcctgcagacttcactaggcatgggccatgctgccctggagttgtctcaggggagctgcctcctccagaggttagagcacaggcccaggtaataggactaaatttttagatgtgttatcttagacacactgcacaactgctgtgttctctatgtaaattatctcctgtaaaatataacattgaagcctgcattaaatatattgtgtaaatatgtaagaataaaagaaagttatgagagctaagtgttaatcaaggcacaagcatataagatataactatattttcctgaatgatggaattactaccagtctcccccaggacacttcatctgccctgagcccagcctctcctcagatgtcccacccagagcttgctatatagtgggggacatgcaaatagggccctccctctactgatgaaaaccagcccagccctgaccctgcagctctgggagaggagcccagcactagaagtcggcggtgtttccattcggtgatcagcactgaacacagaggactcaccatggagtttgggctgagctgggttttcctcgttgctcttttaagaggtgattcatggagaaatagagagactgagtgtgagtgaacatgagtgagaaaaactggatttgtgtggcattttctgataacggtgtccttctgtttgcaggtgtccagtgtcaggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatggaagtaataaatactatgcagactccgtgaagggccgattcaccatctccagagacaattccaagaacacgctgtatctgcaaatgaacagcctgagagccgaggacacggctgtgtattactgtgcgagagacacagtgaggggaggtcattgtgcgcccagacacaaacctccctgcaggaacgctggggggaaatcagctgcagggggcgctcaggagccactgatcagagtcagccctggaggcaggtgcagatggaggctgtttcctgtcaggatgtgggactttgtcttcttctgacagttccccagggaacctcttaaatttagaaaactgtgcctaacaatgtcttctctatgcatatgaggaccttttctccctggcacaaaatgcagattgacgctgacacggatgaaaattcctcaaccatggtcacaaggatcagagtcctgagtaacctcagggcttcctggtgattcttctccaatcagacccaggacagggacctccgtgagattccctgactggaacagtctttatggatcctggtcacagacaatagagaggctgaaccagggtcagcgtcatgtagaacgtcacagatttcacgtctgatccttctcctgacacgaaagtatgcaaatcagtatcagcaccgatctggtgcttcttttgttcctaatccatttactttcttttttcgtcgtttttctcctttttccatttgtttttcctgctttttgcaaaaggaagatgttttccctgtgagatgcaggggatgacaattttgggagatggctggaacatccaatatcctcagggccgaccatcagtaagtgcaggctagaagtctcagaaagagctgaagctgcttaatcaccgtggagttttaccttctccagttctgctctgatggaatcagggccaagcaggttatcaatgataatctacctaacatagagtcaactgattccagtttcaataacgtctgttaaaaattcacaccaccacctggattactgttttgtcaaatcaatacacagtattgtccagctaagtagacccaaagacggaccgttgcccatggagaaaaacattaacctgagttctaggttcttacagtgttaaaggtgtaaaactgattattaaaaatgaggctatttttctttttgctgttgagttgtagaagtttcttttccattttgacatgaaaactttttcagatatatggcatattatccaattctgtaagttgtagttattttgttgctttgcagaatctttttcataatctattcccacttgttcaattctgcttttttttgtaggtgatttgaatgtaaaatcctgaaaaagattgctaattttttgagtgttgagagttttacaattagaggtattacagttagatatttgaggcatttggagtgaatttttgtgtttattctaacctaaaattcttaattcttttcatgggaaaatccagttttcataccaccctctttggaagacactacaatttagccatgttatattgatggttctcatgctaaaaatcagcttgtcatcaatatgtgggtttatatctaagctctatataggtatttaagccaaaactttctatgtttttaataaatgttgaggcctggaagtgaaatgcctaaagctttcttcttgccttgttacagatattgtaccaaaatattctaaccttttactattgagtgtaataatagctgtggcctttcttaacggcttttattatgttcaagttgttttcttgtcttcctactttgttcatagttttaataatgaaactgatttttttcaaagtctttttctgtgtctgatgaaatgttactgagatattttttctttagttttttaatgtgtaccaaactgattgatttgagaatgttgaatcaagtatgcatctcaggaagaaatttgagttggtcatggtgtatgtcttctaaaacactttggagcttagtttactattgttggggattaattcatgtctactaatgatattggtctgtagtttcctttattgtggtgcctttgtctattactggtaatactatcatggtagtctcatagaaagagtttagaaggtgtatggcagactacctttaaaatagattttatcagtggagaaatggtgatagttttttcttcacttttctgttgggaagaattttatgttgtttaaaagatattcagaatgacttaacctggtttatgagctttcattctattcctttcttccattctttttgaagaactgcttacctttcctatttatttttaagtttgtttttagacatatgcaatacattttgaggtgaaacctggtggaattttttccaataaattagtaaaaataaatcatttaattgactattttattcaggttgatttgtttaatatttgctaaaggccagttctttaagctatgacacataataaatcccaaatggcagtacctcattgtttacttagcttttgtacttatatttttcagaggaagaaccactactgtaaattgtaaatagccaatacataattgtattgtatgcaaatctgtgactgtttacagtgtcatctctgagaaacataaagtttatttactatatatatataaagagtttggaaggtggactccaccaatttttgaaagagttacagaagggctgctattacttctttaaatgttaaggttcattttatgatgtaacagataacctatcatggagaatgttcaatgtgttcttgagaaggatgtgtattacgtgactcttggttggaaggttctgtaaatatcattcagataaatttgttcaatagtgttgttcaagttcagaggcacattgagaattttctttctggatttgctaaacattatggtcatgaggtattaaggtcttgtgttatttttgtattgttttctatttctttatatctcttacagtttgcttaatgcagttatatttgtatttgtacacatgtgtaaaaacaaaaatcataattgctaaatgagttttatggcacagtcacattataagtaatatttttccaaatgctaccattgccactaaagtcctcctggagtctgacgtctgctctgggcactgccttcttctcaggcgtcccacactggagcttgctatagaggaggaggcatgaaaacagggccctccctctcctggtgaaatcaagcccagacctgaccctgcagctctgggagaacagccacagccctgggattcccaggggtttccatttggtaatcaggactgaacacagagaactcactatggggtgtgaattaagctgaatttttcttgttggtattttaaaaggtgactcctagggaactagagtgagtgagagtgagtggatatgagtgagagaaacagtggatatgtttgccagtttctgaccaggatgtgtgtgtattttcaggtgttcagtgtgaggtggagctgatagagtccatagaggacctgagacaacctgggaagttcctgagactctcctgtgtagcctctagattcgccttcagtagcttctgaatgagccgagttcaccagtctccaggcaaggggctggagtgagtaatagatataaaagatgatggaagtcagatacaccatgcagactctgtgaagggcagattctccatctccaaagacaatgctaagaactctctgtatctgcaaatgaacactcagagagctgaggacgtggccgtgtatggctatacataaggtcccaagtgaggaaatatcggtgtgagtccagacacaacatttcctgcaaaaagaagaaaggagtctgggccgaaggggacactcagcactcacaaaacaggtgcagccccaaggcaggtgcagatggagggagggtaagggctgctttccttcagggtctgtggtttcctctgcttctaatatttcccctctgaacctctgtatatttatgttttgtgcccaccatgaggtccctggattagaaaactaatttaaaagaggaaatattctcatatgtcccaaaaacagatgtaagttttggaggcataaaaatgcataggagccgcgtgagtctgtagacactgccaccccacaatgccagacccaaaactagtgctggagaagggtgggagtttgatggagcttccctgatgaccccgtggtccaagctaagtccagcaaggccattggtgcctcgctgagcacagttgtccatcagggatctcccatgtgtcccagcagcagccatgcctcagtatctccactgtgcacagccatcgtctgggaggagctcccaggatgggtgtctttggcacacacaggtgatgggtgttagagtgcagtgcagcagctggctgcctggtctattgggctcctggatattggagggattggaggtgcattctcaaggccagcacgctgtttgttaatttttgtataaaaaccatgtgatttaattcattttctcagatgacatagataattaataacacaatctgcaaacaattgtaattttcaactttaccccaagttcattgtttcttaattctgtgcaggatccagacatggtattgcccttctcatgagaaattgttcgacctaaactgaaaccagttgtttctcatatactttggttctccccacatgcagagatcttgattagagcaagtttggtactttccacgcactcaccctcacctccccagataaagagcagaagttctccttagactgagtctgagggaggagctgttcctgtaccactcagggcctgcggagacccccaggtgcagcttcactgagtcaggtgtttcactccctgtgattgctgctcaggtctaattgtgggctcagaattaggacagtcttcaggttatcacagatcaatcatattctaaaaatcatcattatcacacaccgtggtaataattcaatgttcatttttctaaacagcagtttctcttttttatttggttgcaagtttgaggaaaggagcatgtgataatactttttaatctaacctcaaaatctactgaattgttctaggagactcacaaattggacaagagtgagctccttgtgctcataaaaaatgcatgtatttgggaatttcaccgtgttgtccagaaactgttaacatcaacaactgtgttttccagtgcacttctggcttgagacatcctcacagaccctctccctcacctgcactgtctctggattccccatcataaccagtgtgtcctgctagaattgtatctgcttgcccctagaagatggacaggagtggatcaggttcatgggttgtaaagggagcaaaaattacatcccacttctcaagagtccatatccagatccaagaaacagttcttacagctgagctctgtgcccagtgaacacacaactacacattttgaagcaaaagacgcaatgaagggccttcattgtgagcctagacacaaacctccctgcaggggtgaataggagcagcagggggcattcggggcagtatgggggcttagcatgattgttgggggtcaagatgagcaggatcaaggctcatcatcagggcaagtgcaacagggcagaaaaggggctgtagatgtgggttgttctcaccatcatatttcaccaccagacaccctccactacatctcttctaatgtgtctgagtgttgatatgattagaaaatggcatttatgtaaatactaatgtatacccaaatggaggtgcatccagttgtcctctccatcttatgtggaccttgtccatcaagggctaagttcctgtatttacttgattacctcatacattatggtcaaaacaggtagggtctcattttggcatggtctctcctcctcccttctctctgtcgcacaaaaacacatgaactgacacacacagagcttcccaacttcaattatctgatgtattgaagcaaattgattagtgtgcagcttttctgctttgcctgctattcatgttatgtaaaaataagaaccgtgtgtttctcagcttgttacttctctaagctaagtagcatctttgtttattatacccagagaccaaaagcgattcagctgttattcagcagcttaactggtaaacaaattgtggaaaattcatttactggaataatacccactgttacaatgaagtactgctggatacactcagtaccatgcttaaaataacaagtacctgaataagtaaaataagtcaaacaaataaaagtgcatacatatgattccacttctataatttctataaagtaaaaatgaacttaaagttacataaaaagatctgtagttgactggggacatggtacaagaagagaaggtatagaaaggagaaacgacaggagagcaaaaggaaatttctaggataattttttctctgttagtaaaagtgaggattatgtcactatttgtaaaattgtccactttatgtaaaggttcttatttgctaatttcacctcattaaaatattgcaaattttaaaatatctaatttggtagaaaaggtagtagagagagatgaataaaatacataaaattcagagagtcctgaatacacacatgaatggaccctgggtctcactgtacttttagggagacactagaatacaaaaacataatgacaggatttcagtacatgaaaggagcttctcagaccccaggaggcctgtccaactgcgtctgggagttaactcagggagcaggcatgtcctttggaaggagcaatgacaccaagctcccagcatccattgtagccgacaccatgccaatgccaagagatctcgactaaaattttctgtggatgttgagtgtgattatgccacacactcacaccaagtgagtatggaaaggatagttacctgcatccttaaggtgtctgctgagagcagggcaggtctctcattaaggtccaaagtggcttgatagagcagggaaggagactggctctgggttgttatcatggcttggtggggagcggggcagagcatcctacttgcaggaagggttttgtggggtttcaaggtcaaattggcatcaaatgagggagctcctgtgatttctaactagatttaccttgtatgcttaaaaaaagagatgatggaggaatgagcctgaagttatcagcagtcaggcctaaacacagagtctgatgacttactctaaatagcaagtatacaaatgatgagtaagaaaagagacaagactccaatatgggtggacaacagccaggtctgcagaaaatgagaagactgtttataagcaaagaataatgagtaggatatggaggaggattctggtccaatgtcttgtgtggaagcttctcatgatttgagatcatcagcttattctgaaggtcttaggtcacctgtcttcttcaaaatatcagaagtgcctgatgatatgtgaggatgcacagtttaacttcctctatttgagtagctttacaattgtgtagagttcttaattaattaattttttttttggagacggagtctcactctgttgtgcaggttggactgcagtggtgtgatcataacatagctcacggtgatttcaaattcctggctcatagaatcctcccacctcaacctcctgactagcaagtagctaggtttccagggcccttcatctacacttggccggttcttttcattctttttttttttttttaggtggagtttccctcttcttgcccagactggagtgcaatggtgccatctcagctcactgcaatctccccctcccaggttcaggtgattctcctacctcagcctccagagtagctgggatcacaggcatgtgacaccatgccccgctaatcttgtatttttatcagagatgacatttctccatattggtcaggctggtctcaaactccctacctcaggtgatctttccacctcagcctcccaaagtgctgggattacaggcgtgaggcaccgcaactggcctcttcatttttattcatatgttccttcagcagccactatgtcttcccactgatttcttcagtttctgccttttccttttgaataaggcattattcctaagggaagtcgggaggtgggcctggacagggacttggtgcattcctctctcccgtcccagttcttattggtttctccagtggctgtagaacagcagttttgatggctttacctctgcagataatttctcttgcaatgtagtgctgatggggaggtgtgtctggatgcacttcacctatagttgctgttttgctttcccagacagcaccatcccaaggggtagagggtggagcattttgtgatgtatccccagtactgaagaaaaaggcttcaatagcaggaggaattcctcaactgtatacactctgagaatttaaacaataacttctctatcatactcaaattgaaaccatccaatgaatatgtctactttaatcgtgtgctaacttaaatggcatttggcagcctctgtgccagaaaagattatcatctgctcctgtttatttccctgcaagtccttatctctcttcagatttcagatatattgtttgtcctataacatcaaaaatttgatgtatatgtgctaatttgcagatcagtaagtttagtagctgttgtaagaataataacatatttttatggggtgcttacatctccaagctgagaagcacctctatgtgtaatactaagaaactagaaatgatacaaatatcaagaagatacatagataaaaagtaatggcatgctaatttactgtaataacatccatcatgagaatcaatacattgttgatgctcaacatgtttgcatcataagtagttatgtgcgagaagccacacaaatagaacacatactatataattcctgtataattcttgaaactcaaaactaaagcattaaatatgaaggactgactcagaatatggtggggaagaaaatatttgggaaggaggaattgtagaggaacacaaggaaacttttaagtgtaatttgtttgttcattatttggatggcttttggggatgcaaaggtgagcacgagtggaataacattttgttttgtttgtttgtttgtttttctgaagagatgtggtccttctctgtgacccaggctggagtgtagtggtgggatcatagttcaatgtagcctctaacttctggtctccaacaatactcctgcatctgccatctaagtagctggaactaccgttgtgtgccaggaggtttggcttggcttgagtacttattaaaccacacactttttgcaatatttaatgtatagtaataatgtctcaataagactattacaaatcaatgaatgaataatttgttcagtacagattcatggaaaaatagacactaacatgatgagtgtctgacatttatgaaaatacagctgcatgaaatgtgcttctctttacattcattaggtaaacacaatagtgcatacacatcacaccgtgctttcattacaggaagaaagttctgaaaatgtcactggggtgaaccacacggtgctgggcttggttcagggagcagtcaggcccagtgttgtgaccttcaaccacagaatccttaaaaaaaaaaaaaaaaaaaaaaagaggctgcctcaaagtccgcatcagttcccggactcgctatgtttctggatcgtatcagtgcatccggatctccctggtggctttagtgattccttgcttgccatgctgaggtctcgctgtagattatgttgggttttctaagaccgttttgctattgtaagatccactccctgggacagagcgattccctctaaacctgatagaggttctgaactaaaaataacattaagtgaatcctggtgtgtctgaactcaagtgattgttacattaagctgctgttccaatctgtttcctcacctgggaaaagaggagccaggacatagtgagttgaggccccaggaagataactgaattctcagagggcacagccagcatcctcctcccagggagagtctaaaagactggggcctccctcatcccttttcacctgtccatacagaggcaccacccacatgcaaatctcacttaggcacccacagaaaaccaccacacatttccttaaattcagggtcctgctcacatgggaaatactttctgagagtcctggacctcctgtgcaagaacatgaaacacctgtggttcttcctcctgctggtggcagctcccagatgtgagtgtctcaaggctgcagacatggagatatgggaggtgcctctgatcccagggctcactgtgtgtctctctgttcacaggggtcctgtcccaggtgcagctgcaggagtcgggcccaggactggtgaagccttcacagaccctgtccctcacctgcactgtctctggtggctccatcagcagtggtggttactactggagctggatccgccagcacccagggaagggcctggagtggattgggtacatctattacagtgggagcacctactacaacccgtccctcaagagtcgagttaccatatcagtagacacgtctaagaaccagttctccctgaagctgagctctgtgactgccgcggacacggccgtgtattactgtgcgagagacacaatgaggggaggtgagtgtgagcccagacacaaacctccctgcagggaggcggagggggcgggcgcaggtgctgctcaggaccagcagggggcgcgcggggcccacagagcatgaggccgggtcaggagcaggtgcagggagggcggggcttcctcatcagctcagtgctctccctcctcgccagcacctcagctgtccccaggcctcctctttctttattatctgtggttctgcttcctcacatccttgtggtaggaaaggaaggaggaaggcaaattttcctcttacagtcaaagtgtcactaattactaggaactttcctacaagttcctgaatgtcccatttttccttcttaattaaaaaaaatatatattctaatacttctcaccatctcttgatttgtgtcatcagttgaattgtgctgtctttgaaattcaaatgctgaaaccttaaatccaattgatctatattggaattttaaggatggaattaaggttaaatgtgatcataagtctgagattctaatgcaatagatctgttgtctttataagaagtggaagagtcaccagagacctctcacttttcccgtgcacgcagagaagaggccatgtggagacatagtggactagaaggtgcaagccaagaagaagccgcaccaagaaccaaccctgccagcacctggaccttggacattcagacttcagaatggtgagaaaatcaatgtttgttgtttaagccacccactcctgttgtcttcttatgaagacccagacagactaataccacataactctgttagctcctggagggagaagcagctccctgaggctgggcacatctctcagatatccatatgaagtaggcagaaatagtagttctcatataaaaatgtgtcatggccctgttggccatttttttttgacggagtctcgctctgtggccaggctggagtgcagtggtgcaatctcagctgactacaaaccccgtctcctgggttcaggcaattctccttcctcaacctcctgagcagctgggactacaggtgtccaccaccatgccagcctattttttttttgtatttttagcagagacagggtttcactgtgttagggtggtctcaaatctcctcactgcatgatctgcctgcctcggtttcccaaagtgttgggattacaagtgtgagccaccgcacctggcccctgttggccattcttggggcaatgtctctgaaaccagccctggtgcctgtaccacaaaattttcttttatctttcatgtggatataacaaatggacaatgaggaccagctgcatggagactgaccactgaacatcttctgctgtctcctaagtaagtcacaggaaaacacaccaacatcaccaacataactgttttccttcaacttcctcgaacgaactatagaaatgatcccttaaagtatagtctattccttcaactttctcaatttgcactgaatcccttcctaaattaggagctacatagggtctgagttttgttccctttctcccagtcttccccaagtatcaaggacagaatagatttaaattaaatttggccgtccatgcccccaacaccacatcggtttctaacatccttgtcatgtacccatccttctgtgggcaccccacatcaggttggccaggaatggccagaaggtgtcatcaccttatgggctgaggctacaagttatacacacgtgtgatttcagtcacacacactctactgcaggacacacctgtgttctgaggaactcaggcgcctgctgatctcaggtcttctctaataaattacacacctcttatgaatgaaggtccagatggccccatcagctgcagagcagtggattaaagctcatgggtgggtcagtcaggcagaagtcagacaatgggataatagaagtcagacaatagtcactgaggttcccaatgtattttaatggaataaaacaatattagcaacaaaggggcagtaaagaagactggctcttgaaggtatttaaggaccaggaactttatttggggggaaagtgagagacacttttacatggaaagccctaaagcacatacagcagctgacagagtggccactgtgcacatgagggctgaggagacggatgataggttacgttgctccaagatgtccctgggtgtgtgatggttggactcctcatgcatatgaaaataagagctggactcagggagaaacaagggccataccccatagaaaaggaagaaaaaaagcagatgggcacccctggagagagctcattagatttggtaggtttgagatgaaaattacttccaaaggttttaatgttctaagctaaatatgaatctcttcaataaagtgagaattaaaagaagaatggagctaggagttgagagaggaaacaaattatgagagagcagaaagcaaatccacccaaactgtcacatgacagaggccagaatggagctgatgcagctacttcactattctgcagacctagttgaccatgtggagaaggggttcgaacaaacggggatgttctccaaccttccaaaacaacctccttcttatgcatatgcagtaatcatgattctcagggtggccttcccaagtttcctgttcttacctcttcccccaggggtagagtgtcttttccaacccacagtggtttctctgccatgtcctcagcttctcctccattgtacttaacctgaagattaaggatttcatctggatggagtttcctgggaatcctctgttttctttggtttctgatgaccacatcacaggccataggacacaggttttagtggatttcccctggagacagtggaggtgaatccaggcgttccacagtccttaccgttcttctcttcctgtcagcaccgcaggacagcagataagggagctgactgtggatttttcagatccccgggaaaaagcctgcaaggactaatagtttcacatctaacaccattagcacatgcatccaaaattaaaaaaaaaatcctcactaaatatttccaggttagcctgttcctctctcaataccataccgtggcacctgccctgggttcggtaacatgtgggccccagtcctctctgtaggcgtctgcctcctcagatttcagtcctcttttttgctccgtgaaagcaactcagatatgttaaaaggttttcttcttcatttattcataatttttcaggtttgttgttaatgaggaaagagtaagatcatggtttcctcatttttcacattcccatactgagtaactgctctctctctatgaaagccagaaattaagagaacaactcaagtatccatatccattacaagtgaatgttagacaatttgatgtatgattatgaactaaagtacaacacaggattagaatccaggcatcctcattctcataaaatcatggctgcattcacaaataactgtgctgagtgaaagtagctaacaaattaacagtgcacttcataaacttctatttgtataaactgcagaaggtacagctattctaaagcaacagagaagattacatattggtgggaactgggttttgaaagtaatggggtggtgagatgaaattacagagaagtgacacaaagatttaggtgtgaattgtacacaaattaattgaagctctgattaaagggttgcacacatgttaccattttccaaattatgcagtatatatttgaattaattattaattgtatttaaataaagcagtaacaaagaaacaaatgaatacatttattgaggtggagccaaaactaaatgggaatgaacactcgaaacatctctgactcttgaaaatacacaagcgtgaacactggttctctctatgtatttcaggtcaatagcagaatacactaaaagaaaacagagatgtcctggcaggggtggaatcctgcagacctcactaggcatgtctcacactgccctggagttgtctcaggggagcagtctcctctagtggtcagaggcacaggccgagataatggggctaactctgtccagctgtgtgaccttgaatgcattgtataaacactctgttctctgtgtgatttatcttccttaaaatgtgacattgacacttgcattaaatgtattctacaaatatgtcaaaaagatgatgactgctaaatgattatcaaggcacaatcatataatataatgatattttcctgagtgataagatgactaccaatctcccccagggcactttgtctgctctgagccctgcacctcctcaggattcccatcccagagcttgctatacagtaggagacatgcaaataggtttctccctctgctgatgaaaaccagcccagtcctgaccgcacagctctgggagagaagcgccagccctgggattcccaggggtttctatttggtgatcaggactaaagacagaggacccaccatggagcttgggctgagctgggttttcactgttgctgttttaaaaggtgaactagagagattgagcgtgagtggatacccttgagagaaatggtggattatgtctgggagtttctgaccaggatgtctacgagtttgcaggtgtctagtgagaggtacagctcgtggagtccggagaggacccaagacaacctgggggatccctgagactctcctgtgcagactctggattaaccttcagtagctactgaaggaactcggtttcccaggctccagggaaggggctggagtgagtagtagatatacagtgtgatggaagtcagatatgttatgcataatctttgaagagcaaattcaccatctccaaagaaaatgccaagaactcactgtatttgctaatgaacagtctgagagcagcgggcacagctgtgtgttactgtatgtgaggcaccaggtaagaagacatcagtgtgaacacagacacagtttcctgcaatgataagggaggaggctgggctaaaaggggcactcaggacccactgaaaacgggcagctctagggcaggtacagatggttatcatgggctgctttccttcggggtctgtggcttcctctgcatctaccagttcccctcggagcctctggacatttatgtttctgtggccacccctgacatctctggattagaaaagtttattataggaagaggaaacattttcatttgtcccaaagcagatgtaagtaatggaagcaaaaaatgcacaggaggccaggtggggctgtagatactgtcaccccagaatgtcaatctcaccactagtactggagaggcatgggagtttgatggagcttccctaacaactctgtcttccaagataagtccagcaagaccattggtgcctcccagagcacagttgtccatcagggatgtccaatgcttcccagcagcagccatgcctcagtgtctccactgtgcacagccactgtctgggaggagctcccaggatgggtgtctttggcacacaccaggtggcgggtgttaagagtgcagtgcagcagctggctgcctggtctattgggcctgatgctggagagatgggaggtgcattcttggggccagcatgctgtttgtgaatttttatataaaaactctgattttacttcattttcgcagatgacatagataactaaaaacagaatctgcaaagaaattgtaattttcaactttaccccaaattcattgtttcttaattctgtgcaagatccagacatattattgccttcctcatgataatttattctatgtaaaaccgaaatcattttttctcctactctttgtttctgttcaagtacagagatcttgagcaaagtaagttgggttctttccacacactaaccctcaccttccccagagaatgagcagagattgtcctcagtctgagtctaagggaggagctgtttctgcacaactcagagcctgcagagacccccaggtgcagcttcagtgagtcagacatttctccatgtgggcgacctccagtgcctgtgactgctgctcaggcctaattgttggttaagcattaggacactctttaggtgatcacatctcaagcctattctgaaaatcaccatgatcagagatagttcaatggccattctcctaacataagtttctctttattacttggttccaagtatggagaaaaatgtgaccctatatttgtctgaatccaacatcagcatcaactgcattatgctaggagactcactaattgagcacaagtgagctcgttattctcatagaaatgtaagtatttggaaatttcagtgtgttctccagaacctgtggctgccaacaactgtatttctcggtgcactcttggcctggtgaagccttcacagaacctctccctcacctgtgccatctctgcattctccatcacaaccagtgtttcctgctggagctgcatccatcagcgcccccatgggaggtactggagtggatcgggtgcataggtcatggagggagcacaaattactcccctcttctcaagagtccagtcaccatctccagatccatgtccaaaaagtagttcttcttacagctgaactatgtgaggaacaaacacatagccatgtattttagagcaaaagacacagtgaggaaaccacagtgtgaactcatacccaagcctccctgtgggggtgcataggacagccagggttactcaggacaccaggctccctcaggacaccaaggggcactcaagaccattgtagaggcatgcaggtagctgggggctctcaggaaccatgggggaaaatcaggacaccaatgggtgcttggtacagcggggggctcaggattattgtggcgattcagaaagagcaggtccaaggctcaacctcagggcatgtgcagctggtgtgaaaaggagctggatgaggcgttttgtgtcaccatcatgtttcaccaccagacaccctccactacctctattctaatgcatgtgtttgtatgattagaaaatgatattgatataaatatataaccatagctaggtgtgtcaagttgtcctctccatcttatatcagccttgtctgtaaggactaattccccataattacttgagaacctcataaattgtggtcaattatgtaggattcctctctttttctgccttccttcctccctccttctctctctcacacagaaacttatatacagccaccccacaacacacataaatctataacttttattacctgatgtattgataagtaatctaaagttacataaaaatcagtagttcactgtcaatattgtaggagaagggaaggtctaggaaggaggaattacagaacaagaggatattttgagggtaattgacttgttatctatgtggataatgataatgtctgtgaccatatttgtaaaattgaacacttcgtgtggagactattatttttttatttaaccccatgccattattttgccgtattctagcatttctctaaaaatacagaaatgttcagcactcattcatgtgtatattcaggagtttctgacttttcatgtattttatttatctctgtctaattgctttgataccaaattttacctagtataattagtactacctttagcactgattataagtctcactcctccatcatctccttttttgccacacaagctgaatctagtttggactcataggagctgcttcattcaatgccagtggttgtttcaaaccctatcaacccccctacaaactgtcattaagaaagtttatcaaactccaccagtcatgtgatattagttcgttttcacagtggtataaagaactacctgagacgaggagtttacaaagaaaagaggtttagttgactcacagtgctgcatggctagggaggccacaggaaacttataatcatggtggaaggtgaaggcgaagcacggcacatcacacagcgcagcaggagagagagggggaagtgacacatacttttaaactatcagctcttgtgagaagtcactcactatgatgagaacaacatgggaaaactgccctcatgatccaataacctctcacctggtccctcccttgacatgtggggattagaatttgagatgatatttaggtggggacacaaaacaaatctatagcacatgtccagctgtgtcctggagttgtttcagggatccagtgtgtactgttgatagaaacagtgatcatcattctagctggtgtgagatggtatctccttgtggtttagatttgcatttctctgatggccagtgatgatgagaattttttcatgtgtcttttggctgcataaatgtcttcttttgagaagcgtctgtgaaaaaaaaaaagaaacagtgacaccaagctcacaccatccgttgtagttgacaacatgcaaagccaagagatctcaactgagatttagtgtgtgtgtcatgtctgatgaagtcataagctcagagcaagtgaatatggaaaagtgtattatctgcacagtgtaggtgtctgctgagtgcagggcaggtctcacaggaaaatctaaaatggcttgaaagaagaggaaaggagactggctcagggtttttataatggtttagtggtggcggcagagtgaggcttcccactcacagatcggggtttataaggtttgaaactcccactgccattgaatgaagaagctcctgtgagtccaaactagattcaccttgtgtggcaaaaaaggagatgatggaggagtgagccttaagtaatcaacaggcatgcaccaaaagatagagtgacaacttattctaggtagcaagaataaaaataatgaaaaagaaataagggttcagtatcgatggacaagacccagatctacagaaatgagatgactttagaaatataaggaaataataatgagagaaagaaggaggggatggggaattagggtcctggccgaatgtcttgggtagaagcttctcacaatcaaggactatcagcttattctgcaggtcttaggtcacacgtctgcttaaaaacatcagaaatgccaggcaatcaatgaggatgctcagtttagcatctcctatttgagtagatttacagttgtgtggaattcttaattgattctttttggtttgtttttagaggcaggctctcacactgttccacagcttaaagtacagttgtgtgatcatagctcactgtaattttgacctccagactcacgtaatcttcctgtatcagcctcctgagtatctagaattagaggggaatgccacccctcacctgcttattctttaaaatattttttcatagaaatagcatctctttatgttgcccaggttggcttcgatttcctggtctcatgtgatttccctcactttgcttctgaaagtggtgtgattatagggaagatccactgcatctgtcctgaattgattctttacttgtaaaacatgaagccaataattaactgcctgactgttttgtgcagtgagttagttaaaagtttctgataagattccttccaatatgattcaagagcagtattttctgccgatattcctttcagtttccttgttgaagatcagaagacactgcggaaaagatgtagtaaaaaggcagttttaactcttcatgattggagtggatatcacataggaatccctttccgtattttgtaacacatgcatgcaatagaacaaagatgatcccttggtgtaaaatctataaacgtatgggccttttagctaccaagtcatagggtaataactgatggaccctgaggagtgaaccatgattccatagtgctagtgggagaacccttggccaaggaagttcacattttattaaaattgataatttttatgtagggatgccattttttaaacattcccagaaggttgtgagtgggattgactctgtcttctgtgaacaatgacagtgccctccatggttagataatattttaaactagattgagctagaatggttgctgtattgaatcactatatttttttagcttcatgttagctttttgtgtgttagcatttgctttaaaatgatattaatcagccctctagtaggtagaaattcatctgagggtttcttcccttgttgtccatctcaataggatttccagaagacgtaagaaccctctctgtttctaaaaatattccaggctgggcgctgtggctcatgcctgtaaacccagcactttgggaggccgaggtgggtggacccctcgaggttgggagtttgagaccagcctggtcagtatggtgaaacctcatttctactaaaaatacaaaaattcgccgggcatggtggtgtacactcgtaatcccagctacttgagaggctgaagtgagaggattgcttgaaccctggaggcgggggtcgcagtgagccgagattgtgccactgcacttcagcctgggcgacacagcgagactccgtctcaaacaaaacgacacaaaaaattccaaagttgtgcaccctctaaaagcatacgtacttaattctcatttttaatttattaaacatctctaataagttcaatgtttcctgccttctgagttgatttcctaacacatagaagaatatatcctaaatgaaagtttgtgttcttaatagaaattactagttaataacctttacttttattattgaggtattatacatcaatgttaatcctctcaatgggactcttacctaaagaatatataaaatattttcctgatcatgacataaagtagatgtgaacacattcttagcattcagccatgtctcttgtctattaatattataaaccacatgctaactttgattttattggtaattgttctaatttctttttttttcccacttctctggttgtttttttttttaactttaagttttagggtacatgtgcacaatgtgcaggttagttagatatgtatacatgtgccatgttggtgtgctgcacccattaactcgtcatttaatattaggtatatctcctaatgctatccctcccccctcccctcaccccacaacaggccccggtgtgtgatgttccccttcctgtgtccatgtgttctcattgttcaattcccacctaggactgagaacatgtggtgtttggttttttgtccttgcgatagtttgctgagaatgatggtttccagcttcatccatgtccctacaaaggacatgaactcatcattttttatggctgcataggattccatggtgcatatgtgccacattttcttaatccagtgtatcattgttggacatttgggttggttccaagtctttgctattgtgaatagggaattgttctaatttcaaactagttaatttttatcttcatgcagctagattattatgtgtggctatttattccgagagtgataaagacaacattaacaattttcactgcaggcatgtctaggcaactccctgtgcactatgaccctggggcgttggagattctatggggactcttccctacctgcctaggagagttctctgccttctacctctagcattttcctctttgaagaagtacatctaactgtcattagaatagagacaaagacaagtcttaactgcttccagctgaggagggatgctgtttggggaagatctctcttggaggtctaagggaccccaggaaaagggagccattatcccaggcttcagttgcatgaccatttggagtttgatggtctgaaaatgagaagaggcaaatctggttattagaagacatgtatgaaaaccaaacaaggtggcaaggacagcttgaaagaaaattccaaggctgctgacattcctagataactgcagctgtagttatgcctgctaaggtttgggcgcatggggcttggcttttgtcagctccctgggatttattttcccaaacaaagaaacctccaggttaggggcaccctattcattcccatcacctggcatgatttaaaggataattgcttagaattaaaatattgatccagattttttatattccccatcgctttttgtttcttctgggctgtagccagagatcattgattggcgctcaggaataagcagagttagtctaaaatgcaggcaaatacttaaacaactgaagagattagaatttaaagacaagtgtatgatatgttttgaaatacaatgtttctctttccagttttggtttttgtcagcagcaaataatgataagactgagttgtttgcaaaataaactttagtcttaaacttggcctgattatttgcataaagtgcagcaagaatattaataataattctgtaggaaaagcctgcaagcaccaggagcttcacagtctaacactatgagcacgtgcatcctcacgcaactcactgaatatgtccaagtcagcctgttccgatcttaaatgccatccagtggcatctgccccaggtacactaatacatgggtcctgcttctctctgcagccgcctctctcctcagatttcaggttttgtgtattgtttgttttctctctgacatcaacacagatatgttgaaggttttcttttttttatttgtagttgttcagctttgttgttaatgaggtcagaataagctcatagtttacacatttttacattcccatgccgagtagctgcttttctctatcaaatccattaactgagagaacaatcacatttcgttacaggtgaacagttaaatagtttggcatatatttctgtgctggaatctaatgcagcttgaaatcaagtcatgcctcactcattgaaaaaaacatggctaaattctcaaagaattgtgctgagtgaaagaaactaaggaatgaagagtaaattttatatgatacatttgtagaaattttagaagatgccactattataaattaacatggagaagatttaaatgtttctgagaatatgctattgggagtaatggggatgtgagttaaatttcagaggaataagagaaagatttagggattaatttattcaaaccttgattgaagtgctgagtaaatggttgcaaacataggtctacatttttcaaatcattcaccataaatttgaattatttattaattacactcgaataaagcaataaagaaactgatgagataatatttgactgaattgcagcaataaatagatcgatattaacacaaggaatataactgacttccaaaaacatacacatgaaccgtggttcactctgcgtatttaggtaaataacagaaagttgtcataacagatggggaatcctgcagacttcactaggcatgggccatgctgccctggagttgtctcaggggagctgcctcctccagaggttagagcacaggcccaggtaataggactaaatttttagatgtgttatcttagacacactgcacaactgctgtgttctctatgtaaattatctcctgtaaaatataacattgaagcctgcattaaatatattgtgtaaatatgtaagaataaaagaaagttatgagagctaagtgttaatcaaggcacaagcatataagatataactatattttcctgaatgatggaattactaccagtctcccccaggacacttcatctgccctgagcccagcctctcctcagatgtcccacccagagcttgctatatagtgggggacatgcaaatagggccctccctctactgatgaaaaccagcccagccctgaccctgcagctctgggagaggagcccagcactagaagtcggcggtgtttccattcggtgatcagcactgaacacagaggactcaccatggagtttgggctgagctgggttttcctcgttgctcttttaagaggtgattcatggagaaatagagagactgagtgtgagtgaacatgagtgagaaaaactggatttgtgtggcattttctgataacggtgtccttctgtttgcaggtgtccagtgtcaggtgcagctggtggagtctgggggaggcgtggtccagcctgggaggtccctgagactctcctgtgcagcctctggattcaccttcagtagctatggcatgcactgggtccgccaggctccaggcaaggggctggagtgggtggcagttatatcatatgatggaagtaataaatactatgcagactccgtgaagggccgattcaccatctccagagacaattccaagaacacgctgtatctgcaaatgaacagcctgagagctgaggacacggctgtgtattactgtgcgaaagacacagtgaggggaagtcattgtgcgcccagacacaaacctccctgcaggaacgctggcgggaaatcagcggcagggggcgctcaggagccactgatcagagtcagccctggaggcaggtgcagatggaggctgtttcctgtcaggatgtgggactttgtcttcttctgacagttccccagggaacctcttaaatttagaaaactgtgcctaacaatgtcttctctatgcatatgaggaccttttctccctggcacaaaatgcagattgacgctgacacggatgaaaattcctcaaccatggtcacaaggatcagagtcctgagtaacctcagggcttcctggtgagtcttctccaatcagacccaggacagggacctccgtgagattccctgactggaacagtctttatggatcctggtcacagacaatagagaggctgaaccagggtcagcgtcatgtagaacctcacagatttcacgtctgatccttctcctgacacgaaagtatgcaaatcagtatcagcaccgatctggtgcttcttttgttcctaatccatttactttattttttcgtcgtttttctcctttttccatttgtttttcctgctttttgcaaaaggaagatgttttccctgtgagatgcaggggatgacaattttgggagatggctggaacatccaatatcctcagggccggccatcagtaagtgcaggctggaagtctcagaaagagctgaagctgcttaatcaccgtggagttttaccttctccagttctgctctgatggaatcagggccaagcaggttatcaatgataatctacctaacatagagtcaaccgattccagtttcaataacgtctgttaaaaattcacaccaccacctggattagtgttttgtcaaatcaatacacagtattgtccagctaagtagacccaaagacggaccgttgcccatggagaaaaacattaacctgagttctaggttcttacagtgttaaaggtgtaaaactgattattaaaaatgaggctatttttctttttgctgttgagttgtagaagtttcttttccatttggacattaaaactttttgagatatatggcatattatccaattctgtaagttgtagttacttggttgctttgcagaatctttttcataatctattcccacttgttcaattctgctttttttttgtaggtgatttgaatgtaaaatccagaaaaagattgctaattttttgagggttgagagttttacaattacaggtattaaagttagatatttgaggcatttggagtgaatttttgtgtttattctaacctaaaattcttaattcttttcatgggaaaatccagttttcataccaccctctttggaagacactacaatttagccatgttatattgatggttctcatgctaaaaatcagctcgtcatcaatatgtgggtttatatctaagctctgtataggtatttatgccaaaactttctatgtttttaacaaatgttaaggcctggaagtgaaatgcctaaagctttcttcttgccttgttacagatattggaccaaaatattctaaccttttactattgagtgtaataatagctgtggcctttcttaacggcttttattatgttcaagttgttttcttgtcttcctactttgttcatagtttttataatgaaactgatttttttcaaagtctttttctgtgtctgatgaaatgttactgaggtattttttctttagttttttaatgtggtgtaccaaattggttgatttgagaatgttgaatcaagtatgcatctcaggaagaaatttgagttggtcatggtgtatgtcttctaaaacactttggagcttagtttactattgttggggattaattcatgtctactaatgatattggtctgtagttttcttttattgtggtgcctttgtctattactggtaatactatcatggtagcctcatagaaagagtttagaagatatatggcagactacctttaaaatagattttatcagtggagaaatggtgatagttttttcttcacttttctgttgggaagaattttatgttgtttaaaagatattcagaatgacttaacctggtttatgagctttcattctattcctttcttccattctttttgaagaactgcttaccttttccttttaatttttaagtttgtttttagacatatgcaatacattttgaggtgaaacctggtggaattttttctaataaattagaaaaaaataaatcatttaattgactattttattcaggttgatttgtttaatatttgctaaaggccagttctttaagctatgacacataataaatcccaaatggcagtacctcattgtttacttagcttttgtacttatatttctcagaggaagaaccactactgtaaattgtaaatagccaatacataattgtattgtatgcaaatctgtgactgtttacagtgtcatctctgagaaacataaagtttatttactatatatatataaagagtttggaaggtggactcctcaccaatttttgaaagagttacagaagggctggcattacttctttaaatgttaaggttcattttatgatgtgacatataacccatcatggagaatgttcaatgtgttcttgagaaggatgtgtattacgtgactcttggttggaaggttctgtaaatatcattcagataaatttgttcaatagtgttgttcaagttcagaggcacattaggaattttctttccggatttgctatacattatggtcatgaggtattaaggtcttgtgttatttttgtattgttttctatttctttatatctcttacagtttgcttaatgcagttatatttgtatttgtacacatgtgtaaaaacaaaaatcataattgctaaatgagttttatggcacagtcacattataagtaatatttttccaaatgctaccattgccactaaactcctcctggagtctgacgtctgctttgggcactgccttcttctcaggcatcccacactggagcttgctatagaggaggagggagggcccctctcctggtgaaaacaagcccagacctgaccctgcagctctgggagaagagccacagccctgggattcccaggggtttccatttggtaatcaggactgaacacagagaactcactatggggtgtgaattaagctgaatttttcttgttggtattttaaaaggtaactcatagggaactagagtgagtgagagtgagtggatatgagtgagagaaacagtggatatgtttgccagtttctgaccaggatttgtttgtattttcaggtgttcagtgtgaggtggagctgatagagcccacagaggacctgagacaacctgggaagttcctgagactctcctgtgtagcctctagattcgccttcagtagcttctgaatgagcccagttcaccagtctgcaggcaaggggctggagtgagtaatagatataaaagatgatggaagtcagatacaccatgcagactctgtgaagggcagattctccatctccaaagacaatgctaagaactctctgtatctgcaaatgaacagtcagagaactgaggacatggctgtgtatggctgtacataaggttccaagtgaggaaacatcggtgtgagtccagacacaaaatttcctgcaaaaagaagaaaggagtctgggccaaaggggacactcagcactcacaaaacaggtgcagccccaaggcaggtgcagatggagggagggtaagggctgctttccttcaggatctgtggtttcctctgcttctaatatttcccctctgagcctctgtacatttatattttgtgcccaccatgaggtcgctggattagaaaactaatttgaaagaggaaatattctcatatgtcctaaaaacagatgtaagtattggaggcataaaaatgcataggagccgggtgtgtctgtagacactgccacccccaatgccagacccacaactagtgctggagaagggtgggagtttgatggagcttccctgatgaccccgtggtccaagctaagtccagcaaggccattggtgcctcgctgagcacagttgtccatcagggatctcccatgtgtcccagcagcagccatgcctcaatctctccactgtgcacagccattgtctgggaggagctcccaggatgggtgtctttggcacacacagttgatgggtgttagagtgcagtgcagcagctggctgcctggtctattgggctcctggatattggagggatttgaggtgcattctcagggccagcacgctttgtcaatttttatatgaaaaccatgtgatttaattcattttctcagatgacatagataattaataacacaatctgcaaacaattataattttcaactttaccccaagttcattgtttctgaattctgtgcaggatccagacatggtactgcccttctcatgagaaactgttcgatctaaactgaaaccagttgtttctcgtatactttggttctccccatgtgcagagatcttgattagagcaagtttggtactttccacgcactcaccctcacctccccagataaagagcagaagttctccttagactgagtctgagggaggagctgttcctgtaccactcagggcctgcggagacccccaggtgcagcttcactgagtcaggtgtttcactccctgtgattgctgctcaggtctaattgtggctcggaattaggacagtcttcaggttatcacaggtcaatcatattctaaaaatcatcgttatcacacaccatggtaacaattcaaggttcatttttctaacggcagtttctcttttttatttggttgcaagtttgaggaaaggaacatgtgataatactttttaacctaacctcgaaatctactgaattgttctaggagactcacaaattggacaaagtgagctctttattctcataaaaatgtgtggttttgggaatttcactgtgttgcccagaacctgttaacatcaacaactatgtttctcagcacacttctggcttgagacgtccttgcagaccctctccctcacctgcactgtctctggattccccatcataaccagtgtttcctgctagaattgtatctgcttgcccctagaagatggacaggagtggatcaggtgcatgggttgtgaagggagcacaaattacaacccactgctcaagagtccatatccagatccaagaaacagttcttacagctgagctctgtgcccagtgaacacacaactacgcatttttaagcaaaagacgcaatgaagggccttcattgtgagcctagacacaaccctccctgcaggggtgaataggagcagcagggggcattcggggcagtatgggggcttaggatgattgttaggggtcaggatgagcaggatcaaggcttcgcatcagggcaagtgcaacagggcagaaaaggggctgtagatgtgggttgttctcaccatcatatttcaccaccagacaccctccactacatctcttctaatgtgtctgagtgttgatatgattagaaaatggcatttatgtaaatactaatatgtacccatatggaggtgcatccagttgtcttctccatcttatgtggaccttgtccatcaagcactaagtccctgtatttacttgagtacctcacacattatggtcaaaacaggtagggtctccttttggcatggtctctcctcctgccttctctcttctgtcacacaaaaacacgtgaactgacacacacacagagcttcccaactttaattatgtgatgtattgaagcaaattgattagtgtgcagcttttctgctttgcctgctattcatgttatgtaaaaataagaaccatgtttttctcagcttgtcacttctctaagctaagtagcatctttgtttattatacccagagaccaaaagcgatccaactgttattcagcagcttaactggtaaacaaattgtggaaaattcacttactggaatcatacccactgctacaatcaagtaatgctggatacacccaacaccatgcttaaaatagcaagtacttgaataagtaaaataagtcagacaaataaaagtgcatacatacgattccacttctataatttctataaagtaaaaatgaacttaaagttacataaaaagatctgtagttgactggggacatggtacaagaagagaaggtatagaaaggagaaactacaggagaacaaaaggaaatttctaggataattgatttttttctctgttagtaaaagtgaggattatgtcaatatttgtaaaattgtacactttatgtaaagattcttatttgctaatttcacctcattaaaatattgcaattttttaaatgtctagtttggtagaaaaggtagtagagagagatgaataaaatacataaaaatcagagagtcctgaatacacacatgaatggaccctgggtctcactgtactttgagggagacactagaatacaaaaacataatgacaggatttcagtacatgaaaggagcttctcagaccccaggaggcatgtccaactgcgtctgggagttaactcagggagcaggcatgtcctttggaaggagccgtgacaccaagctcccagcatccattgtagccgacaccatgccaatgccaagagatctcaactaaaattttctgtggatgttgagtctgattatgccacacactcacaccaagtgagtatggaaaggatagttacctgcatccttaaggtgtctgctgagagcagggcaggtctctcattaaggtccaaagtggcttgatagggcagggaaggagactggctcagggttgttatcatggtttggtggggagcggggcagagcatcctacttgcaggaagggttttgtggggtttcaaggccaaattggcatcaaatgagggagctcctgtgatttctaactagatttaccttgtatgcttaaaaaaagagatgatggaggaatgagcctgaagttatcagcagtcaggcctaaacacagagtctgatgacttactctaaatagcaagtatacaaatgatgagtaagaaaagagacaagactccaatatgggtggacaacagccaggtctgcagaaaatgagaagactgtttataagcaaagaataatgagtaggatatggaggaggattctggtccaatgtcttgtgtggaagcttctcatgatttgagatcatcagcttattctgaaggtcttaggtcacctgtcttcttcaaaatatcagaagtgcctgatgatatgtgaggatgcgcagtttaacttcctctatttgagtagctttacaattgtgtaaaattcttaattaattaatttttttttgagacggagtctcactctcttgtgcaggttggactgcagtggtgtgatcataacatagctcacggtgattttaaattcctggctcatagaatcctcccacctcaacctcctgactagcaagtagctaggtttccagggcccttcatctacacttggccggttctttacattctttttttttttttttttaggtggagtttccctcttcttgcccagaccggagtgcaatggcgccatctcagctcactgcaatctccccctcccaggttcaggtgattctcctacctcagcctccagagtagctgggatcacaggcatgtgacaccatgccccgctaattttgtatttttagtagagatgacgtttctccatgttggtcaggctggtctcaaactccctacctcaggtgatccttccacctcagcctcccaaagtgctggaattacaggcgtgaggcaccacacctggcctcttcgtttttattcatatattccttcagcagccactatgtcttcccactgatttcttcagtttctgccttttccttttgaataaggctgttactcctgagggaagatgggaggtgggcctggacagggacttggtgcattcctctctcccctcccagttcttattggtttctccagtgtctgtagaacagtggttttgatggctttacctctgcagataatttctcttgcaatgtagtggtgatggggaggtgtgtctggatgcatttcagctgtagttgctgttttgctttcccagacagcaccatcccaaggggtagaggctggagcattttgtgatgtatccccagtactgaagaaaaaggcttcaatagcaggaggaattcctcaactgcatacactctgagaatttaaacaataacttctctatcacactcaaattgaaaccacccaatgaatatgtctactttaatcgtgtgctaacttaaatgacatttggcagcctctgtcccagaaaagattatcatctgctcctgtttatttccctgcaagtctttatgtctgttcagatttcagatatattgtttgtcctataacatcaaaaatttgatgtatatatgctaatttgcagatcagtaagtttagtatttgttataagaatagtaacatatttttatggggtgcttacatctccaagctgagaagcacctctgtgtaatactaagcaactagaaatggtacaaataccaagaagacacatagataaacagtaatggcatgctaatttatggtaataacatccatcattagaatcaatacattgttgatgctcaacatgtgtgcatcataagtagttatgtgcgagaagccacacaaataaaacacatactatgtaattcctgtataataaattcttgaaactcaaaactaaggtattaaatgtgaaggactgactcagaatatggtggaggaagaaaataattgggaaggaggaattgtagaggaacacaaggaaacttttaagtgtaatttgtttattcattatttggatggcttttggggatgcacaggtgagcacgagtggaataacattttgttttgtttgtttgtttgtttttttctgaagagatgtggtcctactctgcgacccaggctggagtgtagtggtgggatcatagttcaatgtagcctccaacttctggtctccaacaatactcctgcatctgccatctaagtagctggaactaccgttgtttgccagcaggcttggcttgagtacttattaaaccgcacactttttgcaatatttaatgtatagtaataatgtctcaataagactattacaaatcaatgaatgaataatttgttctgtacagatttatggaaaaatagacactaacatgatgaatgactgacatttatgaaaatacagctgcatgaaatgtgcttctctttacattcattaggtaaacacaatagtgcatacacatcacaccgtgctttcattacaggaagaaacatctgaaaatgtcactggggtgaaccatattgtgctgggcttggttcaggaagcagtcaggcccagtgttgtgaccttcaaccacagaatcctaaaaaataataaaagaggctcccccaaagtccccatcagttcctggactcgccatgtgtctgggccgtatcagtgcatccggagctccctggtggctttagggattccttgcttgccatgctgaggtctcgctgtagattatgttgggttttctgaggccgttttgctatttaagacccactccctggcacagagcgattccctctaaacctgatagaggttctgaactacaaataacgttaagtgaatcctggtgtgtctgaactcacatgattgttacattaagctgctgttgcaatctgtttcctcacctgggaaaagaggagccaggacatagtgagttgaggccccaggaagataactgaattctcagagggcacaaccagcatcctccttccagggagagcctaaaagactggggcctccctcatcccttttcacctctccatacagaggcaccacccacatgcaaatctcacttaggcacccaagggaaaccatcacacatttccttaaattcagggtcctgctcacatgggaaatactttctgagagtcctggacctcctgtgcaagaacatgaaacacctgtggttcttcctcctgctggtggcagctcccagatgtgagtgtctcaaggctgcagacatggagatatgggaggtgcctctgagcccagggctcactgtgggtctctctgttcacaggggtcctgtcccaggtgcagctgcaggagtcgggcccaggactggtgaagccttcggacaccctgtccctcacctgcgctgtctctggttactccatcagcagtagtaactggtggggctggatccggcagcccccagggaagggactggagtggattgggtacatctattatagtgggagcacctactacaacccgtccctcaagagtcgagtcaccatgtcagtagacacgtccaagaaccagttctccctgaagctgagctctgtgaccgccgtggacacggccgtgtattactgtgcgagaaacacagtgaggggaggtgagtgtgagcccagacacaaacctccctgcagggaggcggaggagccggcgcaggtgctgctcaggacgagcagggggcgcgcggggcccacagagcaggaggccgggtcaggagcaggtgcagggagggcggggcttcctcatcagctcagtggtctccctcctccccagcacctcagctgtccccaggactcctctttctttattatctgtggttctacttcctcacatccttgctgcaggttttaacagtcactggcacccttttttcaacaaattcccacaaggcccattttaccttcttgacaagcaaaatattctaaggcttctcactatcccttgattggcgtcatctactgcatcgtgtctttctcttaaattcatgtgatgaaaccccaatcccagtggctctgtattggacagagggattttaagagggcaaataagttaactgtggccataaatgtgggaccctaatccagtaggactcttgtccttatgagaagtggaagacatcagaggcctctctctccacatgcacacagaggagagtccatgtggggatgcgctgcatgagaaggtggccctttgcaagcctggaagaggcctctcaaaaaacttaccctttctgcacccagatcttggacgtcaagactccagaacaataagaaaattaatatttgttatttgaaatagcctagtctgtggtatcttctcatggaaagccaagtagattcagagattcaattgtgttagctccgtctcctgcatggagtagcagcccaccgaggctggacacatctctcaaattattttcataaagaaaaatagatccaagatgaaaaccccaccacatttctgctgagccattcacttagcagcagtctctgagatcagccctgggggtatgttctaggtcgtgtatctcactttccactatgagaatccatgtagataatgagaaccagccagatggagtcctgatccctgcccaccttctgcttccccccaagtgacacacggtcacagaaaaccactccagcatcaccctgtgtcttgtactctctaaaatcccactaaagctgaccctaaactaggagctatttggggctggactcattctgttcttagtcttccataaggtccaggtgccgagtagagcctcagtaaagagtgagcttcaattcccctaacccacatcattcccttacatccttgtcatgcacctgtcctctgcaggcacccagggcaggttacacaggaattgcctgaagctggtctcaggtgccctgctgagaccactggttatgcacacgtatgatttcaggtcatgcaggctcttctgcaggacagacctgtgtcctgtagagcacagacacttggtgacccagggcctcctctaataactcatacatctcatgtcagtgtatatccaggtggcccctcagtgcagcacactagggtgattaccctcacaggtggctttttcaggcggtgaacagaaaatggggtgggcacgctggtcattcccatcatcggtgatatccaagtgaattttaaataaatgaaacaaaactaacaacaaaggggaaggatatgtacctgtatctgggaggtagactgggtcccagaactgtactgggagtgggtgtgaaaggcccttttgtgtgggaagccctccagcatgagtgaaagctgaaggaatgatcactgtaggtggaggctgatggagaagctggcagggtacatttcctgaagctgttcccgggtgcgtgatggttcaatggcccatgtacatgaagaggagggctggactcatgtaggatcaaggaaactaccccatggcaatggaagaaaagaaaatggagatggacacccctggaggcagcttattagctttggtggaggaacgatgggaatttattccaatgaccccagcattttcagctaaatatgagttgcattaacagacagaattatgaagggaagggagaaggagtttatagagggaaaaagcagaacagaaaaaaagaactatgcaagtctatcaaatggcagatgacagagtggagctgatgcagctacttcattcttcccggaacctaccagagaccttggcattcctgtaaggcaggtctagtggtgatgcacttgtccactttttgctttttggagaaacgtttgaaacatcctacattactgaagaaaagctttaattagtgtaatatttttacttgacagttttattggttttgttttattttcagcaacttgaatagaatcatgcacatcatgatatttgggtgaacaacaggccacatacacgataatgatctcattaaattataatactgtattttcactgcatttcttccatacttagatatgttcatatatatacatacctaccatggtgattcaactgcccacagtattcactacacttacatgatgtacagatttgttatctaggagcactatgctatcccacacagcctgggtgtagcagggtatttcacgtaggttcacgtaaacacactctatgatcctcgcatgatgacaaattgcctaaggacacattgctcagatgtatccctactgttaagctacacatcattgtatctcatctctctccatttttggtctctgataaaattctcgtgttgtttttgcattcttctctgagctcattgaacacatttataaggtttcctttgaattttctgccaggtaatcaatatacctccttttaatttgtgtcagtttctagtgctttgctttgttacagaatttggactgctttttttctctttcattattattatcactttgtacattctctgttgctttctgctcattagaaggaaaagccatggtaaccactcttcacagaatatgctcagggcaaatgccatcacctgttagcccagtccatgatagtggtgtctcttaaaatttcatactggtccaaactttttgttgttgttgttagtggcactcagacctatagaggattttaagttttcccctactctaaattaggtggcatcaaaattcatcctgcaggcagtctctgataaagtggagaaattggacaaagttttagcatgtatatggttcataaaaataatatgagtttaaggttttctcagccagttgctacatattgatattttataatcatttctttgaatgtctctggagtttatcttttgaaaatttagatcagaatatataccaggtttgaggcttcttgtctggcttaacgatctcctataggtcagcgtgtgaaaaggcacagagtctatctgaagaggagaactcagggaagccccaaaacaacagaggagacaaaactgaggactttgaggaatctaaagcttctgggacctgcagcctccagacatgctcagcaccctcttgttatccacggactaatttctttctcttttctgagtggtattttctagggttcccgtcctccactttgacactttggtatgtccatgtgtgtccattgtgtttcagccagggacacagaaccaggaaaacatcatggcttttctagagggagctgacctgggtaatcaacagttggagtagaaagtgcctttgtccatgtgtcacaggcctaagggccatgggcaggaggtcaggaagagaggatgaccagacggctggggaaaccaggatgaacaaagccactctccttcctggtgagaaggggcatgtggaagcctggtgtccctgtagggctgaaccacactcacctgcccactgctacctgccagcgaggtgacccacagagcagcagcagctcctgagtcactcacagaggctgcctcctcctccaaaccctccagtgtatgtgcttccataagtgtgagccccagcagatcccaaagttttcaatgggttcatctagctagtgtctgtcctcagccccatccccaggctcctgccctggttggtgtccacagtgtcccagcagcggtgacagtgacagccagggcctgcactttccagagcagcaagtttggaagaatcaagtcccagaaccagcctggatttggggcaaacacacaaatttcactctgaggggaagtgctggaaagtagccttgagtcttcctcagctcacctgtggctgatcctctgcatcccatcagcgatacatgagccctccccaaccccagcgtggagctgtttcaatcgcagcaggatgggaatgtgtcttctttctggggactttttaagcacagctcttatgttcctgagatttgaggtttataaaggtgtgtcagtcacccacagagtggacctgcacaagtaagacaaggacaggatccccaggagaggcacctcatatgagacgggacaggcaggtcccatcacagacactggtcctcagaaaccctgaccagctactcaccttcccaggtcacctgtgtctgatcagttcctgtgtttgctcctgaaaagatccccatcaagggtccccaggtcctgcccccttccttgatgtgcctctgggagtggggctggctgggctgtgggtctgctgtgactttccccacaggtcagcggctcagtgcaggctgcgccaactcggtggggctgggctgtggccgaccctcccagggggagcctggatgcttctcgggggcatctgcaggatcccaggttctgggagaacagggaagccacagtgtgtgcagggccccatctccaggtgtaaagtgtttgctgtcactctgttgacaagggcatatccccaggcctaggggcactgtgggtgcacaaccaatgtggtagacacagagagtaaggcacatttccctcccattactgtggggaatctaggcactgtgtgtgtgtgtgtgtgtgtgtgtgtgtgtgtgtattaggagttttgcagtgggctctgagccccgtgattttgtaggtttagaaattatctgatgagatgttcatccacaggaaccgacaagagattaggtgttctcccaaagcccctgggagctcctggactcattgtgagtgtggactgatccattgcttccagagctccacagaaggggctccctggtggtttcatagaatccttgcttggggtctttctgcagagttcactggctttcctacggccagtttagtattgtaagagatggtgtcagcagcacatggtatcacatgtcactaaatgagcattctgagccaggacacagcatcttcatactggggggagggaaatgctttgggagcccagacaggagcctctctgcagtgcaagggctgggctgcagggggcgctcaaggcccacccatcacaggctccacccccagagcaggtgcaccggaggctggggagggattcctctcaagatctgtgtcattcttctaaaaaaaatctaaaatgagtatttgacaaagactgctgaacattctataaatatcctattcaattgtgagcatttatcaaatttgatgttgtaatgagaaccacttttatactagatatttctaaccctgctagatatcttaatagtatgcagctggaggttaagcaagcttttcttttatataaataagtgcaactttggagaaacacactcatcccccgaataagacattcatgtattaaagcctagaaatactttaaattacctctgagccattcaagtgtgtgttcacagtgaagtcctgttctagggaaaattgttctccagggggagaagctttgtcaacatagagcttagggatgtatcaggaggcacatgacctctaaggggattatagcttgaacccttagcatcctcctgttggtaatacatgtgtcactctccaatctttctcatgcagtatcaggtatgaaataggatcgctcatgaatatgcaaataactgaggtaaatatagatatctttgtgccttgagagcatcatccaacaaccacaactctcctcagaagaagcccctagaccacagcacctcaacatgtactggacctggaggatcctcttcttggtggcagcagcaacaggtaagggacctcccagtcaccgggctgagagagaaaccaggccagtcaagtgagacttcacgcactcctgtctcctctccacaggtgtccactcacaggtgcagctggtgcagtctgggcctgaggtgaagaagcctggagcctcattgaaggtttcctgcaaggcttctggatacaccttcacaagctatgctatcagctgggtatgacaggcccatggacaagggcttgaggaaatgggatggatcaacaccaacactgggaacctaacgtatgcccagggcttcacaggacggtttgtcttctccatggacacctccgtcagcatggcatatcttcatatcagcagcctaaaggctgaggacacgtgcaagaggcacagtgtggaaacccacatcctgagagaaccagaaatcctgagggaggaggcagctgtgctgagctgaggcagtgacagggacaacgtggctgcaccctttgttgacatagggttatacacatacatatatatgcacccaacactggagcacccaggtatatcaagcaaatacaattagagataaacagagagatagacccaataccataatagctggagactttaacaccccactttcagcattggacagatcttccagacagaaaattaacaatgaaatcttagactaaatctgcatgacagaccaagtggacataatggatattgatggaacacttcatccaatggctgcagagtacacaatcttttcctaagcatatggatcattctcagggatagaccacatagtagaccagaaaatttgtcatttttaattaaaaagatatcatgtaccttctctgatagtaatgaaagaaaactaaaataataagaggaattttgaaaacacatggaaattaaacagtatcctccttaattaaacaatgtgcttccaaactgaactatatgctctaaaatgggttaataaagaaacaaacaagaaaattttacaatttattgaaagaaatgataatgaaaacagcgtatgaacacctatgaaatacagtgaacatagtactaagaggaaagttcacagctataagcacctatgttaaaaaagtagacaattataacataaacatcttaggaatatctctcaaaaaaaactagaaaagcaagagcaaatcaaatccaaacatagtaaaataaaaaagttaagatcagaacgttaataaataaaattgaaataaataaaacaataccaaagatcgatcaaatgaaaagttgttttttaaaaagataaaagacatctataaacctttaaccagaccaagaaaaaaaacaaagaagaccaaagtaaataaaatcagaaagaaaactggaaatattacaaccaatagtgcagaaaatcaaaggatcattagaggctactaggagcaactaaatgccaataaatcgaaatatctggaagaaaaggataaatttagagacacatacaacctaccaagattgagccaggaagaaattgaacagatcagtaacaagtagtgagagtgaagccataataaaaggtctcccagcaaagaaaaaacccgggacttgatgacttcatcactcaattatgacaaacatttaaagaagagataatacctaatctcactcaaaatattccaaaaatagataaaaagtagataaggaagggaagaattcttccaaacttactgtacaaggccaatgttacccttatatgaaaaccagataaagccataccaaaaaaaaaagaaaactacagttcaatatcactaatgaatatggatgcaaaactcctcaaggaattcttagcaaaccaaattcaataacatatcaaaagagcattcatcatgaccaagtgtggcttatcccagagatgcaaggatggttcaacctatgcaaatcaatcaatgtgacacatcgtatcaacagaatgaagggcagaagacgtaagatcaggccttaccttgttctcctcactcaaagtctaccattagttctttggtcctcttgaccagtcctgctgtacttggtctcccgtgattctgttcccaggtcctgaaacactgggcttctgcacacctggagtctctctctttgaacatggagaccctgtatcctcagagagggatgatgcctcattgtggctcccatgccccatgcaaacaattcttccaacacagtcatgatttttcctgttggaaattgaaaggggatgtgggaattgatgtgtgtgtgtgtgtgtgtgtcctcaggcctgttgggcctgttgagaacacagcagggctctatgtacaacaggaaagcaatgttttctctataccatctattttcttataaagtgttcataggtaatcaaaaggaaatgaatcacagtttataagatgttgtggactggactgatgttgtcactcaaggctactatgggggctccaggaaaagaaacctagaaaaggataagactgtgagcaaagaagcaaaacctgggaagcagcagggagagggtgagcaggggtgactcaactggggagggataacaccacttaccacagagggtgaaaactccgtgctcagcaaagaggagaacttactcagcatttcccctaatcctccctccagaagcgcgactgccaggaaagttcacaatgtatcatctccagctgggaacccaaaagaaacaggagattttagggcataggtcctgggcacaaggtgtttccctggttcctaccccttccctctctgtccagcaaaactgcttgtttctatcacttgccttcctgtccttggggtaagaatggatgctttgacactcagcagagggatgctctttcagaggaggaatgagtttgtgttatctgatgtctgagcaggacactcacctctgggaagaggctccaagacagaaggtcgccgtggttcctgccccttatatgtgaggggctcttgacacatgcacacttttcctcaaactctgtttataccccagcaacaatgctgggtgttgtcagcctctctcctccccagatactgctctatcatcagcttgagcacagtttccccatgaaaggcattattctctctctcaagaagatcaactttttacatgtcttcgatggatgacagtttttctgtgtgagaatctagaaataagaaatggggtaatggggacaagtgagctctctgtgtgactcactaggaagtccactgttattccaggtgtcctgtcccaggtgcagctgcaggagtcaggtccaggacccatgaggccctcagacacttccctctgcctgtgctgtgtctggattcttttttttaccatggatattatttgagatgaatccaccatcccgtgggcaacaggctggaatggctggggcacagttactagactggatcatcaaggaatacacatcatgcaccctccacccaggtccatgtccccatcaacagtgactcaaccaagagccagttctctgtgaagctcagctccatgaccacctaggacacggctgagtattactgtgaaagactcagtgaggaggtgtccttatgagccctgacacaaacctgtcagggcacttaggacctccaggaagactcaagaccaccaaggggactcacgaccactggggaagggcaggttgcagtaagcacagggccagccccagagcaggtgcaggtggagatgagaggctggtttactgccagggtctggggctgcttctccatttagatgtttccttcagagaccctcccttatttcatgatgctctgcttagctgtaagtctctgaaatatcacagttttgttgtaccaggaggaaaccttctctcaggtgctaaatgtagaacaatctctctgccagtggttgccagggtcacagccctgtggaagctgaagggtacccagtgagtcttctccagtcacattcaggacaggaaccttagtggggttccctgaggagaacagtctttaggaattctaacctcagccaagagaggctgggccagggtcagtgtcaggtagaacctcacaggatttacgtctgacccttctcctgacactaaagcatgcaaatcagtatcagcactgatctggggccccttttgctcctagcccattctatttcttgttagttgtatttgttgttgattttccttttgctgttcctgatccctgtaaagtggagatgtggttcctgctgtaaaaattccagggctcaagccctttccctgcagctcaggtggggctcagactgtggctcctgcaaccacgtgggagaggctgatgggactatcttctctcccgttgctcagaaccctccagtgtgttgtgtggagactcacctgggaatgcaagtggccaatagttgtgaaaggtatgcgcttgtttggtcaaagtggaatgtggatgtggaatttatcctgtgttgtgcaaactaacacaggttcaccttcctcacctgtagtgttagaaagagtgtgaaagttgtaagaatcaaaacagagccacttgtgttaacaccctgacaaatggacctaggaatgaacatgaaggagggttcttaggcccatattcctgataacaaaaactatcataaatagactctgcttagccaccatcttggatagaagcccaccacaaccttattaaaaattacacttgcaagaacatcagctcagaaactggctgttcaaccttacactgatgccaccattgctattgattctacaactatatgataattatctcaaaacaacttttgtaacccacctcattttcacttcataaacctgtggattgacatgttggagttactgctgcatttgtagataatgataaataataaggccttttaacaatgtttgaagctgctattctctgatgtctcttctaaaataaagaatttccaagtggatgacaatgaaaaaattgttagaaatatttggtggtaaggcatctttaacatcctgttgaatgtttctgcatagcacatcaatcccttaaaatactttgctatatctgcatttaatgaatgagtctaatattgaggtgcaattgaaaatacctgggcctttgatgaatcagctcatagggtgataatgtctgggtccttgagaaagcagaccctgtgttgtaagttttagtagaagtaccttttgcaaagaaagttcatgtgtttctgaacattatgctacttttaacttaagaatgcaatatatgatttatttttacttcaaactgggtatatacccagtaatgggatcgctgggtcaaatggtatttctagttgtagctccttgaggaatcaccacaatgtcttccacaatggttgaactaattttcactcccaccaacagtataaaaatgttcctatttctccacatcctctctagcagctgttgtttcctgacttgttaatgatcaccattctaactggaatgagatggtatctcatcgtggttttgatttgcatttctctaatgactagtgatgctgaacattttttcatttgtctgttggctgcataaatatcttgttttgagaagtgtctgttcatatcctttgcccactttctgatggggctgtttgttttttccttgtaaatttgtttaagttctttgtagattctggatattagccctttgtcagatgggtagaatgcaaaaattttctccgattctgtaggttgactgttcactctgctgatagtttcttttgctgtgcagaagctccttagtttacttagatcccatttgtctattttagattttgttgtgattcatacttggttaatttttaattgcattgttttcttctgattagttgtaagtatacctgcatattgatcaaaaaagccgtttaacaaatcaaaaggaaacatttaacaaatacgtgacttggaagtattttctccaagtctgttgttgtcttttactcccttgtcagtgtgtattgcagaaaaatatgtatgtgtgtgtgtgtgtgtttacaaattaaagaaacaggtataatttcatttatccatagatcacgtctttggcattacatctgaaatctcatcataaaatatactaatagtgatttttttttccatgtctctaatctcaggccacaatctactcatgagtgtttaaacatcacctacttgattagaggactatcaccctaagatatttggaatatttctggaaggagatgtgttctttttcccattatttctctatttagtcatttattaatatccgtattggtttatgaatgtctatttcatactctgaagtaaatccatgctatattattcattttattgttcaaatcaccacagctttattatgtgcttggaactcatttagtttggatgctgcatccttacagcacacctcatcattttgtttttgaacactttcctgtttcctggtattacaatacattctaagcccattttctatattaactttttcatacatagaatcagacatttttctaaagattgcttctttctgatgttaaaatatagtattaaaataaaatttgtgatactgggtatatgtgttgttaatgtggtataagtacttttaggacctctcaaccaactggcctagtaaatgtgcatgtttatatgaactcatgtttaaggacacattgaaactatttatgtatcttatattctgtaactttattacattaaaaatgagaatacactggtctcctcacccaactatgttaccaccatatcgacctttctaggcttccttgactgtccataatcacccactgcaaagtgaggaaccccatcccatcatatgccattgtattacttagctgcacaatttcaggacacatgcattgcagcatcagaaatgtaaagctgtacccttcttggaaccatttttatctactagaatagagtgcttatgtgcagtttctttacactttaaacttatagaatttcctcattttcaaagttccttagatcagcaacttcgttttccactttcttcatgaagtcatttcaattacactgtataatttctttatttgaattctgtaaaagccaaaactacagtcaagtaaacatagagaggatattccaggaatttacagagtgggtatcaaataagttaaaaaggcaatgtttaagaagagtaaaactatttttagtgatatgcaatggttgagacatgacacaattaatttgtctaagctcataattttgtgatgaaaaatataaacctaaatatatacaatttaaaatgatgtttagcagtacattatccctaggatcaaatgcagactgtataaaattatctaataacttatttggtgaggatgccatgagacacatgcaacaaagaatgaactaattttccttatttgcatataagatgttgacattcactaaagatctttaatttaaaaaaaaatcaattttctatgtgacccaggttttttcttccagacaagcaaataacccacaggattattttctttccttgattgagaaagattttccccaaacttcagctcagttcaggcatatactgtccctaaatgggcatttaccctcagatgagtccacacacctgtcaacacgtggagtcttctgtcagacaaacacacctttactgatgtggattcttccctcagacaaaaacacatgtccccacatggacactttcctcagactaccatgtatgtccttacatttacgctttcctcagaaaacagacttttcctcatgtggactcttgtctcagacaagcaaatatgtctccatgtgaactcttcactcagataagtacacatatgtccacatttactgtttccctacacaggcacatatattcaatgttgaattgttttgtggcaaaatgatctcaagataatggtaattataaaccccctccctaataaagtgtagatctgtattttttttgttgtaacctaactttgccttattgtcaaaaacagtaatttgcagctctaaatgcaccagttagagacaggtgtccattttctctggaaatgtatttttattttcttactggacatatttgttgataatgttgctactatgaagatacctgaacagtatccacattaaagaataaaaaagagtaatgggcagaataaccctgtgcatccagacccagaaatcctttgaccctgccctcccgaaatgtagacacagaggatggatgagcagtgctgagcagtgtacccatgaccacaaacatgaagacatggaaatgtgtccccactcctcctcatgaaaggcagctcatgccctcttccttcaggccctggtatggagccaccccatgtctctgcccttccttagtgtccacaccatggggtctgcactgatctggattcccttctcatccccctcaatattagtgtgccttgtgaatcaggtccagctgtggctgttctcagtctgtttcctctgtattcacagaagtcctgtgtgatgtttactgatggagtcagaaggagaaaaatttaacagcccagcagttcactgagactgtcctgcaaagcctctggtttcgggtttactgggtgcagcatgagcttggtccagcacgcttcacaacaggaattggtgtgggtagcaacagtgagagatcatatgggagttctaagggttactctccatgagtacagataaatcaacattcccaagtgacaccctttcaagtgcagtctaccttacaaggaccaacctgaaagccaagggcaaggccgtatattacagtgagggacacaggggagggaagatctgtctgagcccagacacaaaaatctctgcagagagacaggagggaactgcgtggtagatgctgctcagaaccaccatggggtggccaggaaacaaggggtgcttaggacctctagggagcgctcaggacgccaggggggtgctcagaaccactaggggacgctcaggacactaggtggcgctcaagacaacactactgcactcatgtcaccacggggtactcagaaccaccagggggcgctcagaaccaccagagggcgctcagaaccaccaggtggcgctcagcaccaccagggggcgctcaggacaccagggggcgctcagaaacactcggggacgctcaggacaagagggggtactcagaaccaacagggggcgctcaggaccaccaatgggtgctcagaaccacaagggggcgctcaggacataggtggtgctaaagacaacaattctgggctcaggtcaccagggggcgctcagaaccaccaggggacgctcaggacatgcaggttctcttaggaggcagctgcacatcaggagcttcagaggctgtgatttcctttcagaccctggaaattcctgacctggtcaagcaaaagtcttccccaggatgtctgatttttccttttaattccatgatttcttttacctacaaaacactaacttagaacagggatgtaatgcaacttttattgctgcgtattttctgagtaatactagcaatgatctctcgggacaattattaaaataggttatttatatattttaattattaaaaataatactattattaaaatagtaaaattttttaaatcacacttgtaatcccagcacttggggagactgaggcagacagattacttgagctcaggagttttagaacagcctggcaacatggtgagatgctttctatacataaaagaagaaatagctgagattggtgcaaccagctacttaaaaggctgaggagggaggattccttaagcctgggaggttgaggctgcagtgagctatgattgtgcctccacacaccagccttggtgacagagtgagaccctgtcttagaaaaaaaaatgcatatcctcaatacagactatttccatgaatagagttttgtgtttttgtgctgtaatagtcaaacaattgtatatgttttctaactttaactcagcatatgcatggtgttttgtttctttttctttcatctgctgtttgtggaaaataaacagcactttaaaggctctgtttctccactttgtttggcttccagtgtcctgtttttcagactgtttctccaccttcccttcttctttgaaagccatttatcttcctcagtctccatgcagaaaaagaaagtccctttactttctgtcttccaagtctggtgaatcagttcccttcttttcataatcactgaagccaaccaagtttagaagtataacagttctccttagaatacgctcatctacctgcactctctgccctcctcatccttttctaggtccctccagacatcaccctcatcccataccctcccttccttaagtaccacagagtgggctcttcacctcctgctgccctctatgtgctcagccctggggctcactagtcctttgattatgaagtccaaatccctatgtgcttgcacactctcacgccaccctctaggaagctgccattgtgagagagtcctgaaaagcatgggctgggtttagtttcataatgcatattatggtcaattagttattctatttgaacattctatttaattaatagatagagttaattaaatagagttattctatttaattctattaaactattaataaattagttattcaatttattaataacaggccaatatttaaaataaataccattgcacgtttaagtgacatatttgacaataattgcatttacatacagttttaccaaaacatgtatcgaagtgtatttgtttttttaaatattggaataggcagacatacacataggaaaacattattttgtactacaatctcaaactgcaaacacaatttaaatgccattaaataattagaataatatgaaacaaatgggcatggtgttttggtgtttaaatatacattcatttcacctgatcatacttatgtgtctttgctgggctgctgtgcatgtatgtgtatttgtatgaccatgaagctttcagatacatcattaaattacataaagtgttaccatgcacttccctcttttaggggacaaagtaaatctttcagggcaatcgcagggaaaatgtgtggttggatcttccacacagagtccctaccatgacattgccaagtagagctatggaagggggctaccaacctccagaccccagaatggtagatccacaggcagcttgcagctcgagtctggaaaagccacaggcacccagctccaacccatgagagcagccttatgggctgcattagggaagtcacaaaggtagggctgcccaaggccttgggcacccacccttgcaccaggtcacaagacatggagtcaatgattattttagagccttaagattgaaggactgtccgactaggttttggccttccataaaaatctttacccaatttttgggccattttctctttttagcataggactcctcacccaatttctgacccatcattgtactttggatgtaaataacttatttttgatttttcagtctcataggtgaaaggaacttttccttgagtctgaactttggattttgaattaatgccaaaacaagttcagattgtcagggaccactggggagggattattgtatattgcaatgtaagaaagacataaggggcagaatgatgtggtctggatgtgtgttttctccaaatcttatgttgaactgtgaaccccagtgttggaggtgaagtctgctgggaggcatggcattaggggcatatccctcatgagttacttcgtgtcatccccttggtgatgaatgagttatcagttcacatgacagctgattgaaagagcctggtaccactcccttctcttatcttcccccctattgtcatgtgacactcttgctccccttcatcttctgccttgactgtaagctttctgaggcactcagcagaaacagatgtcagcaccacacttgctgtacagcctgcacaactgtgagccatataaaacctatgtcctttataaattatccagcctcaggtatttctttacaattcaataatggacgaacagaagaagtatttaattgtgcagcaaattaggggtgtggaatcattaaaatggacttaacgcctgtagaggtaaagacacaagagtctctctctctctctctctctctctccttgaacccttctctgtctttacatacacacacacacacacacacacacacacacacacacacacacacgctccacgtgaagatgtcatgtgaccaaatagcaatatggtggctgctatgagccaacagtagaagcctcaaaataaaacctatcttgccagcatgtttatctttgaatttccagaattgaggaactgagataaaattaaggttgtgtaagttaccaagtatgattgtttttaatgtttgaactgactaaagagaatttgggatgaagaagtggggttctgatgttacaattatttcaacactgtggaaagtgccttggaattgggttatgtgtaaaaggctggatagttttgacatgcataaagaaatttatatattaagtgtcattctgatagattaaaatgagtagagtgctattggaaactggataaatggtgatctttgttataaagtgacaaaaaaaacttgtctagactatgttgtgatatttagtaaaagagaactttgagcagcaaaattgaatatttagctgagaacacttctaagtaaaatgttgaaagtgtagtttggtttctcctgggcatttataataagaaatagatgaattgaaaatgaaattataagggagaaaatatccaaaacttaaaggcttggaaaattctcaatctatctgtgttgcaaaaatcagaaagtgcgttctgaagagaacagtgagtatgaggctgtaatatcacttgataaagaatttatggtattaaaagagaataaatgcaggttttaaagaacaaggatggagatgagacaaaatggacgaatactgtcagattcttcagatttaagaggatggagctacttggttgcaaatgtgcaccattcttccagaacaaagaaaaataaaccttgaatttatttagaagtaatcatgaccactaccttggtttcaacagaccagaccatccatgcttaaaaccttgaggaaaagacctcctaccactgcctggaacttaggaactcccagtgagccttgtgtgtagggctgcatggggtctttgggatgggaccttaacccagcagttacccattggtgcctctacttaaagcattggaattaattctgctgctgcaatgagctgggaaagaagaagcttggcccagagaagattccacttgagccttaaggtctatggtaatttgttttgttatgtgttgtacttgctggggacacatcacccctcctttcttttctatttttctctttgggggagaaaatgtctattttatgcctaactcaccactgtattttgaaatcaaataacttgtccagcgctatggactgaatgtgtatgcaactccaaaattaatattgtggaaccctaatccccagtgtggtgtaattggggtgtgggccatttaaggggtgatcaggtgaaaaggttgaagccgtcataaatgagattagtgctctaataaaaagtcacgggagagcttttctctcttgcttccctgtcatgagatgatacgataaaattacggccatctgcaattcaggaaggaaacctttacatacacatgattggctgtcttgggcttcccagcattcggcactgcacagaataaatatgtcttgttaaagtcatgcactttatgacactttgttaaagcagccccaataaaataagatatctggttttactggctcagagttggagagaaatttgtttcagaaataattctacctcaaatcttactcatgtatggtttagttaatatttaaattatgttttaaacttgtttagagttgatgatgaaatgagttaagagtttggggactgttataatcaaatgaatgaactgcgaatgtgtaaatgccatgcatttgggggatggtcttttctattctgggtctttcatgcctacgtgtgaattgaaggattgcttttcttatttctgtgaagaaggccattattattttgatagataatttatctaatctgtaaataactttgggtagtatgaaaatttcaatactattaattcttccaatccataaatgtggagtatctgggatatatgtcctatttatgtgtgtccatttcattttctattaccaataatttatagttatcctctagaaatctttctcttatttggtaacatttattcctaggtatattttgcagctattgtaaaaggaaaggcttcatggatttcattctcagatgttttgctgtcaacatatagaaatgccaccaattattgtatgtagatgatgaatcttacaactttacttaatttgcttatgaattctaatagtttgtgagaaggctttagttttctttttttaatataagatctttttgtctgctcacaggaaatctgacttccacaattccaaatttgaggtcatttccttttactgttaactaaatactctggctagcatttcagtactattctgaataaaagtgataaaaatggttatttttgtcttcttccacttcttagatgaaaatttcccggtttttccatgcttcgtgtgatgaaagctgtgtttttctcatatatgcgctttattttttgagatatccttcttgtatacctaatttttgataatttctatcagaaatgaatgttgaattttattctatgattttctaaaatatcttgactacacaataacacagtaatatgcaggtcaatacatatcaactgaatttcacttaatatcatcccaacttctaatatttattttttagtattagaacatgcctgtttccatattatatttgctcacaggtattggtacatattttagctaatttgtcattattttactctaagaaataactcaaaaaatcatttttattatgaattgaaaggtaacatcggcaaaattagcccaatcttaatctttcccagactttgaaacattattgaagacaatgagaggggaaagtcagctttagttgagcttctaagaggtaagtgaggtaaaaacccagggcttattggctacgactttgaatgttactgtcttcttttccataagccacatccagaccattttctaaatctaagaaaactaattttatctcactgcttcttagtcttgtttcctgcagctgacaaccaaaactgtcagcgatagagcccagtgtaaatcaccagcctttaattattgcagaactatgattttacaacaacattgtgagttacataatgatcctactttatggccgcggtgcaaatgcttaacttccactaaatcacagagctcagaatggctagcatggaggtgtatatgtatatgtgcattgttctagaaatttccaattactgtatattattgtttgcagtaattaggtcaatctgaactgacaaaagtctccatggccttataagcacagagaccacctccacggcaggtggaaatcaaggctgggaacagtctaccagctgctcccctgggattcctccaattaccctgtttaaagcctctgctcactcatgcgctggaagagggatgtcagagatgcagtctactcttcctaaagggctgacagggcataaagacaagactgattatccatggaacattcctataggaatgcacctatgtgcagacacactaataagctgtgtgtcttgcagtgtgtaaatggctgagatgccatttacacttctttacacaatacatttttaaatgttttgttgatgtattctctatcattcaaaaaaatcatcactttccccctaaacaaagaggatttttatcagaacacttatgggaagccccttgctctcccagattcccaccctcatttctcctgaaggaagaaagaaaaccatctctattgatttccactctcatcctctaggactaaaaccagaaagctgcatgctccctgggtgagccttagagaagaccctgtctgtaggagcaggaatctcagagccttggctgagaggcatggtcctgaaatgagatggagtcccccatggagatcccacgtggacgcccacacctgagggctcactgctcctcaccacagatgcactcccctactgagtcctgagacctgagtgcaccccatagagtaggactcagatgagggaatgcaaatctccaccagctccaccctcctctgggttcaaaagctgagcacggggcctcgctcagtgactcctgtgccccaccatggacacactttgctacacactcctgctgctgaccaccccttcctgtgagtgctgtggtcagggacttcctcagaagtgaaacatcagttgtctcctttgtgggcttcatcttcttatgtcttctccacaggggtcttgtcccaggtcaccttgaaggagtctggtcctgtgctggtgaaacccacagagaccctcacgctgacctgcaccgtctctgggttctcactcagcaatgctagaatgggtgtgagctggatccgtcagcccccagggaaggccctggagtggcttgcacacattttttcgaatgacgaaaaatcctacagcacatctctgaagagcaggctcaccatctccaaggacacctccaaaagccaggtggtccttaccatgaccaacatggaccctgtggacacagccacatattactgtgcacggataccacagagacacagcccaggatgcctcctgtacaagaacctagctgcatctcagtggtgctccctccctacctctgcagaacaggaaagtgtgactgagatgccatttcctgccagggcttgtgtttcctataccaaccagactcagagccctgtctgttttcctattctgtactattaaatggcatgttccctgttagtgattcacgcaagcagaggctgtatcctgtttgacaaagattgagcatgaaagattcccattacctgggccacatgcatcactgatatgtggccacttatttcttgagctcatatccttccaaggggctgaatacaaatatctataacataggccatcttaaactgcaggaagtaatgttggagaagaatgtggagataaaagagcaggatgattaattaaaatccagataccatctttttttgcagagaaaaatttacactaataaagtaattttatgaaacaacaagaaagatggaatgtgtcctcatcatggagtgtctcacttgcagtgcacaaataaatttctaaaaattttatagggaagatgtgatagatgaggctgatttccacacagggagtgattaaatacccaggtaagtataaaatccaacacttggaaaggaaaatgcctcagcttgacatcagaaacccagctcagtaagtctgaggagcaatgcggaaaagaaatgaaaaattcgacaacacttttcttatgaaatccctagctcatgtttgaacacgaaaacagaattgtccacaattttaggacagccatcgcatgacaacaaaccactacaatgataggagcatcactgagtcaacggagttcaagcagtgagcagatcagtactgaggccccaggagaaccaaggctctttggtacattttacagaacccagaaccgagccacataatctatggccaagtgatctttgacaaagttaacaaaaattaaccaacgtatacaccagggaaaggacaccccattcaataaagggtgctggggatattggatagctatatgcacgcgaatgaaactggacccccaccctcaacatgtaaataattaacacaaaatagattaaaggtttaaatgtaagtcttcaaactgtaaatgtattcaaataaaacaccaggacaactcttctggacaaaaagcaaacaatagacaaatgggacttaatgaatctaacaagtttcttcacagcaacagagtgaacagacaaagtgcagaatgatagaaaatatttgcacactgtgcatctgacagagtactaatatacagaattaacaagaaactcaaaccacaacaacaaaagaaaacaagaaccaaataaccccattaaaatgagcaaagaacatgagtagacatttttgcaaataacacataaaaatggacaatagatatataaaaatgctcagcattactaataatcagggaaatgcaaattaaaactagtgagatataccattcacaatggctgttattaaaaagtcaaaaataacagatgttggagaggatgaaatgtaaagggaactcttagacactgttgatgagaatgtggacgagtacgacctctatagagaacagtatggattcagtatgatattgactgtgcatttgtcataaacagctcttattattttgagatacattccatcaatacatagtttaatgagagtttttagtattaaggggtgttgaattttattgaaggcctttgctgcatctattgagataatcatgtgttttttttccattggttctgtttatgtgatggattatgtttattgatttgcatatgttgaaccagccttgcatcccaggtatgaagccaacttgatcatggtggatttgaaaaccggcacaagacaaggatgtcctgtctcatcactcccattcaacatagtattggaagttctggccaaggaaatcaggcaagagaaataaataaagggtattcaaatagaaaaagaggaagtcaaactgtctctgtttgcagatgacatgattatatatttagaaaaccccatcatctcagccccaaatctccttaagctgataagcaacttcagcaaagtctaaggatacaaaatcaatgtggaaaaatcacaaacattcctatataccaataatagaaaaacagagagccaaatcatgactgaactctcattcacaattgctacaaagagaataaaatacctaggaatacaacttacaaaggatgtgaaggacctcttcaagagaactgcaaaccactgcccaaggaaataagagagggcacaaacaaatggaaaaacattccatgttcatggataggaagaatcaatatcgtgaaaatggccatactgcccaaagtaatttatagattcaatgctatccacatcaagctaccattgactttcttcacagaattagaaaaaaactactttaaatttcatatggaaccaaaaaagagcccatatagcctagacaatcctaaggaaaaagaacaaagctggaggcatcacgctacctgacttcaaactatactacaaggctacagtaaccaaaacagcatggtactggtaccaaaacagagatacagaccaatggaacacaacagaggtcccagaaataatgccacacatctacacccatctgacctttgaaaaacctgacagaaacaagcaatgtggaaaatgatcccctatttaataaatggtgttgagaaaactagctagccatattcagaaaactgaaactggatcccttccttacaccttatacaaaaattaactcatgatggattaaagacttaaacatgagacctaaaaccataaaaacccaagaagaaaacctaggcaataccattcagtacataggcatgggcaaggccttaatgactaaaacaccgaaagcaatggcaacaaaagtcaaaattgacaaatgggatctaagtaaactaaagagcttctgcacagcaaaagaaactatcatcagagtgaatgggcagcctacagaatgggagaaattgtttgcaatctatccatctgacaaagggccaatatctagaatctgcaaggaacttaaacaagcttacaataaaaaaaaaacaaccccatcaaaaattggcggaaggttatgaacatacacttctcaaaagaagatatttattcagccaacaaacataaaataaagttcaacagcattggtcgttcgagaaatgcaaatcaaaaccacaaagagataccacctcacaccagttagaatggcgatgattaaaaagtcaggaaacaaaagctgctggagaggatgtaaagaaataggaacgtttttacactgtggtcggtagtgtaaattacttcaaccattgtggaagacagtgtggtgattcttcaaggatatagaactagaaatgccatttgtcccagcaatcccattatttggtatatacccaaaggattataaatcattctgctataaagacacatgcacacatatttttattgcagcactgttgacaataacaaagacttggaaccaacccaaatgcccatcaaagatagactggataaagaaaatgtggcacatatacaccatggaatactatgcagccataaaaaggatgagttcatgtgctttgcatggacatgggtgaagctggaaaccatcattctcagcaaactatcacaagaacataaaaccaaacaccgcatgttctcactcataagtgggagttgaacaatgagaacacaaggacacagggaggggaacaaacatcacacaacagagcctgtcggggagtggggggctggaggggatagcattaggagaaatacctattgtagatgatgggttggtgggtgcagcaaaccactatggcctatgtatacctatgtgacaaacctgcacattctgcacatgtatcccagaacttaaagtatagttaaaaaaaaagagagagagagagaaaggaaacagtatggagactttccaaaaaatgagaaacagtactggcctttattctaccaatcccactactgggtagctacccaaagagaaagaaatcatatttcaaaaagatacccacacttctatgtgtaccacaaatctattcccaatagcacatatgacaacctgagtgtccaccaacagatgattttataaaagaatatagcatatatgcacaatttaatactagtcagccacaataaggaatgaaactgtgtcttttgcagcaagatgcctagaactgggggacattataattagtgaactaactcacaaacagaaagccacatatcacacattattacttataagtgggaggaaaacagtgtgtacacaaggatatggagagagggattatggacattggagacttagcagaatgggagggtaggagttgggagcatgatgaaaaatcacctaatgggtacaatgtacgttacttgggtgttgggtacactaaagccaataccactgtgtaatatttccatgtaacacagttgcacccatagcccttaaatttatacaaataaagataaaaacaattacaatttaaaatataaaattattaatagttgaccaaagatcttgaaaattaaaatttaaatcatgatcaataaatgaaattaatatcagttgaacttcatttaacttaaaatccttttgtactcaagtgattttaagaaaatgaatgtcaagttttagatgaggagatttgcaaatcatatcaccacctatgtaattatagtaagaaccctcaaaactcaacagtgaataaaagaagaggcaacccatggataaaataggcaaaggtttgtgcaggcatttcattaaagaagatgtacagattacacataggcatataaacaggatctcaacaggatttttcatcacagaaattcaaatcaagaccacaataagatacccaaacaccctttttagaatggctgaaattaagaagaaagatggatcataccgatgctggtgagcataccaggtttctagagtctaaaacattgctaatgggaatgcaaaatgaaacagctacacaggaaaataattcttagtttcttgtaaaattatatatgcccttaacacattacctaaaaatccccctcctgtaatacagtaatacatggctgtgtattactgtgaaagaggcatagtgtgaaaacccacatcttgaaaccctgagggagaaggcagctatgctgtggctgaggagattacagggattatttgattaaagacttttttagaaagtgaggttaaatcagccgggcgtggtggttcacacctgcaatcccatcactttgggaggccgaggtgggtggatcacgaagtcaggaatttgagaccagtctggccaacatggttaaactccatctctactaaaagtgcaaaaaattagccgggtgtggcggtgtacacctgtaatcccagctactctgggcgctgagacaggagaatctcatgaatcggggaggctgaggttgcagtgagccgaaatcgacccactgcaccccagcttgggtgacagtgcaagactccgtctcaaaaaaacaacaacaacaacaaaaagcgaggttaagtcattgaaaaataggaaaatataaatgtgtatgcactctaattatttgggaaattttccatacaacttgtattctgtaaacaaaattcagggagtggaaaacaaatcaaattaataaaactgatataagaattcctctgaagatattagtgtgagcactaacacacacttttgaatgggtgttgtaaatattttggaacacacctcttaggtcacattttaattctacatttatgtaaattatataaaatatcgaaattttttaatgtctccattttgtgcagttataattttggtttcatgccagcaatgcatgatagattccgttcttccacatcctcgttgccatttggcactataagcattgtgtattttaaccattctaatctattggtggtgatagctcattgttgtttaaatgcacatgtctctaaaattttatatttaattattttatataattgtgatgaagtgtttgttatggtatttggctcatttttgatagcattgtttatttttgatcagttgtaagtttctttacatacccattatataagtcacttaaaaaagtacttagctggtcatgaaccccaggatgagatgcagactgtatagaaatctctagcaatgttactcagtgtgggcagggatggcatgagatacggggaataaagaataaagtaactttctccatttggatataagatgtgtccattcactagagagttttctttcagaaggttcccatgtgagccagtttccttcctgacaaggaaatcacccagaggattctcataatctcttaagtgagaaaagttttcctcaaactccagctcagtctagctcacactgtctctaaatgggcaattactttcagacatgtacacacatctgtcccaacgtggactcctccctcagacaagcacacacattgcaatgtggactctcccctcagaaaaccacacatgccccacaatgactccttcttcacataagcatatatgcctgatgctgaactgctgtgtagcaaaattagctcagaatacaagcacttatggactctagccataacaatgtgtagatctgcattttattttaaattctaaatgaacattttgccttcttgttaagaacagtggtttacagctctacatgtagagactacaggcagatatatgtttcctctgggaaaagtttattttcatgtatttactgggttattttgttgataaacattcatctataaagacacctgaaaagtgccctcattagagaaaaagaaagtgtagtttgcagattaactctgagcatccaatcccaggaatcctttgatctgccctccctgaaatccacaggcagaggggggatgatcgctgataagtagcaaacacatgtccacaggaagggagacatggaaatgtggtcactcccacactcaagaggagcagctcatcccctgtccgtagtggtcctggtgaggagccaccccacacctgtgccttcctcagtatccacaccatggggtctgtgctgatctgggcttcccttctcatcactctcaatattagtgtccttgcggatcaggctcagctgtggctgctccagatgaggctgttctcagtctgttccctctgtgtttgcagaagtcctgtgtgaagttcaccgggggagacagaggaaataacggtgcagccgggggctatctgagtctctcctgcaaagactctggattcaccttcactgattgcagcataagcttggtccagcaagctccaggaccagggttgatgtgggcagcaacagggagaaattgaagaggaagctctcagtggtgccctccatgaatacaaagaatcttcacagtccccaggacacccttacgtgcatggtctcactgatatctttacttcttttatcacttttgttatgtaaatcacaatgaatagtgtattcctcatctattatacatttgttaagtcttttttggtgtctttaaaaaaactgataactttatagtatgtaatatccttaagtcctgaaagtgttttttgatgtctaccttgtcttaaatttatacagctactatagcttttcttggttcatgttttctcatatttatcttttctatttgtgaatatgtagagaaactttcttgtacatagctaatagttgtgtattgcttttttattttggcagtccttaaatattctaattttttatgatactttaagttttagggtacatgtgcacaacatgcaggtttaaacaaacaacctcatcaaaaagtgggcaaaggatatgaacagacacttctcaaaagaagacatttatgcagccaaaaaacacatgaagaaatgctcatcatcattggccatcagagaaatgcaaatcaaaaccacaatgagatatcatctcacaacagttagaatgacgatcattaaaaagtcaggaaacaacaggtgctggagaggatgtggagaaataagaacacttttacactgttggtgggactgtaaactagttcaaccattgcggaagtcagtgtggcgattcctcaggtatctagaactagaaataccatttgacccagccatcccattactgggtatatacccaaaggattataaatcatgctgctataaagacacatgcacacgtatgtttatagcagcactattcacaatagcaaagacttggaaccaacctaaatgtccagcaacgatagactggattaagaaaatttggcacatatacaccatggaatactatgcagctataaaaaatgatgagttcctgtcctttgtagggacatggatgaaactatctattgcttttttaaatcaactataataaattctattttttttttttgagaaggagtctcgctctgtcgcccaggctggagtgcagtggtgcgatcagggctcactgcaagctctgcctcctgggtttatgccattctgctgcctcagcctcccgagtagctgggactgcaggcacccaccaccacgcctggctagttttttgtatttttagtagagatggggtttcaccgtgttagtgaggatgctctcaatctcctgaccttgtgatccacctgcctcagcctcccaaagtgctgggattacaggcatgagcaataaattctatttttaaaccaacaatatttttttccgttaatttttgtttaaattaacattttgtaatgatgcttatttctctattaacatggtatttaattacctttttataaatattgtatagttaccataagatttacaataaaaattgtatgtaattagattctaatgtaaatcctgtgatggccttgatatgaagaacacagatagtgtaactgtgtgctttgaattcctccttctcgccactctttcttgtttattctgtttgcacttacatatgctgtaaaatagaatatgtaattttttattactttatacagttatatcttatagcaattacaaatgttaaagagtacaattcatctagatttttccatttttacaatctttatttctttgtagagatttctattttgagtgcatatcacatggctactcgcagagaatctttgtaaaatgtgccctgaaacatgaatgtgctgacaacacatattctccagatctttttttctgacagaattttatttgccattcacctttaatgaaattttaatgcatgtagaatttcagtttgcatttcacctgtaatttattttcttgtaattattattagtttttcctggagatgatcacacattacattctgctgggcctttattaaccatgtttctgcgaacctagtcaggcttgggtttcaagtgtatggttgccgtggctatcagagttgaaatcagcttctcctgttcacaaaaacttcaggttcctctggtgatacctgcgtttgtgtccctgtttggctttggatcttcacatttcattctccccaaagaaaggctgtctctttcagctgtggcaggtgcatcctgctgacacatttacttggtgactttttgtgggatgaaggggcttggacacaggggcacgttttccaaccttctggctgagcctccttcttagctatgggtggtgagactggctctgatgcatgatcttccaagtgttcctgttccttcccttcctcagtgtcacagtgtctcttcccagtcatgctgttttttcatcagtgtcctcagcttctgacccactgtccttaccccacagattctggatttcattcctcaggaaacagacgggaggtgattctgggtagagtttccctgatgtcctctgtttccttgtgttctagttgattctaccagtgcccacaggacacaagatttaataaatgtctcctgcatataatgaagggggattcagcattgaacggagctactgttcttcctccccagtcaacaccacaggacagcaggtgggtgagttgtctggggatttccccaattctgtaggaaaagcctgcaagtgccaggagtttcacactctcacaccattagcacacacgtcttcaagcaactcattaaacatttccaggttagctttttcctatcttcaataccatgccatgagtggcacctgccccaggtactctaataaacgcaccctagttctctctgcgggcccctattttctcatatttcagggatttttttctctgtgacatcaactcagatatggtgaggggtttattttttgtaattcttcatgttttttgttaacgaggtcagaataatatcattttctcaatttttacattctaacgcttagtatctgatttctaaataaaattcagaaactaagacaacaaatgaagtatccattatttggtgcattgttaaacaatttgagaaatattcatgtactgaaatagaatgaaccactgaaatcaaggcatgcctcattcacataagaacatgagggcattatcaaataattttgctgagtggaggaagctaaagaattcaccatcaatttcatgtgatttcatttgtataaatcacagaagatgcaatattctaaattaacatagagaagatctgaatttctctgaaaatagggtgggcagagtaacaacgtggtgaaataaaattatagacaagttagataaaaaaattagaggttaacttaattgctaaaacatgattgaagtgctgattcaatgactgcacacatatatcaacattttccaaatgcttcactatcaatttgatttcattattgattgtttttttaataaagcagtaataaaaatgaatatattggctgagaaagagcaagaaatggataaataccgacacttgaataatcaaggactcctgaaaatacacacatgtgaacactgattgtagatttcaggtaaacactagaaaaggcaaaattacacaaagttgttatgacaggagggacatcctgaaaacctctctaggcatgtcccacaccaccctggagctgtctcaggggagcagtctcctccagtgtttagaggcacaggcacgcataatagggctaactctggccagatgtgtgatattggacacattgcacaactgctctgttctgtatgtaatttatcttctctacaaatgtaacattgacagttgcattaaatatattctgcaaatatgtaaaagttaaataagctgatgtctgctaaatgattaccaaggcacaatcacataatctgaagttatattttccagagtgataggattacctccagagttttccaggacactctcatctgctccgggcactgccttctcctcagccgtcccacccctgagcttgctatatagtaggagacatggaaatagggcccactctctgctgataaaaaccagcccaaccccgaccctgcagctctgggagaggagcccagcccccgaattcccaggtgttttcatctggtgatcagcaccgaacacagaggactcaccatggagtttgtgctgagctgggttttccttgttgctattttaaaacgtgatctatagagaactagagatattgagtatgaatggatatgagtgagaaacagtggatacgtgtggcagtttctgaccggggtgtctctgtgtttgcaggtatccagtgtgagatgcagctggtggagtctgggggaggcttggcaaagcctgcgtggtccccgagactctcctgtgcagcctctcaattcaccttcagtagctactacatgaactgtgtccgccaggctccagggaatgggctggagttggtttgacaagttaatcctaatgggggtagcacatacctcatagactccggtaaggaccgattcaatacctccagagataacgccaagaacacacttcatctgcaaatgaacagcctgaaaaccgaggacacggccctctattagtgtaccagagacacagtgaggggaggtcagtgtgagcccagacacaaacctccctgcagggccatgcgggtggtttcctttctcagctgcaggaggcgggcttattgttgcaggactctggagacttattaggttgtgatattttactatggttatttatcatgaacttttttattgggaattgtgttttattaatttttattttatatgtaaggttatttttttaaaatacataccttcaagaaataattcttcctaataatttgcacttgttctttttagagttttgttaacatctgttgatatcagctactacatagctatagggacattaatttacatctatagacatatgtgtaaatacacaaacttatacatatatgtggtcttttatatttaatgttataataaaattattataacaattataaaatacatcctaaagaatgaaacatatatagtaatccatattcctttcaatcattgcctatagtttacataaattgatgtctatttgtaaccttaaacatagtgtattggtcattttcaaacatccaagaacaaatttcaaatgtccttgtcacacacacaaaaataaaaatttgaggatttgaggtgatatatatgtcaatcagctcgattcaattattccatattgcattcataaatcataacatagctttattcactataaatacatacaaccaaaatttctcaattttcaatgaaattttaattatacatattttatctgtcctaggtcatgaatgtttttctccctgtccggatgtgattagattgtcctgagaaacaaattcagcttcctgcctcctgaaggcttcaggaagcagctcctagatggggtgaagcaggcaacccgtgtgtgtccacaggacccggagcctctctctccttggattaggccccctcctcaggattacagggctcttcagttttctcaacatgctgttataccagagaagcacaaaacacttaatttcattatatttttcttcaatttttcaaaacaacacaaaggtaataattttaacaataaacatattacaacctactatacatgagacccttcctgtgcttcgaggtttcttctcaggactttgtatgtattacatgttttcagtttttttctgagatggaatgttgacgtctccttattacagattattcttttaatttgtctcttagaataattttttccagagctcctgcccgcccgcgcctggcggaatggagcggcgccagggctgagccaggcgcgcaggggccgccgcacgtgccgcgcggggagcggatgcccagcgggcggagagccagcgccagaggccgggtcggagcggccgctggagcagcgtcagaatgggagaacagcccatcttcaccccccgagcgcgggtcttccagattgaccccaacaccaagaagaactggatgcctgcgagcaacaggcggtcaccatttcctgtttctatgatgtcacaaggaacagctatgggatcatcagtgtggacagcgccaaggtgaccataaacaacacaattacacagaatatgaccttcaccaacacgtcacagacgtctgggcagtgggccgacagcagagccaacacggtgtttggtttggggttttcctctgagcagcagctgacaaagtttgcagagaaattccaggaggtggaagaagcggccaagacagccaaagacaagacccaggagaacatggagccctcgagtaatcatcctgagaatcagggcgtggagccccatcttctactccggcatccagtgtcaacgggacggacgatgaaaggcctctcaggccgctgcagccgacacgcacctgcagtctgggaaccacaagctgaaggcggcctcgacgcagagctgcccacgggaagaggtgggagatggagctgcagacccggcgggagaccgacttccggctgcccacggcgctgcaggagtcgacggccagtgcggagcagaggaagaggccgtgagtcagagtgcgactgtgtctctgagaagatggaggcggcagagagaggatcaaaacctggaagataaagtgcgttccctaaagataggccctgaggagagcaaatcccgacagcgccacctggaggcgcttcctggtggcgctggaccggaagatccaggcctgcataacttccgcccaggcctcccaggctgggcaccaacaactagggctggcagaggcccgggatccccaacgtgagtcctaagtatgtgtgcgagaccagatggcgctaggacgttccctgtgtgcgttgcttctgtaaatgcaggcgccgtgtgtcgtgtttccaaaccagttgtgccatccactcactcctttccagaatagaaatctctcgcttctctggccttgtgaggttgtggacaactggaagattctgactgaggaaaccagaaccaggtctaccttcaacatttacgcagtcaggccagggatgtttatatcgttcataagggttgttggaaccatatgaactgaaaaaaagcattttctcatccaaatattgatattctttacaccaggccatcgggctccttttatccgatagcattcagagtatttgaaggtcctccaggtgccagccttgggggcacagggagaacaacattcctctccgaaaacatggggaagctttaaaataactgtttagtggagacttgcccagagatggaaaacaggtttctggtgagtacattttctggtttgggaatcacctgcatccccgatcctgccccgtgccccccagtttgtatggttgtgacaatgttccatttctttgttttaatttctgagcagttgactgtggtgcgggaacagcacacagtgagggtgcctagcacaatgcctggcgcaaagtaggtgctttataaatatttgttcaattaaaaaaaaagagggaggctgaggcaggagaatcacttgaagctgggaggcggaggttgtggtgagccgagatggcgccacttcactccagcctggcaacagagcaagactccatttcaaaaaaataaaataaaataaataaaataaataaataaaataaaaaatattttttccaagccccactcaaaaccatggtattgttagaggtgtaatagttggaccaacattgaaaatacattccatttagttcatgggcgtgcaaatatccttttttctttaaaaattgttctcagttgtaatattacaaaaaatattggtaatttataccaatgacacaggttaaaatgttgtataaataatttaatgacgtttgattggaaaaaatacatgtgccacatgtcgacaattttttccttctctatgaaatatatactcattaataagtttcagatgttacagttatctttttgatttctgggatttaattttagtaggtatacttgaatgcattttattaattcctataatgatgttgatatttcatgtaggattttaatactaattttactatttactgaattttaaactattctacatgttttatttatataagaaaaaaattacatatgagaaaaaatgcgtagacctgaaatgtatcactagagagtttctgtcaaatgtgaatacctttgttcccaacacctaaggtagcctgaagagcaagtccttccccacaacatgcgtctttttctgtgcttgcggtcagctcctgcatggggaaatgttttgatttctgacactatagatccattttttttctgttttgaactttatataaatgcaatcaaacattttagaccttaatttggtaatgggctacattgctattttttgaggttatttcctgctatttaaggtattaaattagatcaacatattatcatttattcaagtaatggactgactctgatatgaaacctcaaagttttcacatatatatggagagagagagagagagagagagatgagggagagaggttttatatctgagtcagtctgttaaataagtaaatgacagtattttgatttattttcctgtaaatcgactttaaatttgtttccagtttatgaatattataaacaaagctgttacaaatgtcttagtgtaagttttcctatgttgtcttccttttattgagaaaatatgaagtatgtatttattataagcttaaattttttcagttttattgaggtataattgaaatattttaataatgtatagctttaaggtgccccacttgacgttttgatgttgtattagtccattctcacggtgctataaaaaatgcctgagactgagggatttgagaaaaaaagtgtgtttaattggctcacggttctgcaggctgtacaggaagtgtagtggcttctccttctggggagagtcaggaaagttaggatcatggcagaagacaaaggggagcaggtgcgtcacatggccagaccaggagccacaggaagcagggaaggtctacacactgttaggcaactagatcttatgagaactcacacactgtcatgagaacagcaccaggagtttgttctaaaccattcatgaaagacccaccccatgtcccagtcatctcccaccaggtcccaccttcacaattgaggattataatacaacatgagatttggggcaggacacagatccaaaccacatcagatacacattgtgaaatgctcatcatggccaaggtaatttgtatatccattttctcatggagctaccattttatttttttaaaatgtactacatgtgtgtgtatgtgtgtgtgtctcatgagaacacctacgatctacccgttcagcaaaaatcacatttacaatacagcattaaatacaagaacattgcagtacattagatctgcagaactcattcaccctgcacaactggacctctacccttcgaccgacatcatctgatttccctctcctcacaggcctgggacccactattctactctctgctttcaagagcttgaatattttagatcccacatgtaaatgagatcattaagtctttctgcatctggcttattccactaagcatcatgtcctctagccccatccctgttgttgcaaatgtcagaatttccttcttttcaaagcctaataaaattcagttttctgtgtacacattttctttacacattcatcaatctgtggtcattaaattattttacaaatctacactattataaataatcttgcagtgaacatgtgtttgacataataattttatttcttttgaatatatgacaagaagtgggatcaccagagcatatgatagctttatttttcaatataatgaataaccaaacctaccacaccatgcttttgaagtcttagtcatattttatttgcctaggccaatgtcccgaaaaatttctcctacattttcttcagtttgtacatttaaatattgaatccatattcaattaatttttgtctatggtgaaaaactagaagtctagttttattcttctatgtgtggctgtctaagtttttcagcaccacttactgaatagagggttgtttctccattgcatatttttgtcagttttgtcaaagaacaggtggttgtagaaacttgtctttatttcttggctgtctattcttttacattattattattgttattgtttttagtagcagtaccatgctgtctttcttactgtatctgtgtagtataatttgaaatcagggaatgtggtgctttcagctttggtctttttccttgggatttcttttgctattcaggctgttttttgattccatatatatttaaggattttttttaaaacatgtaatcaattatattggttacttgataaaaattgcattgaatatgtatcttgctttggacagtgtattagtctactgtgcattgctataaattaatgcctgaggccaagtgatttacaaagaaaagaggcttatttggcttacagttttggaggctgtgtgagaagcatggcaccagcatctgcttcttgtgagggcctcaggaagcttacggtcatggtggaaggcaaaggggaagcaggcggtgtcctgtggtgagagggggcacagaagaggggaggagggtcgctagactgtttttaacaatcagatttcaaattagctaataaagaaataattcactaattaccatggggttgataccaagccatacctgaaggatcttttccccacaatccaaaaactcctactaggacccacctcaaatattttggatcacatttcaccatgagatttggaagggacaatcacctaaactgtagcatttcactcttgtgtcccctggtctcaaatccttgtaagattgcaaaatcatctttttttaaaatagttcccaaaagtgttaacttgatcaacctccaactgaaaattacaaagtctcgccagggtcttaaggcaatttccctccagctgcgtgctggcaaaatgttttaaagagttatgtacttccaaggtgcaatattgccattgggtaaatattgtcaatacaaaaggaataaattggccaaaggccccacacacacctaaagcctagcaggacagatattaaatcttaaagctacaaaataatctatcttgactttatgttcttagtcagggtacaccaggacaaagtgggtcccaaaatcctcaggcatctcatccttatggctgggcacattccatggggctaataacacaggccagagtcaagtgccagaagtagttccaggttgggagtacaagctgcctttggatctaccattctgggatcttgagggttgtggctgcatttctgtagctccactatgaagtgccctagtggggactctgaatggggttccaaccccatctttccccatctttggtactgccttcgtagaggttgtttgtggtggatccagtcctgtagcaagcttcctcctgggcacatagggttctctacacatcttctgaaatctaggtagaaactgcccagcctccttcactcttgcattctgcatatctgccagaatccagttatcccagcaccatttactgaacacagaggtttttttccacattgtttgtttttgtcagccttatgaagtatcagacggtttaggtgtgcagctttatttctgtttcctattttgttccgtttcttctgcatatctgctcttgtaccagtaccaagctgtttttgttaccatgtcattatggtgtagcttaaagttgggtatcatgatgcctctggcgttgttctttttgcttagcattgctttggctattcagggtcttttttggttccatacaaattttagaatagattattttttctaattctgtgatcaatgatgttgatagttttatgtaaatagtactgaatctgtaaattgctttagacagtatgataatttttacaatattccttcttctaatccataagcatgaaatgttttcccatttatttgtgtcatgtatgatttatttatttatttatgctgtgttttgtagttctccttgtagagatctttcaccttgtttgttacctgtatttccaggcatttcatttgtgtgtgtgtgaatattgtaagtgggataagactgtgttcttgatttcactctcagcttggacatagttgggtatagaaatgttagtgattcttgtacattaagtttgtatcctgagactctaccaaagttgtttatctattttagaattattttggcagagtctttagaattttctatgtgtagaattatatcatcagtttggacagatatatctacttcttttcccatttagatgttgtattagtctatttgcacactataaagaaacacctgagactgcataatttataaagatttttaattgtctcatggttctgcaggctgtacaggaagcatggctggggaggcctcaggaacccaacagtcatgacagaaagggaagcatcatgtcttacatggctggagcaggaagagagaggaggtaggtgccaagtacttggaaaccacatctcctgagggctctgtcatgggaacagcacaaaagagggtgaagcatccccatgatctaatcatccctcaccagtccccacctccaacactgggaataacaatttgacatgaaatttgggtggggatgcaaatacaaaccatatcagctccgttttattttttctattgcctggttgctctgactacgatttccagtagtatgctcaataggagtggtgagagagggcatccttgtcttatttcagttctcaaggggtttgagcttttgctcactcagtataatgttgagtgtggttttgtcatagatggctgttattattttgagttttttttttttttttttgagacggagtctcgctctgtcgcctaggctggagtccaatggcacgatctcggctcactgcgacctctgcctttcggggtcaagcgattctcctgcctcagcctcccatgtagctaggattatggttacgggcatgcgccatcacgcccagctaattttttgtatttttagtagagacagggtttcactgcgttagccaggatggtctccatctcctgacctcgtgatccgcccgcctcagcctcccaaagtgctgggattagaggcgtgagcccccgcaccaggctattttgaggtattttttgatgcctagtcttttgagagtttttatgagtgaatgttggatctcatcaaaagctttctcagcatgtattgagaaaatcatatgttttttgcttttattttgcttacatggagaatcacagttactgaattgtggatgttgaatgaaacttgccttccaggggtaaagcctacttgatcatgacgtatcacattttaaagtgcttctggattctatttgttagtattttgttgagaaattttaggtctatgttcaccaagaatattcatctgatgttttcttttttaattatgtatcttcctgattttgtatcccaaggacacacaatgaaggaaggacagtctcccaacaaatgatgtaaaaactggacatccatatgcaaaataaataaaattagaccttctctaacaccatatacaaaaatcaacaaaaataaacataacatgaaaccataaactcatagacaacatggaaaaataattcatgtcattgattcagaaatgatttatttgaagttaatcccaaaagcaagcccagcaaaaaactacatgcaattatatatctgacaagaagttctatcaaaatgtataaataatccatacaactcaatagcaaatatcaaatgacctcataaaaagagcaaaaacctgaatagatttttttcagaagacacatgcatgaaaaacagagcataaaaatgtcctcaagatgactaattgtcagaggaattcgaatcaaaagcacaatgacatatcacctcacaccacttaaaatggctattatcagcaagacaaaagataagaaatgttggcaagaatgatccacagccataaagagagctttgattggccaagagactgatttcagtaactttctcctgtgaagagaccactgaccatggacttgtcctggccaatttccagaggctgtgcactgtgtgtctttctgcccctgcacaaagcccttttgatatgcaggacccaactgtaattcatttagttcttaagtcctcaccccaaagcaaagctgaaatgcatgtatcatgtgtgtttgcttattagacatgagagcctccactccatgtgaatatccatagctccttctatagcctgctgagtgtgtacactcgaccaatccatttgcacaaatttgtttctcatctttccctctcttaaagtgcctgctcacagtctctgtgggaggctttccttcccagcctgttaagatggccatcctgcagcttcaaccctttctgagaaataaagtctcctttctaaatttataaactgggtgattcttccgttgaaagcacaagctgttgggaagagttatatggcaattccataaatgcctggaagacaagtgtggatagggtagggtaagaagtcctgggggctgcacaccccactctgatggaatttccctccagaaacttctgggttctcaagatgagaatccaaacagattccctcatggctctgtcatcaggagaactatactctgataagtatgcccagaacttcctccagacagaccctatagggaaaaaatacttttcaagatctttattctgtgaggggaagggattcttttccatcccagacagcttcatcttagccttcctgagtcatgaaaaggagtataattaataaaacatctggggtcagattcaagaaaataatctgtggatgctgcagccaggagggggagtggaggacggaggaaaatcagctgtaccactgaatactccttgtaaatggtacagcctagagaaagaatagcaagaaatcattggaattcaatttccagaacatatactgctcccctacccaccacatcacctcaccaccaatatgattaatctggattaaagagaaaagtgtggaaaggcacagactccatctaaggactagaatttagggaaaccaaaggcagtgggagagaaaaagtcaaggacagtaaagtgacttaaaacctcttagaccaacagcttcaggaacaaggtcacatcctctccctcactgaaattagatttacctctcatggggcatctgcagggtgcgcaggtgagaactggcaaagagaacatgaaggcactttccaaatctccattagtacctagctcgctttagctgtttggaaaaagcaaaaccacaacaaacataaccaggactaggatcagtgttggaagcacttttcactggcaagacactaagaaggagggcaaattcgaggccagttactatgcaaatatgccactgtgagtgtgtgtggtggtgagctttgagacatagggtctgtgggtaaagttataatcgataaaatcttcaaccacagaatcctaaaaaaaagagccttccccaaagtcccatcagttcctggactcgccatgtgtctggaccgtatcagtggatccggagctccagggaaggggctccctgatggcttttatgattccttgcttgccgtgctgaggtctccctgtagattatgttgggttttctaaggcctattttctattgtaagaggtggtgggggaaacaatttctgtcactgaaagagcattctgagccagggcacagccccttcctactgagcttgagattctgggaggaaaaagttctctgacaggaggaaaaagttcccagacaggaacttccctgcagggcaggagctgagcggcagggggcgctcagggagcacccagcacaggacccagccctggggcaggtgcacaggaggctggggcagggttttctctcaggaattgaatgttccttatttcaaagcaataatgacctaacatttaaataagaatttagcaagtactgatgtgcctgtaagtattttattgtatacgcagcctatacctaacccaataatttaatgcaaaccggatttaaaaggagaaatgtctaggtctttcaaatgtatttctagttaggaattgaggggtggttttattaattcaatgggtgttactgtccggagacacactcatcccagaagttagatgtgcagagggcaaggctcaggaaaagttcaggtagacagtgagccatatgaacagggaatcacattgaggaccatgtcctgtgagattctgggtttctgtgagaggagttctgtcttcatggacttctgggcatgtcagaggacaaatattaaacaaagttcagggcagggagctcagcatcccactgtggcgtggtccacatgtcacctatcttcttcctcagggtggcgtggcctgagctatgaaaaacctgcctcatgaatatgcaaatgcactgctgtctaccgaggtaaatacagatctttccttgcccagagaccatcacacaacagccacatccctcccctacagaagcccccagagcgcagcacctcaccatggactgcacctggaggatcctcttcttggtggcagcagctacaggcaagagaatcctgagttccagggctgatgaggggactgggtccagttaagtggtgtctcatccactcctctgtcctctccacaggcacccacgcccaggtccagctggtacagtctggggctgaggtgaagaagcctggggcctcagtgaaggtctcctgcaaggtttccggatacaccctcactgaattatccatgcactgggtgcgacaggctcctggaaaagggcttgagtggatgggaggttttgatcctgaagatggtgaaacaatctacgcacagaagttccagggcagagtcaccatgaccgaggacacatctacagacacagcctacatggagctgagcagcctgagatctgaggacacggccgtgtattactgtgcaacagacacagtgtgaaaacccacatcctgagagcgtcagaaaccctgaggaatgaggcagctgtgctgaggctgaggagatgacaggatttatgaagtttaaatctgtttagaaaatgggttgagtaattgagtaaaacagcaatggaaagatgtgtacactgtcattatgtaggaaatagtattttcaactgtcaccctataagtaacactcacagagtgggaaaggcagccatcaatcaagctgatgcaaacattcccatgggggctttgtggggacatacattttataattggatctataaatcattagaaacaggattgcttgatctcatggtaagactaaatataatttccaagaagtggccgaaatttcttccaaaatgtctttgcccttccttttacattgaatttattttaaaggagttttaggatcacaacaagtttgagtagaagaaacagagttcccatgcactcctgccccccgacgctcagccttctctgctatcaacaccctgcaccagtgtcataaatcggttacagaggatgaatctccacagacacattggttgtttccttttctggtggtccctggtataacaagcctcaactatcttgaagcaccccaggttcaagtggattcttcaagtgggttactgggaatgatgccaggtagaaggaaagtgggtgggaccattcctctttgcactctttcctcaaggatccataaaatgtacatttacatggagctcctctttctcctggttttatatgcctcttccccaatggtaaggtttcccagtgtttacagcgggggtccccagtccccgtgctgtggatccgttaaggtgtgcagtgcgttaggaactgggccacacagctggagatgagtgggggcgagccagcatcgctgcctgagctctgtctcctgtcggatcagctgtgcattagattctcctacgagccgaattcactttttttatatatatactttaattctagggtacatgtgcataacgtacaggtttgttacataggtatacatgtgctatgttggtttgctgcattcatcgaattctattgtgacctgcacatacaaggggcctagactgagcgctccctatgagaatctaatgcctgacgattgcagggggaacaagttcatcccaaaaccacccaccgccatcatccatggaaaaattctcttctaccaaactgttccctggtgccaaaatggttggggacactggtgtagaggcaggtctgtaccttggaaagccagcagcttctggtgaatcccataattaatgtcctttaatgagaagtggagactttggtcatgagggccttcgtgaataatgccctacagttggattcaaaacattgtaagctcttggggggtgtttctggataaagccctttgtgcagaaaatgcagacacatccatgggatccatgcaggaaaaaagcttcctttacaaagtggtttggcacctggaaggagctctcagggttgggcactgtaccctttgctggctgcactttagccagaggcttaagcctgattggtcttgcagtgggagagccttcctggggtcaaaggttacaaaaatgcctgtcatcttccagctgagcaagcccatctgcgtgcttgtcagtgtcaaccccatgaagggtgcactctggaagatgacaagatgcacacaaacctcctcccactgattatccactaccacacactcagctgcaacccgtgctccagaaacggacaggggcctgcaaggataaacagaatggaagtattttattacctgggaaagcactgccaaatgccacgtttcaggaaggttaactcataagtgttcaggaagtgactgaagggcagtggtgggtgaggtgacgggactgcctcagggctgcacatgaggagggctccctcccacacagccttttcctccaggagctgcaccaggaactcacagaggatcaggaaggattctgagaacattcttctgtggcgctgactagaggggcaaaataaattataaaaaataaatcaattctaaatataatatgatgtttgttattagaaactatttctggatcctgtgggaaccctgacataagccaccattctctgtgaacaaacatttaacctctccttccatggggaggtcgacgagcttggattggttctttcatggatagtatcccccaaactcctctccactccctgcgtatccccgggtctctcagtgacaagttctcctcagtggaatttggttgatgtagtgagatcttcaaatttcctgtcgtctgtgttctcatgttctccccttatctgagattaagaaacgcacctgcatgtagtaaattatagcctactgtctctcatggacaaaataatggccacgccaaccaaccttgtggctgacagcaaccactggcggccaccatcccctccacagcctgtgttggaacatcacctgagagattgtgttagcaactttccttcagaatcatcttaaaaactttgtgtcccatttcacatggagacgtcatttttccatttcatcttcatagagaaatagaaggagaagaataccaaatacacttcctatctccagattattcaaatataattgtccctttatcaccttctgatttctggtcttcacagaatactctacaaatttttctcactggcgttataccaaaagttgtgaagcaccagatactgggattaatttaaccaacattattattctaataattcttagaatttagaattacaattatcatcttttcgtatacggataaactaacctatgcctttgaaaataagcccttacatgagagtgaaaagctatagatttggaggatttccttgcaaatccaatatttggaaaacggattttatcacaaatatacaaattaacttacaattgaacaacaaaaccacagaatttaattttaaaatgggcagagacctgaatagaaaccatatccaaaaaacaaacataaaaagtgatcaacttgattttcattaggtgtacttatgtttaatatttaaaaagttctactaaactatgagaatgggtaaaaattacaaggtagacaatatcagatggtgatgaggaagttgaaaaacaggaactttcaccccttgctggtgggaatgccgaaatggcacatagaaaactacagttaataatttattgtatatttcagaatagctacaagataagatttggaatgttcataacactaagaaataatcagtgatatagatgaaggatatcctagttatccagatttgatcactgcacataaaatgcttttatcaaaatatcagttgtaccacctaaatattttgaaatattgtgtatctatataaatcaaacattaaaaaacaccaatgcagtggaatccagctaattgcagattcccattagatgggatgtgctgcatgatctgtaaactaatcagaatctgtgggtttgtaaaggactttagaaatcaactaggctgcttgtttctaaagataagtctccctagtttaaatattttcttaatgggtggcgattttgaacatagaagaaatagtaatatttgtgtcttgtaagttttcttcttctcgtgtcacgagaaaaggtttgcagggaggaatctgggaccatctttcaagtctcaacttcactgtgattacctcagtaagtattttctgatacccctgactaagataagtctcgtatctgtcctagaaactaaaagtagaattctaagcatctacctgaccagatggacccttcctcttcaccaaggagttccagagacacttttaaacctagctccggccgtgttagaaatagaggatcagaaatgcctcattataccctcctccctttggaattcaagcacaactaaccagcatttttatgaaaacagagcttaaggctcagaaaacagattatttgtagcagtaagataccaaattctaaccttattcgagaatatcatcacaggacagagagcaggcattgaaaggaatcaaaggcttttaccctaaaatatattcctttgacatattttaaaatagccaggcacagttatcttttgtgagagagatttacattctgtagagaatctccttccctttccaggtctttttcttataccgaggagattagctgagggtctagcttcttttaaaggtcttaggagaaaacatttcccagctattgcctctaaaggtggtcacataagagacttcatctacatagtaagaatcttgttctccaaaacctgttatcttaacctagaaacatttttctaccggtttcaggtctttagaaaaaagcttaaatctttcaatcaattgtcaatcagaaaatattcgaactcactgtaagttgtaatccccgccacacactgcctcacttctagctgttttgtctttatggaccaaatcaacatatatctcacatgtattgtttggtgactgtctctctagtacactaaatttaagctgccatcaagccactttgggcacatgttctcaagatcttctggggctgttcacagttcatggtcctcacattcgcctcagaataaatctctctaaatattttgcaaggttgctttttcatcagtagttctaacagaacctactctgtggtttttgttaaaagcattatattaatatagtattagtaatattagtattagttataacacatgttggaaaattcttatgaagttatgcatagactaacaatgggatcaagtgtaaatgtttcaaagtatttaagcaagttatttcaaaatttatcttctgcagatacttctatcagattcattatatcagctaattacttgctttatgatttttgcattttattgtagatgatcacaccctatattttcttggcctttattgtagaaaattgtgtgaaactagtcagggctacatttgcaagtaattgtcgcagtggctgcctgaattgcagtgggtttcctctgcagccaccagtcactcagattactccaatgacaccttaattttgtttcctgcttggctttgggccttagtcttgtgctctccagacagactctgtctttcatctcccctaggtcaggccagagccacatggacctgatgattgtcaatatggtgggaagggtcgcactgaacgggcactctctgtccttctgagggagccatactgcaggcagacatggcagtcctggctcagggtgtgtccttccaagtatccctgcccttccttcaggtgtgatgctgatccatgcatcttcctcccattcctgggtagagggtctccttgttctttccccaatcttctcccagcagccactatgtcttcccactgatgtcttcagcttcctcttttctgcccttcccagcagatgagtctgttattcctgagggaagagagaggaggtgggagatgaggctgttattcctgaaagaatggacagagctttggagcttttctttcttctaccccagtttctacgagttcctccagtgcctgtaacacagagctgtcagtggctttgcccctgcatgttaattctttggtcatgtagtggtggtgagggagctgggtctggatgcatttcagccacagctgctgttccacttccccacacagaaccgtctcaggaggaagaggttggagatttttctgatgtgtcctcaatcctgggagaaaagttttcaatagcaataggaatctctcagttgtatgtccgctgagaatttaaacaataacttctttataatactaaattttaaacaatccaatgaatatatctaatttaattttgtattagcttatgtgacatttgctggcctctcccccagataaggtcatattctcttcctgtttgttcctgcaagtcactgaatttcacaagatgtaaggtctcttgattatactataacatcaataatctggtgtactaaagaaaatgtgctaatttgcagcttactaaaattagttgttttagtaaaaataatatatttgttatagcatgcctacatctccaggctgagtagaagctttgtttgtaatactcagaaactgcaaataacacacatattaaggagctttctaaataaatactatgggtgaattctttaactggaatactgttcctcattagaatcaacacattctttatacacaaccaaattactgactcacaagtaattatactgagcaagaagccacacaaatgaaattgaaaatataagatttcactttaacaaaatcttgaaaaatagatctgaattaacaaagatgagaggttgactcagtatggtgagagggaaataatggggaggcaggaatgagaggaacacagggaggcttttaactgtaatcatcgttatctcgattgttattttggatacacaggtgagcacacgtgaaattacgttttttttccttcggagacatggttttgctttgtcgtccaggctggagctccgtggtgagatcatagctctctgcagcctcagaccctgggtctccagcaatcctcctccctctgccctatgtagctgggactacaggtgtgcaccaccatgctcggcttcagtgcgtattaaaccgcacacttcaattatgcagtatttattatatagcaataatgcctcaataagggtattacaaataagtggatagataatttgttaaagattgatggaaagatagataccaacatgagaaatgtatgacactcaagaaaataaaactgtaggaaacttgcttttctttatatttgttaggtaatcaccacagtgtgtacacatcacaccatgttcccattacagagaaaaggttctgcgaacctcacgagctgtgacccctgtgtgctgggcttggttcagggagaagtcaggtccagtggtgagaagcacaggcccagatgcccaggctcactctgaccaaatgtgagcactggggacattgtaaaacccacctgtgcttttgctgataatttttcatctttaacatggaaataatattgatactatataccatggtttctctgcgtatgtaaaaataaaagatgattggtgctaactttaaaaatatgcagtttatgtagatctatggtacctcaataaaactgttttaaaataaaaattacaaaattataagattttcaggttttaaggtttaagtttatcacaaaacaaactgacaataggaaagcacaatttcccaatgctttcaatatcacagatctccccgaggacattctgacatgctctgagccccactatctccaaaggcctctcaccccagagcttactatatagtaggagatatgcaaatagagccctccgtctgctgatgaaaaccagcccagccctgaccctgcagctctgagagaggagcccagccctgggattttcaggtgttttcatttggtgatcaggactgaacagagagaactcaccatggagtttgggctgagctggctttttcttgtggctattttaaaaggtaattcatggagaaatagaaaaattgagtgtgaatggataagagtgagagaaacagtggatacgtgtggcagtttctgaccagggtttctttttgtttgcaggtgtccagtgtgaggtgcagctgttggagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaaagacacagtgaggggaagtcattgtgagcccagacacaaacctccctgcaggaacgatgggggggaaatcagcggcagggggcgctcaggacccgctgatcagagtcatccgcagaggcaggtgcagatggaggctgtttcctgtcagggtgtgggacttcatcttcttctgacagtttctctagtgaacctctctaacctcagaattctgtgcttactaatgtcatctctacgtattttttaaaagatcattttaatatgagcacctattctcacacgcaccaaatgcagattgacgcttacagagatgaaaagttctcaaccatggtcaccaggatgagagtcctgaggaaattcaggggtgcctggtgactcttccgcaatcagtcctgggacagaaacctcagggacagcctttatgagttttgatcacatctaacagagaggatgggccagggccagagtcatgtagaacctcacaggttccacgtctgacccttctcctgacactaaagccaatcagcatcagcactgacctggtgctccttttgctcccaatccatgttctttctttggagagtttcttctcccttttttatttgcttttcctctttcctgaaaaagaaacagatggtccccttggtccacattccagggctcaaggcattttcttggagctcaggtggggctcaggctgtggctcctgcagccacgtgggagaggctgatgggacttccttctctccccattttctcaggaccctctactgtgttgtgtgtaggctcatctgggaatgcagttgaccattaatactgaaggggacaaactcatttgatcaaaatgggatgtggatgtggagttaaccctgttccgtgcacagtgtcagagtcgtctgcttcagaagtagtgttagaaagagctggtgaaatttatcagaatcaagatggagccacttgtgttaaagccctaatgaatgaagctggggaaggccatgaaggagggttctaacacacatattcctgataataagaactaccataaatagactctgcacaaccataaccttgcacagaagccaccacaacattaaaagaattacttctcccattgtatctgcccagcaactccctgttcaactttacaccgatgtgcccctgttattgatccttctagcccaggacaattgtcttaaacagctgatgtgaccctcctcatttttcctttattctttatcttcctataccaacctgaatgcacccatacatttcaattgcaatacacttcctagaatacatattattatattttagagtctctctctctctgttattcagggttgacaagctacagatggacatgccactttctttttttatgactttttttaaaaattttattattcttgtactttaagttttagggtacctgtgaacaatgcaggtttgttacatatgtatacatgtgccatgttgttgtgctccacccattaactcgtcatttagcattaggtatacctcctaatgctctccctccccactacccccaccccacaacagtccctggagtgtgatgttcctcttcctgtgtccatgtgttctcattgttcaattcccacctatgagtgaggaaaaaaatgatgagttcatgtcctttgtagggacacggaagaaactggaaaccatccttctatcattctcagcaaactatcgcaaggacaaaagacatgccacttttctgtgagatgtggaggatgacagtttttggagatgtctgggaatacccagtgtccagaagatcatccatcaataagtgcaggctggaggtcccagagagaggcaaagctgctgaaacaccatggaatttcattttctccagttctgctctgatggaatcaggcccacctgttttgcttgtcttaagtaaattcacagcaccacatatattagtgttgcagtgaataactacaaagtctatcctaaccaagtgtaccatcaaatttaccattacccagagggaagaatctttaacatgagatctatgttcataattttttaaggtgaaaaagtgatcactatccaatcaggcaaatatgattttgctaatgagtggtagatgttgcatgtatttttggatgtcatccctttttcagatgcatggcttgcaattatattttcccattctgtaggttggaattatttccacactttgtagaatctttttgttgtgatgtagttccacctgtttaattctgcttttgttgtctgtgcctttaatgtgaaatataggaaatcattgttaatatattattttctgggtcggggaaattttacaattgcaggccatatgtttaaatatctggcccattcagagtgatttttgtgtttattctaacccaaaattcttaactctttgcatgtgtacatccagtttttctaacacattcatagggagagacttggtttatctgttttatattgtgggttcttatgctgaaaatcagtttgccattgatacatcagtttatttctgagctctttctacatatttatgccaactccatcctgtttttattattctacttttgttattacttttgaaatctggaagtaagatgtaagtttatttttgcctttttacagatgctatagcaaaatattttaacctttcactcttccatataaaagtatggctttaaataatgacttttattatatacaggttatattcttgtattcctaacttttagaggttttattatgagatcttgaattttttaaatgttattttctatgtctggtgagaagttaactgatgcttttcctttattctcttaatttaccacatcagatttattgatttgaagatattgattcatcagcgcatctcaaaaataatttggagcttgtcatggtgtacaatccttttaaagtcttatagaacttagttgactatgaattgggagtagcttgtttatatatactaagaacatttgtcagaagctctttcttgtttattcccagtttgcacttacatatactataaaacataatatataaattttttattcctttcatagttatataatatagcaattacaaagataaaaactgcacttcatcttgattttcccattttgtacagtcttaatttcttcgtatagatttatgttttgaatgtatatcacacggctactagcagagaaagtttgttaaaatgtgcactgaagcatgaatgtgctgacaataaattgtctcaagatctttttgtaatgacagaattttatttgcctttcacttttaatgaaaatgtaatgcacatagaattccagtttgcatttcacttgtaatttattttcttgtgtttattattttgttcatggagatgatcacacattacattctgctgggcctttattaaccacatttctatgaacctagtcagggttggatttcaagtgtatggttgccacggctatcagagttgaagtcagcttctcctgttcacaaaaagttcaggttcctccagtgatacccacttttgtgtcccggtttggctcttcccatttctttctccccagagagagcctgtctctttcatctgtggcaggtgcatcctgctgacacttttacttggtgattgtttgtggggtgaaagggcttggacacagggggatgttctccaaccttctgaccaagcatccttcttagctatgggtggtgagaatggctctgaagcatggtcttccaagcgttcctgttccttcccttccccaagtcagagtgtctctttctagccacagtggtcttccatcagtgtcctcagcttctgacccactgtccttactccacagactcaggatttcattcctcaggaaagagacgggaggtgtttctgggtagagtctccttagtgtcctctgtttccttctgttctagttgattctaccagtgcctgaaggacacaagatttaataaatgtctcccacatatcgtgaagagggattcagcattgaacggagctactgttcttcctccccagtcaacatcacaggacagcaggtggctgagttgtctggggatttctccaattctgtaggaaaagcccgcaagtgccaggagtttcacactctcacagcattagcacacacatcctcaacaactcatgaaacatttccaggttagctttttcctatcttcaataccatacaatgagtggcacctgccccaggtactctaataaatggacctagttttctctgcaggctccccattttctcagatttcaggggtttttttctctgcaacatcaactcagatatgttgaagggttcattttttgtagttcttcaagtttcttgttaatgaggtcagaagaagatcattttctcatttttttttttacattcccgtgcttagtatctgctttctaaataaaattcggaaactaagacaaaatatcaaatatccactatttggtgcattgttaaactatttgagaaatattcatgtactgaaatacaatgaacaattgaaatcaaggcatgcctcagtcacataagaatgtgaggacattatcaaataattgtgctgagtgaaggaagctaaagaattcacagtaaatctcctgtgatttcttttgtataaattgtagaaaatgcaactattctaaattaacatggagaagatctgaatttttctgagaaaagtgtggtgaggtaacaagatggtgaaataaaattacagagaagtgagagaaaaaaatttggaggttaatttaattgctaatagcacgattgaagtgctgattcaaaggctgcacacatataccaacattttccatatcgtacactataaatttgaattcactattgattgaatttttgaataaagcagtaacaaaaatgagtatattggctgaggaagagcaagaaagagatgaatattgacacttgaataatcacggactcctgaaaatacacacatgtgaacactgattgcatatttcaggtaaatactagaaaaagcaaagtcacataaagtcgttatgacaggtgggataccctgcaaatcacactaggcatgtcccacactgccctggagctgtctcaggggagcagtctcctccagtgtttagaggcacaggcacggataatagggctgacgctgtccagatgtgtgatattggacacattgcacaactgctctgttatgtatgtaattcatcttctctaaaaatgtaacattgacacttgcactgaatatattctgcaaatatgtaaacattaaataagatgatgactgctaattgatcatcaagtcacaatcacataatctgaagttatattttcctgagagataggattacctccagtgttttccgggaccctctcatctgctctgggcactgccctctcctccagcgtcccactagagcttgctatatagtaggagacatgcaaatagggccctccctctgctgataaaaaccagccgagcccagaccctgcagctctgggagaagagccccagccccagaattcccaggagtttccattcggtgatcagcactgaacacagaggactcaccatggagtttgggctgagctgggttttccttgttgctattataaaaggtgatttatggagaactagagacattgagtggacgtgagtgagataagcagtgaatatatgtggcagtttctgactaggttgtctctgtgtttgcaggtgtccagtgtcaggtgcagctggtggagtctgggggaggcttggtcaagcctggagggtccctgagactctcctgtgcagcctctggattcaccttcagtgactactacatgagctggatccgccaggctccagggaaggggctggagtgggtttcatacattagtagtagtggtagtaccatatactacgcagactctgtgaagggccgattcaccatctccagggacaacgccaagaactcactgtatctgcaaatgaacagcctgagagccgaggacacggccgtgtattactgtgcgagagacacagtgaggggaagtcagtgtgagcccagacacaaacctccctgcaggggtcccttgggaccaccagggggcgcccgggacactgagcacggggctgtctccagggcaggtgcaggtgctgctgagggctggcttcctgtcgcggtctggggcggcctcgtcgtcaaatttccccaggaacttctccagatttacaattctgtactaacatttgatgtctctaagtggaaaacgtttttgtcctttttgtttctttgtttttgtaacaagaggaaacatcctcagctccacagaagccagggtgtcactttggggacagaaataatcctttcatggtcaccaggataagagtcctgaggaatcccagggaaacctggagagtgttttccagttagactcagggcagagacctccatgggaatctctgattagaacaggccttgagctctgacgggagccaagagagaggctcgcccagggtcagagtccttaaaacctgatggttttcacagctatcccccctcgtcttgtaaactcagactgattcagttgaccctctttctgctaatccatttccttctctgtaggtttgattctcacagttcgctttcttcttctcttccctgaaaacagacgatgtgttttctgtagtcaaaatcccagggctcaggtctgcaggacctgggtaggctacggggactttctcactcaccattgtctggacactcttgtcttctgtgcatggaggcatttggaaaatgaagtggacattagccatgaagggaataatactagttttctccaataggatattgatgtagagctgatcttgtgcttctcacactgtctcagagtttggactttcacctgtgactttgagaagagctggggatgggcactccattgtgctgtgagctctgggtaacgataattgtagaatctgcctaggcagtctaaggtcaatactactggtcatcaggaaagacagctggaattcctgggaagatctgcatctgccgtccaccatggagtcccatcgtcttctgttatgctctctttgaatcagtcccacctagattatctagaacactcttcctgacttaggaaaaataatggcaggctccactaacacctgtgttatgccatgggagcaacacctaagctagtgtgtgaatgagtagatgagactgtggtctagtcaaggtgacaggtaaaattgattgttgccattatgatattttattttatatttggcaatatagtcatgctcctattataaatattttttgagacggagtcttgctctgttgccagcctggagagtgcagcagcacgatctcggctcactgcaacctcttccacctcccaggttcaagcagttctcctgcctcagcctcccgagaaactgggattacaggtgcacgccaccatgcctggctaatttttgtatttttagtatcgacagggtttcaccatgtgggccagtgtggtctcgatttcctgacctcgtgatctgcacacctcggcctcccaaagtgctgggattacaggcatgagccaccacacctggcctagttttattaatgtctgtccataccagcaactacatacctatggggacattaatttacatctgcagacagatgtgtaaatacacaagcctatacatacatgtgtagccatttatatttaacattataataaaataattctaaaatattttctaaagaattaaacttaatgatgagctaaatataaattagagtaatctataattgatttcgatcattctctatagtttgcataaatggatgtctatttctaagccttaacatagtgtattcgtcattttaaaacagtcaagaaaaaattacaaatgttcttgtcacaaaaaaagataaggatttgatgatttgaggtaatatatatgtcaattaacttgattcaattattctgtattgcattcacaaaccataacatacctttgtgccccataaatatatacaaccaaaatttctcaattttcaatgaaattttaattatatatttttaaatctgatgcctctccttggattaagccacctcctcaggcttacagggctcttccattttctcaacatgctgttataccagatgagcacaaacacattaatttcattatgcttagctttaatttttcaaaacaacatgaaggtgataattttaccaatagacgtattgcaacctactatgcatgagaccctttctgtgcttcaaggtttcttctcaggactttatatgtattgcaaattttcatttttttctgatatggaatgctgatttctctttattacagattatcagtttatttttcaaatttatctcttaaaattaattttttcaaagtcccactcaaaccagggtattattagaactttgaagtgtaatagttggaccaactttgagaatacattcaatttagttcacgtgctctcaagtatcttttcttctttaaaagttgttgtcagttgtaatatcacacaaaatattagtaatttatactaatgacacaggttaaaatattgtataaataatttaattacatttgattggaaaaaaggaatatatgttcctcatatcttgacttttttttcttctctatgagatgcatgtttattaattattaagtttaagatgttacccttgtctttttgatttctgggatttaattttagtacatatacttgaatgcattgtattaattcatataataatgttcatattttggatagggttttaatattaattttgttattactgaattttaaactattctacactttttcattttttgtttttatgcgataaaatttacatataagaaaatatgcatagatctggaatgtatcactagagagtttctggcaaatgtgaatacccttgtccccagcacctaaggtagctgaagagcaagtccatccccacatcgcgggtctttccctgtgcctgcggtcaactcctgcatggggaaatgttttgatttctcacactacagatccatttttttccgttttgaactttatataaatggaatcaaacattatagaccttttttttgaaaggggcttcgatatttttgagattaattcatgctatttaatgtataaaattagatcaacatattgtcatttattcaattcatggactgactctgatatgaaacctcaaagttttcatgtatatatggagacagggagaggaaggagaaagattttatatctgagtcagtccattaagtaaataaatgagaatattttgatttattttcctgttgatgtactttaaatttgtttccattttatgaatattataggcaaagccgttacaaatatattagtgtaggttttcctatattgtctcatttttgttgagaaaatatgaagtatatatttctttttttatttttgattactatttatttatattttatattttactttaagttctgggatacatgtgctgaacatgcaggcttcttacgtaagtatgcatgtgccgtggcggtttgctgcacctatcaacctgtcatctaggtttgaagcacctcatgcattaggtatttgtcctaatgctctccctcccctttcctaatgcttttcctcccctgacacatcccagtgtgtgatgttcccctccttgtgtccatgtgttctcattgttcaactcccacttatgagtgagaacatgtggtgtttggttttctgttcctgtgttagtttgccgaggatgatgatttccagcttcatccatgtccctgcaaaggacatggaaatcattcttttttatggctgcatagtagttcatggtgtacatatgccacattttttcatacagtctatcattgatggacatttgagttggttccatgtctttgctattgtaaatagtgctgcaataaacatacatgtgcatatgtctttatagtagaatgatttataatcctttgggtatatagccggtaacaggactgctgggtcaaatggtgtttctcgttctagatccttgaggaatttccacactgtcttccacaatggttgaactgatttacactccccctcaacagtgtaaaagtgttcctatttctccacattctcaccagcatctgttgtttccagactttttaatgatcaacactctaactggcatgagatggtgtctcattgtgattttcatttgcatttctctaatgaccagtgataatgagctttttttcatatgtttgttagctgcataaatgtctttttttgagaagtgtctgttcatgtccttcgctcactttttgatggggttgttttttttttgtaaatttgtttaagttccttgtagattctggatattagacctttgtcagatggatagattgcaaaaattttctcccattctgtaggttgcctgttcattctgatgatagtttcttttgctgagcagaagctctttggtttaattagatcccatttgtcagttttggcttttgtcgtaattgctttggtgttttagtcatgaagcctttgcccatgcctatgtcctgaatgatactgcctatgttttcttctagggtttttgtggttttagattttacatttaagtctttaatgcatctagagttaatttttgtataaggtataaggaagggatccagtttcagttttctccatatggctacccagttttcccagcaccatttattaaatagggatcatttccccatcgcttgtttttgtcaggtttgttgaagatcagatggttgtagatgtgtggtgttatttctgaggcctctgctctgttccattggtctatataactgttttggcaccactaccatgctgtttttgttactgtagccttatagtataatttgaagtcaggtagcatgatgccttcagctttgttctttttgcttaggactatcttggctatacaggctgtttttagttccatatgaagtttaaggtagttttttctggctctgtgaagaaagtcaatggtagcttgatgggaatagcattgattgtataaattactttgggcactatggtcattttcacaatattgattcttcctatccatgagcatggtatttatttattataaaagtaactttaattttttcagttttaatgaggaacaattgaaatatttttaaatgtatatgtttaaggtgcaccacttcatgttttgatattgtgttagtccattctcacactgctataaagaaatgcctgagactgagtaatgtgaaacaaaaaaatagatgtttaattggctcatttttctgcagactgtacaggaagtgtagtggcttctccttctggtgagactcaggaaagttagaatcatagcagaagacaaatagtagtagacacatcacatggccagagcaggggccacaggaagagagggaggtctacacagttagacaaccagatcttatgataactcacacaatattatgagaacagcgccaagagtcagtgctaaaccattcatgaaagacccaccccatgacccaagcatctcccactgggtcccagcttcaggattgaggattataatacaacacgagattcaggccaggacgagttgcaaactgtatcagatacacattgtaaaatgctcatcatgatcaaggtaatttgtgtgcctatcatcccacatacattttttttttaaatggagtgtgtgtgtgtgtgtgtgtgtgtgtgtgtgtgtgatgagaatatctaagatctaccctttcagcaaaaatcacttttacaacacagtattaaatacaggaacattgctgtagattagatctccagaactcattcaacctgcacacctgaaattctgtaccctttaaacatcacccaatttccctctcctcccacatcctgggacccattattttactttctgctttcaagagcttgggtgttttagataccacatgtaaatgagataatgcagcatttgtctttctgcatctggcttattccacttagcatcatgtcctccaggcccatccgtgttgttgcaaatgtcagaatttccttcttttcaaagcctaataaaattcagttttatgtgtacacattttctttatacattcatcagtctgtggtcattaaattattttacaaatctacactattataaataaccttgcaatcagcatgtgtttaacataataattttacttatttgaatacataacaagaagtgggatcaccagatgatatgatagctttatttttcaatttattgagtaaccaatcctaccacaccctaaaaggattctcttttcaccacattcttgccaatatgtgttatatgtcttgctgatgatagccattttaagcagagtgaggtgataactcatcatgattttgatttgaattcctctgataattagtaatgttgagaaccctttgaggctctgtttttcatgtgtgtgttttctgaagaaaaacctatccagtttttgccctttttatcagatcatttgttatttgctattgagttgcatgagttatttatacttttggatagaacttatgtcaggtatataattgcacatagtttttttcctgtgcttttttctattaaattcaaagaaatcatttctgaatcaatgacaggaagtttttttccatgtgttctatgagtttgtggcttcaggttatgttcatttttagtttatttttgaatacggtgttagagaaggtctaattttatttcttttgcatatggatgttaagcttttacatcatatattgaggagactgtccatccttcactgtgtgttcttgggatacaaaatcaggaagatgcataatttaaaaagaaaacatcagatgaatattcctggtgaatatagaccgaaaagttctcaacaaaatactagcaaatagaatccagaagcactttaaaatgtaatacctcatgatcaagtaggctttacccctggaaggcaaggttcattcaacatccacaattcagtaactgtgattcaccatgtaagcagaataaaagcaaaaaccatatgattatctcaatagatgctgagaaagcttttgataggatccaacatccgctcataataaaagccctcaacagactaggcatcaaaaaaacttacctcgaaataataagagccatctatgaccaatccacagtcaacattatactgagtgagcaaaagctcaaaaccctttagaagtgaaagaagaccaagatgccctctcaccactgctattgaacatagtactagaaaccctagtcagagcaaccaagcaatatcaaaataaaaggcagctgatatggtttgtacttgtgtccccactcaaattaaatgtcaaattgtaatacgcagtgttgagggtggggcctgatgaaaggtggttagatcatggggatgagtctctctctcgtgctgatcccatgatagagccctcaggagatctggtttcaaagtacgtggcacctccctcgtctttcttcctcctgctccagccaggtaggacatgatgcttggcgcgggccgcctggccgtcgacatttaggtgacactatagaaggatccgcggaattctctttcttgtttattcccagtttgcacttacatatactataaaacataatatataaattttttattcctttcatagttatataatatagcaattacaaagataaaaactgcacttcatcttgattttcccattttgtacagtcttaatttcttcgtatagatttatgttttgaatgtatatcacacggctactagcagagaaagtttgttaaaatgtgcactgaagcatgaatgtgctgacaataaattgtctcaagatctttttgtaatgacagaattttatttgcctttcacttttaatgaaaatgtaatgcacatagaattccagtttgcatttcacttgtaatttattttcttgtgtttattattttgttcatggagatgatcacacattacattctgctgggcctttattaaccacatttctatgaacctagtcagggttggatttcaagtgtatggttgccacggctatcagagttgaagtcagcttctcctgttcacaaaaagttcaggttcctccagtgatacccacttttgtgtcccggtttggctcttcccatttctttctccccagagagagcctgtctctttcatctgtggcaggtgcatcctgctgacacttttacttggtgattgtttgtggggtgaaagggcttggacacagggggatgttctccaaccttctgaccaagcatccttcttagctatgggtggtgagaatggctctgaagcatggtcttccaagcgttcctgttccttcccttccccaagtcagagtgtctctttctagccacagtggtcttccatcagtgtcctcagcttctgacccactgtccttactccacagactcaggatttcattcctcaggaaagagacgggaggtgtttctgggtagagtctccttagtgtcctctgtttccttctgttctagttgattctaccagtgcctgaaggacacaagatttaataaatgtctcccacatatcgtgaagagggattcagcattgaacggagctactgttcttcctccccagtcaacatcacaggacagcaggtggctgagttgtctggggatttctccaattctgtaggaaaagcccgcaagtgccaggagtttcacactctcacagcattagcacacacatcctcaacaactcatgaaacatttccaggttagctttttcctatcttcaataccatacaatgagtggcacctgccccaggtactctaataaatggacctagttttctctgcaggctccccattttctcagatttcaggggtttttttctctgcaacatcaactcagatatgttgaagggttcattttttgtagttcttcaagtttcttgttaatgaggtcagaagaagatcattttctcatttttttttttacattcccgtgcttagtatctgctttctaaataaaattcggaaactaagacaaaatatcaaatatccactatttggtgcattgttaaactatttgagaaatattcatgtactgaaatacaatgaacaattgaaatcaaggcatgcctcagtcacataagaatgtgaggacattatcaaataattgtgctgagtgaaggaagctaaagaattcacagtaaatctcctgtgatttcttttgtataaattgtagaaaatgcaactattctaaattaacatggagaagatctgaatttttctgagaaaagtgtggtgaggtaacaagatggtgaaataaaattacagagaagtgagagaaaaaaatttggaggttaatttaattgctaatagcacgattgaagtgctgattcaaaggctgcacacatataccaacattttccatatcgtacactataaatttgaattcactattgattgaatttttgaataaagcagtaacaaaaatgagtatattggctgaggaagagcaagaaagagatgaatattgacacttgaataatcacggactcctgaaaatacacacatgtgaacactgattgcatatttcaggtaaatactagaaaaagcaaagtcacataaagtcgttatgacaggtgggataccctgcaaatcacactaggcatgtcccacactgccctggagctgtctcaggggagcagtctcctccagtgtttagaggcacaggcacggataatagggctgacgctgtccagatgtgtgatattggacacattgcacaactgctctgttatgtatgtaattcatcttctctaaaaatgtaacattgacacttgcactgaatatattctgcaaatatgtaaacattaaataagatgatgactgctaattgatcatcaagtcacaatcacataatctgaagttatattttcctgagagataggattacctccagtgttttccgggaccctctcatctgctctgggcactgccctctcctccagcgtcccactagagcttgctatatagtaggagacatgcaaatagggccctccctctgctgataaaaaccagccgagcccagaccctgcagctctgggagaagagccccagccccagaattcccaggagtttccattcggtgatcagcactgaacacagaggactcaccatggagtttgggctgagctgggttttccttgttgctattataaaaggtgatttatggagaactagagacattgagtggacgtgagtgagataagcagtgaatatatgtggcagtttctgactaggttgtctctgtgtttgcaggtgtccagtgtcaggtgcagctggtggagtctgggggaggcttggtcaagcctggagggtccctgagactctcctgtgcagcctctggattcaccttcagtgactactacatgagctggatccgccaggctccagggaaggggctggagtgggtttcatacattagtagtagtggtagtaccatatactacgcagactctgtgaagggccgattcaccatctccagggacaacgccaagaactcactgtatctgcaaatgaacagcctgagagccgaggacacggccgtgtattactgtgcgagagacacagtgaggggaagtcagtgtgagcccagacacaaacctccctgcaggggtcccttgggaccaccagggggcgcccgggacactgagcacggggctgtctccagggcaggtgcaggtgctgctgagggctggcttcctgtcgcggtctggggcggcctcgtcgtcaaatttccccaggaacttctccagatttacaattctgtactaacatttgatgtctctaagtggaaaacgtttttgtcctttttgtttctttgtttttgtaacaagaggaaacatcctcagctccacagaagccagggtgtcactttggggacagaaataatcctttcatggtcaccaggataagagtcctgaggaatcccagggaaacctggagagtgttttccagttagactcagggcagagacctccatgggaatctctgattagaacaggccttgagctctgacgggagccaagagagaggctcgcccagggtcagagtccttaaaacctgatggttttcacagctatcccccctcgtcttgtaaactcagactgattcagttgaccctctttctgctaatccatttccttctctgtaggtttgattctcacagttcgctttcttcttctcttccctgaaaacagacgatgtgttttctgtagtcaaaatcccagggctcaggtctgcaggacctgggtaggctacggggactttctcactcaccattgtctggacactcttgtcttctgtgcatggaggcatttggaaaatgaagtggacattagccatgaagggaataatactagttttctccaataggatattgatgtagagctgatcttgtgcttctcacactgtctcagagtttggactttcacctgtgactttgagaagagctggggatgggcactccattgtgctgtgagctctgggtaacgataattgtagaatctgcctaggcagtctaaggtcaatactactggtcatcaggaaagacagctggaattcctgggaagatctgcatctgccgtccaccatggagtcccatcgtcttctgttatgctctctttgaatcagtcccacctagattatctagaacactcttcctgacttaggaaaaataatggcaggctccactaacacctgtgttatgccatgggagcaacacctaagctagtgtgtgaatgagtagatgagactgtggtctagtcaaggtgacaggtaaaattgattgttgccattatgatattttattttatatttggcaatatagtcatgctcctattataaatattttttgagacggagtcttgctctgttgccagcctggagagtgcagcagcacgatctcggctcactgcaacctcttccacctcccaggttcaagcagttctcctgcctcagcctcccgagaaactgggattacaggtgcacgccaccatgcctggctaatttttgtatttttagtatcgacagggtttcaccatgtgggccagtgtggtctcgatttcctgacctcgtgatctgcacacctcggcctcccaaagtgctgggattacaggcatgagccaccacacctggcctagttttattaatgtctgtccataccagcaactacatacctatggggacattaatttacatctgcagacagatgtgtaaatacacaagcctatacatacatgtgtagccatttatatttaacattataataaaataattctaaaatattttctaaagaattaaacttaatgatgagctaaatataaattagagtaatctataattgatttcgatcattctctatagtttgcataaatggatgtctatttctaagccttaacatagtgtattcgtcattttaaaacagtcaagaaaaaattacaaatgttcttgtcacaaaaaaagataaggatttgatgatttgaggtaatatatatgtcaattaacttgattcaattattctgtattgcattcacaaaccataacatacctttgtgccccataaatatatacaaccaaaatttctcaattttcaatgaaattttaattatatatttttaaatctgatgcctctccttggattaagccacctcctcaggcttacagggctcttccattttctcaacatgctgttataccagatgagcacaaacacattaatttcattatgcttagctttaatttttcaaaacaacatgaaggtgataattttaccaatagacgtattgcaacctactatgcatgagaccctttctgtgcttcaaggtttcttctcaggactttatatgtattgcaaattttcatttttttctgatatggaatgctgatttctctttattacagattatcagtttatttttcaaatttatctcttaaaattaattttttcaaagtcccactcaaaccagggtattattagaactttgaagtgtaatagttggaccaactttgagaatacattcaatttagttcacgtgctctcaagtatcttttcttctttaaaagttgttgtcagttgtaatatcacacaaaatattagtaatttatactaatgacacaggttaaaatattgtataaataatttaattacatttgattggaaaaaaggaatatatgttcctcatatcttgacttttttttcttctctatgagatgcatgtttattaattattaagtttaagatgttacccttgtctttttgatttctgggatttaattttagtacatatacttgaatgcattgtattaattcatataataatgttcatattttggatagggttttaatattaattttgttattactgaattttaaactattctacactttttcattttttgtttttatgcgataaaatttacatataagaaaatatgcatagatctggaatgtatcactagagagtttctggcaaatgtgaatacccttgtccccagcacctaaggtagctgaagagcaagtccatccccacatcgcgggtctttccctgtgcctgcggtcaactcctgcatggggaaatgttttgatttctcacactacagatccatttttttccgttttgaactttatataaatggaatcaaacattatagaccttttttttgaaaggggcttcgatatttttgagattaattcatgctatttaatgtataaaattagatcaacatattgtcatttattcaattcatggactgactctgatatgaaacctcaaagttttcatgtatatatggagacagggagaggaaggagaaagattttatatctgagtcagtccattaagtaaataaatgagaatattttgatttattttcctgttgatgtactttaaatttgtttccattttatgaatattataggcaaagccgttacaaatatattagtgtaggttttcctatattgtctcatttttgttgagaaaatatgaagtatatatttctttttttatttttgattactatttatttatattttatattttactttaagttctgggatacatgtgctgaacatgcaggcttcttacgtaagtatgcatgtgccgtggcggtttgctgcacctatcaacctgtcatctaggtttgaagcacctcatgcattaggtatttgtcctaatgctctccctcccctttcctaatgcttttcctcccctgacacatcccagtgtgtgatgttcccctccttgtgtccatgtgttctcattgttcaactcccacttatgagtgagaacatgtggtgtttggttttctgttcctgtgttagtttgccgaggatgatgatttccagcttcatccatgtccctgcaaaggacatggaaatcattcttttttatggctgcatagtagttcatggtgtacatatgccacattttttcatacagtctatcattgatggacatttgagttggttccatgtctttgctattgtaaatagtgctgcaataaacatacatgtgcatatgtctttatagtagaatgatttataatcctttgggtatatagccggtaacaggactgctgggtcaaatggtgtttctcgttctagatccttgaggaatttccacactgtcttccacaatggttgaactgatttacactccccctcaacagtgtaaaagtgttcctatttctccacattctcaccagcatctgttgtttccagactttttaatgatcaacactctaactggcatgagatggtgtctcattgtgattttcatttgcatttctctaatgaccagtgataatgagctttttttcatatgtttgttagctgcataaatgtctttttttgagaagtgtctgttcatgtccttcgctcactttttgatggggttgttttttttttgtaaatttgtttaagttccttgtagattctggatattagacctttgtcagatggatagattgcaaaaattttctcccattctgtaggttgcctgttcattctgatgatagtttcttttgctgagcagaagctctttggtttaattagatcccatttgtcagttttggcttttgtcgtaattgctttggtgttttagtcatgaagcctttgcccatgcctatgtcctgaatgatactgcctatgttttcttctagggtttttgtggttttagattttacatttaagtctttaatgcatctagagttaatttttgtataaggtataaggaagggatccagtttcagttttctccatatggctacccagttttcccagcaccatttattaaatagggatcatttccccatcgcttgtttttgtcaggtttgttgaagatcagatggttgtagatgtgtggtgttatttctgaggcctctgctctgttccattggtctatataactgttttggcaccactaccatgctgtttttgttactgtagccttatagtataatttgaagtcaggtagcatgatgccttcagctttgttctttttgcttaggactatcttggctatacaggctgtttttagttccatatgaagtttaaggtagttttttctggctctgtgaagaaagtcaatggtagcttgatgggaatagcattgattgtataaattactttgggcactatggtcattttcacaatattgattcttcctatccatgagcatggtatttatttattataaaagtaactttaattttttcagttttaatgaggaacaattgaaatatttttaaatgtatatgtttaaggtgcaccacttcatgttttgatattgtgttagtccattctcacactgctataaagaaatgcctgagactgagtaatgtgaaacaaaaaaatagatgtttaattggctcatttttctgcagactgtacaggaagtgtagtggcttctccttctggtgagactcaggaaagttagaatcatagcagaagacaaatagtagtagacacatcacatggccagagcaggggccacaggaagagagggaggtctacacagttagacaaccagatcttatgataactcacacaatattatgagaacagcgccaagagtcagtgctaaaccattcatgaaagacccaccccatgacccaagcatctcccactgggtcccagcttcaggattgaggattataatacaacacgagattcaggccaggacgagttgcaaactgtatcagatacacattgtaaaatgctcatcatgatcaaggtaatttgtgtgcctatcatcccacatacattttttttttaaatggagtgtgtgtgtgtgtgtgtgtgtgtgtgtgtgtgtgatgagaatatctaagatctaccctttcagcaaaaatcacttttacaacacagtattaaatacaggaacattgctgtagattagatctccagaactcattcaacctgcacacctgaaattctgtaccctttaaacatcacccaatttccctctcctcccacatcctgggacccattattttactttctgctttcaagagcttgggtgttttagataccacatgtaaatgagataatgcagcatttgtctttctgcatctggcttattccacttagcatcatgtcctccaggcccatccgtgttgttgcaaatgtcagaatttccttcttttcaaagcctaataaaattcagttttatgtgtacacattttctttatacattcatcagtctgtggtcattaaattattttacaaatctacactattataaataaccttgcaatcagcatgtgtttaacataataattttacttatttgaatacataacaagaagtgggatcaccagatgatatgatagctttatttttcaatttattgagtaaccaatcctaccacaccctaaaaggattctcttttcaccacattcttgccaatatgtgttatatgtcttgctgatgatagccattttaagcagagtgaggtgataactcatcatgattttgatttgaattcctctgataattagtaatgttgagaaccctttgaggctctgtttttcatgtgtgtgttttctgaagaaaaacctatccagtttttgccctttttatcagatcatttgttatttgctattgagttgcatgagttatttatacttttggatagaacttatgtcaggtatataattgcacatagtttttttcctgtgcttttttctattaaattcaaagaaatcatttctgaatcaatgacaggaagtttttttccatgtgttctatgagtttgtggcttcaggttatgttcatttttagtttatttttgaatacggtgttagagaaggtctaattttatttcttttgcatatggatgttaagcttttacatcatatattgaggagactgtccatccttcactgtgtgttcttgggatacaaaatcaggaagatgcataatttaaaaagaaaacatcagatgaatattcctggtgaatatagaccgaaaagttctcaacaaaatactagcaaatagaatccagaagcactttaaaatgtaatacctcatgatcaagtaggctttacccctggaaggcaaggttcattcaacatccacaattcagtaactgtgattcaccatgtaagcagaataaaagcaaaaaccatatgattatctcaatagatgctgagaaagcttttgataggatccaacatccgctcataataaaagccctcaacagactaggcatcaaaaaaacttacctcgaaataataagagccatctatgaccaatccacagtcaacattatactgagtgagcaaaagctcaaaaccctttagaagtgaaagaagaccaagatgccctctcaccactgctattgaacatagtactagaaaccctagtcagagcaaccaagcaatatcaaaataaaaggcagctgatatggtttgtacttgtgtccccactcaaattaaatgtcaaattgtaatacgcagtgttgagggtggggcctgatgaaaggtggttagatcatggggatgagtctctctctcgtgctgatcccatgatagagccctcaggagatctggtttcaaagtacgtggcacctccctcgtctttcttcctcctgctccagccaggtaggacatgatgcttccctttctgtactgattgtcaggatcctgaggcctccccagccatgcttcctgtatagcctgaagaaccatgaaacaattaaaaatctttataaattacacagtctcaggtgtttctttatagtttgcgaatggactaatacagaatccaaataggaaaagaagaactcaatgtatctctccaaactgatgatataattctatacctagaaaattctaaagaccctgccaaaataattctagaatagataaacaattttggtaaagtgttgggatacaaaatcaatgtacaaaaatcactagcatttctataccccaactatgtccaagctgagactgaaatcaagaacacaatcctatcccacttacaatattcacacacacaaaatatgaaatgcctggaaatacaggtaacaaacaaggtgaaggatctctgcaaggagaactacaaaatacagcagaaataaataaataaatcgtacatgacacatgactcatctgacaaagggctaatatccagaatctacaatgaacttaaacaaatttacaagaaaaacaaacaaccccatcaaaaagcgggcaaaggatatgaatagacacttctcaaaagaagacatttatggagccaacagacacatgaaaaaatgctcatcatcactggccatcagaggaatgcaaatcaaaaccacaatgagataccatctcacaccagctagaatggcgatcattaaaaagtcagggaacaacaggcgctggaggggatgtggagaaataggaacacttttacactgctggtgggactgtaaactagttcaaccattgtggaagacagtgtggcgatcctcaaggatctagaactagaaataccatttgacccagcagtcccattacttgctatatacccaaaggattataaatcatgctgctataaagacacatgcacacttatgtttattgtgtcactattgacaatagcaaagacttggagccagcccaaatgtccaccagtgatagactggattaagaaaatgtggcacatatacaccatggaatactatgcagccataaaaaaggatgagttcatgtcctttgtagggacatggatgaaaatggaaaccatcattctgtgcaaactatcacaaggacagaaaaccaaacactgcatgttctcattcataggtgggaactgaacagtgagaacatttggactcaaggtggggaacatcacacaccggggcccgtcatggggtcgtgggagtggggagggatagcattaggagatatacctaatgtaatgttaatgggtgcagcacaccaacatagcacatgtatacatatgtagcaaacctgcacattgtgcacatggaccctagaacttaaagtattatttaaaaagaaagaaaaaaactattaatttttctgaaccatgaacatggaatatttcagatatattttcaatttgtgtgtgttcactttattttttattatcaatcatttctggttttcttttagaaatctttcacttatttggtaatatgaaatataatttttagctattataaacaaaatgctttattgattttttgctgtttgcatttagcaatgccaccaatttttgtatgtaggtgttgtattctgcaaatttacagaattttttatcaattataacagtttttccagcaccatttattaaatagggaatcgtttccccatttcttgtttttgtcaggtttgtcaaagatcagatggtcgtagatatgcagcattatttctgagggctctgttctgttccattggtctatatctctgttttggtaccagtaccatgctgttttggttactgtagccttgtagcatagcttgaagtcaggtagcgtgatgcctccatctttgttgttttggcttaggattgagttggcaatgcaggctcttttttgttccatatgaactttaaagtagttttttccaattctgtgaagaaagtcattgatggggatggcatcgaatctataaattaccttgggcagtatggccattttcacgatattgattcttgctacccatgagcatggaatgttcttccatttctttgtgtcctcttttatttcattgagcagtggtttgtagttctccttgaagaggtccttcacatcccttgtaagttggattcctaggtgttttattctctttgaagcaattgtgaatgggagttcactcatgatttggctctctgtttgtctgttattggtgtataagaatgctagtgatttttgcacactgattttgtaccctgagacttcactgatgttgcctattagcttagggagatttggggctgagacaatggggttttctagatatacaatcatgtcatctgcaaacagggacaatttgacttcctcttttcctaatcgaataccctttatttccttctcctgcctgattgccctggccagaatatgtagaaagctgaaactggatcccttccttgcaccttatacaaaaattaattcaagatggattaaagacttaaatgttagatctaaaaccataaaaaccctagaagaaaacctaagcaataccattcaggacataggcatgggcaaggacttcatgtctaaaacagcaaaagcaatggcaacaaaagccaaaattgacaaatgggatctaattaagctaaagagcttctgcacagcaaaagaaactatcatcagagtgaacaggcaaccaacagaatgggagaaaacttttgcgatctactcatctgacaaagggctaatatccagaatctacaatgaactcaaacaaatttacaagaaaaaaacaaacaaccccatcaaaaagtgggtgaaggatatgaacagacacttctcaaaagaagacatttatgcagccaacagacacatgaaaaaatgctcatcatcactggccatcagagaaatgcaaatcaaaaccacaatgagataccatctcacaccagttgggatggcgatcattaaaaagtcagggaacaacaggcgctggagaggatatggagaaataggaacacttttacactgttggtgggactgtaaactagttcaaccattgtggaagacagtgtggcgatcctcaaggatctagaactagaaataccatttgacccagcagtcccattacttgctatatacccaaaggattataaatcatgctgctataaagacacatgcacacttatgtttattgtgtcactattgacaatagcaaagacttggagccaacccaaatgtccaccagtgatagactggattaagaaaatgtggcacatatacaccatggaatactatgcagccataaaaaaggatgagttcatgtcctttgtggggacatggatgaaaatggaaaccatcattctgtgcaaactatcacaaggacagaaaaccaaacactgcatgttctcattcataggtgggaactgaacaatgagaacatttggtctcaaggtggggaacatcacacaccggggcccgtcatggggtcgtgggagtggggagggatagcattaggagatatacctaatggtaaatgacaagttaataggtgcagcacaccaacgtggcacacgtatacatatgtaactaacctgcacattgtgcacatgtaccctaaaacttaaagtataataaaaaaaagaaaaaagagacccaattgttgacaaagttatgaaaaagatagtttttaaggagtctttaagtaatattgtattttctgcaaacagacaatttgatttcccctattccaaatttcaggacatttcttcttttttcttgtcaaattgttctggctagaattacagtaccatgtagaagtggtggaaaagagcatttttgtcttgttcaacatcttagagaaaaggctttcagtttttccagccttggtataatgcaagctgtgggtttcacatatctggactttattattttgagatatgtttcttgtataccaagtttgttgagaatttctataaggaatggaggttgaatttttttctatgactttcttaaagcaattaatcataaaataataataagcaggtcaatacaagatccataaattagtggaagctagttatttgcactgctgccatagagtaggatcactacacaactcatggtgttgatgggaaactataattctgcaataattaaagactagtgatttacactgggctctattgagagatttggttgtcaactacagaaatcgagatgaaggggcactgagaaacatttcgcttcatatcatctcaacttctaatatcaatttttagtactaatacagtcctattttctcagtatactgtctcacaggttatagtatatgtcttagaaaattaagggttgtttcattctaataattaactcagaaaaattcatttcctattatggatgacaagtgtaaattcatatcttaataattacccacactccaaaacactactacaggcaaaggcaagagaaaggcaggtatagatgagattctctgaggtcagttatgtaaatacccaaggactattgtctatgaccttgaatgtcactttcttcccttccatgagctacatccaggatattctgtgaatctgagagcgttgagcatgtttaattattttatctcactgccccttagtcttgctttctccagttgacaaccaaatctctcaacaataggcccagcgtaaatcaccagacttcaattattgtagaactatggtttcccaacaacattatgagttacaaaatgatactactttatggcagcagtgaaaatgatgaacttccactaacttatgaatctctgaatggctagcatggaggtgtgtatgtatcagcgcactgttctagaaatgttccgtttctgtccattattttatgtagtaatgaggacaacgtgaactaaagggagtatccatggccttataagcacagagaccacatccagtgcaggtgcagagcaaggctgcaacagtcagcaagttgctctctgaagagtcttccaattcccttgcccaaagcatctgctcattcatgggctgagaaaagggaagtcatgcatgcagtctactctctctacagagctgacaggggacacggacaacatcgattattcatggaattttcccataggaatgcagctgtgtgcacacacacataatacatttttaaatgttttttttatttatcctctccaattttaaaaaagtcatcaccttttctcctaatcaaagaggattttgaccagaatgcttggtgggagccccctgctctcccagatgcccacccttatttctcttgaagtgaagaacggcagctctcttgatttctactctcatcctctaggactaaaaccagaaggttccacgccccctgggtgaacatccaagaagaccctgtctgtagcagcaggagcctcaagccttgactgagagctatggtcctgaaatgagacagtgtcccccatggagagcacacgtggacgcccacaactgagggctcactgctcttcaccacagatgcgctcccttactgagtcctgagacctgagtgcaccccatagggtagggctcagaagaggggatgcaaatctccaccagctccacccttctctgtgttgaaaagccgagcatggggacctagttcagtgactcctgtgccccaccacatggagctttactccacgcttctcctgctgactgtcccttcctgtgagttcagtggtcagggaatccttcaggggtgaaacacctgttcttttctttgtgggcttcatcttcttatgctttctccacaggggtcttatcccaggtcaccttgaaggagtctggtcctgcactggtgaaacccacacagaccctcatgctgacctgcaccttctctgggttctcactcagcacttctggaatgggtgtgggttagatctgtcagccctcagcaaaggccctggagtggcttgcacacatttattagaatgataataaatactacagcccatctctgaagagtaggctcattatctccaaggacacctccaagaatgaagtggttctaacagtgatcaacatggacattgtggacacagccacacattactgtgcaaggagaccacagagacagagcccagggtgcctcttgtacaagaacccaggctgcttctcagtggcgctccctccccacctctgcagaacaggaaagtgtggctgagatgccatttcctgtcagggtctgggtgtcttatcctatctgactcagagccttgtcttcctccctcttctttagtaataaatggcatgacccctgttagtggttcatgcaagcagaggctgtatcctgtttgacaaagattcagcatgaaaggttcctgttacttgagccagatgcatcactgatatgtggccaccagtttcttagactcataccactttaagggaccaaatacaaatgtccatagcatatgccattcttaaactgcagaaatgatgtcaaagaagaatgtggagataagagagcaggaggaattatgaaaatctggatagcatcttctcttctagggtggaaggtatgctagtaaagtaatttaatgaaacaatcagacagatgcaatatgtcctcatcatggagtgtctcacatgggcagtgcacaaataaatttctaaaaattccataaggtagatgtgatggatgaggcttatttccacacagggagcccacaaatatccagagaagtaaaaaatctgacacttggaaagaaaattgcctcatcttgacatcagaaacccatttcaacatgtccgaggggcaatgtggaaaagaaatggaaacttcaaaaacacatttcttatgaaatgtctagctcatgtttgaacataaaaacagaattgtccatgattttagaaaaaccaacccatgacagcgagtcactacactcagaaacaccactgagtcaacagacttcagtctgtgagcaggtcagtactgaggccccaggtgaatcaaggctctcacgtacattgtacagaacccagaattgagccacacaatctataaccaagtcttctttgacaaactttacaaaaattaacaaaaaaatacaccagagaaattcaatatatgaaattcaatatacccattcaatatatggtgctggggaaattggttagccacgtgcagaagaacaaaactagacccccaccctcaacacatatatactcaacacaaaatgaattaaagacttacatataagacctcaaactataaatctactcaaacaaaacaccaggacaactcttctgggctttggcctaggtaaagaatttatgactaagaccccaaaagcaaatccaagaaaaaaatagacaaatgggacttaattaacctaaagcatttttcacagcaccggagtgaacagacaagttgcagagcgaaagaaaatttttccacaccacacctgtgacagggaactaatatgaagaatttgcaaggaactcaaactactctacaacaacaacagcaacaagaaccaaataactccgttaaaattagcagaggacatgagtagacattttcaaaagaacacataaaaatggataataaatatataaactacgctcaacatcactcatcatcagggaaatgcaaattaaaaccacaataagatatcatcttccaccagtcacaatgactattactaaaaactcaaaaatatcagatgttggtgaagatggaaaggaaagggaactcttagacactgttgatgaggatgtggatgaggacaacttctatggaaaatggtatggagatttcccaaaaaactagaaatagaactcccctttgatccagcaatcccactactgggtttactacccaaaggaaaataattttttatttccaaaagatatccacacttctatgtttatcacaaaactattatcaacagcacatatgtcaacctgagtgtccaccaacagatgattttataaaagaatatagcatatatgcacaattcaatactagtcagccacaataaggaatgaaactgtcttttgcagcaatatgcatagaactggaagacaacataattagtgacctaactcacaaacagagagtcacatgtcacatgttattatttataagtggaaggtaacaacgtgtccacaaggatatggagagagaaatgatggacaccagagacttagaaggatgggaggtggaaggtgggagcatgaggagacattacctagtgggtacaatgtacattatttgggtgatagtacactaaaagccaagaccactatggaatatagccatgtccaaaagtggcattcgtagtccttaagtttatacaagtaaatgtacacacaaataaaattaaaaatataaaataattaacagttgaccaatgatcttaaaagttgatttaaaatataatcaataaatgaaatgaatatcagttgaacctcattaaatttgaaaacgttttatactcaaatgactataagaaaatgaatgtcaagtttcagatgagaaactgtttgcaaatcattagccaccaacataagtataataagaaccctcagaactcaactgtgaaaaaaagaaacaacccatggatagaataggcaaaggtttgtgcagacatttcatcaaataagatgtacagatgacacataggcatataaatgggctcgcaacaggattttccattcgaaaaattcaaatcaagccgacagtgagacactactatacaatttttagaaattaagaagaaatacagataataccaatgctggtgagcatatcagggtccaagactctaaaacgttgcaaacaggaatgcaaaatgaaactgctactcaggaaaataatttatagttttttctaaaatcaaacattttcttaatatatgacctaaatatcccactcctgaatatttgtgtcagagaaatacaatcttagattcacaacaaacttccatttaaatgttcaatatattgtgctcacgtgtgtgtgtgcacgatagaaacaaaaagtaacatgaatgtctcaaaatttgaataggtaaaaagtaggaagtgtctattaattgaataccatcagcaataaaaaataacaaaatgactgatacacaaaccattacaggtgaactccagacatgatgctaagtgagagaagccagtctcaatgatcaaagggacacatctgtaagcaccacggtcatcctcaggtgtcagtggtttgggctgggctctctgtctctttcctgaccagacccagatgttgagctccgccacttgcagatggaaaattctactattttcaacaatgcactgaggtttgaactgcttcacagactgaacgaaacaaacacgggctcctttgaacagtgtgcagcatttgttccaaccacaagagaatgtctcccagctctgccccttctcagttttccctgcaagccagcagccctgcagtttagcctgcatctcccatgcatgcacccatctccttccaagggccttactccacaacctccacttattttgagtgcactgactggctttgaacttttccacattctgttgttattgaagttaggatgtttagagccatattaaggatcatattttatgactgaattccagtgccccctctctcctgggacagagcacgtaaccaacattctgcatgtggagacaaagatgagcttttttcttcctcagcctaggagatgagcgctcagtggagggttggatagaagcttcccaccttctcagcactccagttctggtggggagaacctctgccataggagcagagctagaaaccagggaccgaatgttcccagtgacactggacccagggtagagcctccatccacgagtggggctccatggaagaagcgagtctctggctctcagtagcttttgtccagaactgagccttaggatcgtgtactgtgggcagagtcagagggccaatgtcctggctcctggggaacagtttcctctgaagggagctgggtagaaggtgtcctgtcttcttggctacatctgtttgcagtggagtttacatcatgctgagttgggatgtggaaggaaggaggagcatcttagatcaattatgatggctagacttactgaattttgtagattttcttgaataaatgtttcttcacttgctgtatgctgtgagagcctttccaaaccctgtattttttcaaaataattttcactggtctcatgagggcatggattcattgagcccctcatgctatcaaagagaaatagaactttttttgttcactttttagagaacatccatgggttataaaacaatgggttgacttctcttccaaaactttacagataccgtcaattttcctcttgcttgtaaggttttatccagaagaatgctgtcatcattttttctgcttttttggaaggaatgccccttctactcacctcaaattgcctgcatgtatttctatttttctttggttttcagcagttttaataagatttagctaaatgtgtgtggggggagcagggagtgtcattctgctgttctgtgttctctgagatgcatggattcacggtttactctgtctccattttggggaacacaattagaaaaaatgtcagtgtgagcccagaaacaagcctccctgaagtgggcagaggaccacctgggggcgctcaggacccactgagcacaagagccagccccagggcaggtgcagacgggggttaagatctggtttcccgtcagccctgtggcttcctctccataaaacagttccctcgggggcacgtctctggattccttatcttgttcttactgtgaagtctctgaagaataaacatttgttgtaacaagagaaaaattttctcccatgcaccaaaggcagagtcacctacagtcaattagtcctgtttctcaatgttaataaactatcaatgtttctgaaggtacattgtacagaacccagaattcagccacacaatgtatagccaagtgatattgacaaacttaacaaaatatacaccagggaaaggacgtcccattcaataaatggtacttgggaaaatggatagaaacatgcagaagaacaaaactagatccccaccctcaacacattagtcaggtctctaaaatgcaggagtacatatctaaaatttattattttattgtgcatttttacgtgttccagaaggtgggagaaatttctttctgtgaagagcatcccaaagtcaggcactcctctagaacacgtgtttaatccttgtctttggcttattgatgagctctgttggctgcaataacttctgccatccgggctgactttgcatcatgtagaggagcaaattctgaatgaaagtttgcactactcaattgagtgcataacctacagttttgttactgatgtatgattcatcagagatgatatcagatcaaggatttcaatgagaatctaatctaaaagatgtaaacaaattttcctaatttagataaaattactgtgagcacactgctagtattcagccatgtctcctatcacattgaatctacactaagtttgacctaaaagctagcacttgttctcatgttccaatatgttatttttattttaatgtattcagattactatgtgttgctattttacccaaagtgaaggaaagcaattttaactgactgaaaatgagaaaaagcacaacctaatgaaatggaagtcaggacatgagtgtctccagccttgtctatttcaaaaattcacgtacgcagggggatttctttcctcaattttacacagagaaacttccaaaatgtttgtttcctctcccatggactctatcatcagtttctatgtcagtttgcttagaattttggcctccagctccaaccaatttggtgcaaaaacatgatttcattcttttttatagctgcagagtattgcactgtgtataagtaccatgttttctttatgcagtctataactgatgggcgtctaggttgattccctgtattaggtaatgtgaattgcacagagataaacacatgagtggatgtgtctttgtgttacaatgattggttttctcttgggcatatacccagtaatgagattgctgaggggaatagtagctctgttttaagttctttgagaaatctctagactgactgaattgttttctctgtgaatggtgataattatgtcaatatttgtcaaattttgaatgtattgtttgaagattgttatttgtcaatattacctcattaaaactattaaaaatggaagtgtataatttggtagaaaaggattaaaagaaagataaaaataatacaagaaaagtcacagactcctgaatccacatgtgaattagcactcagtttttctatattatttataaaaacactaagatacagccaaataatatcatgatatccttataagaagagtgtttcgtaaacctcactgggaatttctagctctgtcctagagttaatttagggagcagtcggatccagtcctgagcaacacaggccagacactgagacttaccacatcttaccagatgtgagctcttagacacgtcacatggcctctccatgcttgggggtttaccttcacatctgtaaatgaaggaaacattgactgccacagaacatacttcatgtgcatctatacagtagaaatgctaataagaattaattgtttatgaagtgtaatcactctgggacacagcccactcagaggcatcccttccagaacccgctatatagtaggagacatgcaaatagggccctccctctgctgatgaaaaccagcccagccctgaccctgcagctctgggagaggagccccagccctgagattcccaggtgtttccattcagtgatcagcactgaacacagaggactcaccatggagttgggactgagctggattttccttttggctattttaaaaggtgattcatggagaaatagagagattgagtgtgagtggacatgagtggatttgtgtggcagtttctgaccttggtgtctctgtgtttgcaggtgtccagtgtgaagtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattagttggaatagtggtagcataggctatgcggactctgtgaagggccgattcaccatctccagagacaacgccaagaactccctgtatctgcaaatgaacagtctgagagctgaggacacggccttgtattactgtgcaaaagatacacagtgaggggaagtcagcgagagcccagacaaaaacctcctgcaggaagacaggaggggcctgggctgcagagggcactcaagacacactgaaaacacggttaacactgggacaagttgctcaggaaggttaagggctggtttcctttcagagtctttgctgtttctgtatctaacagtttccccaggaaccctgtctagatttgcgatcttgatctgcttaaactgtctctgtgtcatttttcttacctgtgactttaggggagctgatcgtggacactccagtgtgtggagatttcctggtgacagcaattgtgtgttctgtctaagcatgtctagggccggtcatcaggaaggacaggaaggacaggctggaattcttggaaacagctgcacctgccatccaccagggaactttattgtcttctgttctgctaaaattaaatcaggcacaccaagtttaactagcactatcttcctagcttaagaaaattgatggcaggtttcaataacacctatattaaaccttcagagcaacacctacattagtgtctgatttgataattgagactatgttctagccaagcagacacataaaactggtgattgccatgcttagttcatatttcatatttatcaatagaatctggctggtgttataaacagatttgccaacacatgtgtgttagtgtttgtcttcggagaggcacattctatgactggattaagtttgtgtacaggttcctaaggaacctgttcatgcttttgagaggaaatgcagagggggtggaaggcggctggggaagctgaaggtatacgagggaagtcagtccctgagtgaaggagagagggaggagaactgggtagaactttcctaaacttctgtgctggtctaggaaggtccagcaagatcactgagtcagattcgtgtcaaagtttcccatcggggacccccgtgactcccagcagtggctctgctcagatcagcacagagctcgttcttctcctgagagtggagcagaggatgtggctccagcaccagccatggcatggacgtcagagagcagccccaggcacctgagtcgggtgcattgtgccccctgcaggtggacggagggaggtgctgactcagggcccacacgctgtgggttctatacagaacacacacttttacttcatttctgtggatgacatagaaacaaacatgcagtctattaacagcggtgattcctacatttgccccaattgctttattccttgattccgcagaatatcctgacgcagaattgtctttctctcgtggaattgcgacgtgtttaggacgtgtgttccccactttcagtgttctgctccatgaacagagatcctgagtagagtacagctgaccctccttccacactgttcctctcctccccacaggaagagcagataattacctgaggctgaatctgaggtgggatctgtcctctgaacctcagagcctgcagagacccccggctgcagattcatggagtcaggtgtttgtacatgtgggaaacttgagctgttcttttgtcagtgaacactccttagaactaattgtgggttcagaattaggacacccattgatctatcacacctcagctcattctgccactcagaatctccagaaattcaggaaatggttcaatttacatgtttgtgacacattgttctcatttcatttagttgtgagtttggtcagcaaaagtgctaccatttatgtgtcccaacctgatgaagctaacttgcttcaccagatgttgggagctcctgaattttatcctaagcccctctctctccacttcatgtgaaattcggtttgacctggaattctggtgtgttgatttagccagatttccccatactgagtgtctgattttcctggatatctgatcagtttccttgtccttcaccataacttgggtgacatctgatcaccctgggctaacttcaacaaaaatcctggcaggttgccttaagcaggatttacctcactcctgatgtttcttcttgattttccatcctttgccccaaccctgctgcatgcctataaatccccacgttctcactctgtatttggagttctgctgaatctctccctcattgcaaaatcccactgccctggtccctacacctatcatgagggccctggataaagtcttccttactgtgctgtagaaagtgtctttgtatatacattttttctttaacaaatctgcctttagtatttcctaattgatcaaggaacctcaaacattgaatgaaagtgaggttttccattttactaacatatgtgtatctgtgaatttcaatttcaatgtgtggtgtccagaagtcctgagcaccaacagttgtgcttctctgtccaattatttgattctgaaacctgggagtcatcccaacacaggtaaatatgtgattttttttttttttttggtttttactgtttagtgactgacttatttcacttacactgaagcttcatgaacacaatgatgaaaagtagagagaggacttgtttgaaaatgccagatttatggtagactttaccacccacgtgtgtctggaggtcttcttaaggttccaagaacaggacatttttcccacaacaagacaaggatgagaacctctgagctgtgaggatggaggacaggcagggccatgtgtggacaaggacgggctgctgctatgtccagggtgttctctactagcaaccactccatctccttcctcactctgtggtatttgtcagatgggaaacatgcctagaatttatctttgacatctggatggaagcccaggcaagaggcatttgacagcttattcgtgagcctacttctttaaggaatgccagatcccttgctctccttcctagttcttaacccctttaactcccttcccctcctgcacccatccactgcctatttacagccacgtccccacacccttcactgtagcaccattttcttgggctcctgggaaacacaacagctttggtttaactcacagctcaggcacactcacgggtcctttcagaggctctcaacttccctcctacagtccctcagctcctcctggggtcctaacttggccatctctatcctctctgctgagcctggccatacacaatccatcccatctggatatgtgtatagcagtgggttaactcagcaggcatgaatagttcaaaccctccacgttcctaaaaaggtaaataactaaaaaataaaaacaaaagtaaacctttgttcatttatggctgtctgttacctcctgggatgagatctccgagtccatgaaatcttacacctgataaaagtgtctgcagatgtctgcagccttgggacatgctgtacgagtttaatcacagtgatttatagtgaacgcctgcttttgttttgctggggagggctgtggtctgagtattgtggtcagttacccaggtgttccatagtctatgattcattccccaaacacagccctggacaagaaaactcaggggcactcccctgggtgttgacacttcacacatgtcatcttacctcatagctggagcattacacatgtgcagaaggctccacagtgggaggacccctgagagcttgtgcctggattctcctgagcttcactctttgtgccttttttttccatgtattttcaattgtatcattttgctgtaataaactgttcctgtgaatacgagttttcatgagtcctgtgtttttactgagttttgagcctgagggtggcagatgcaacttctcaatgcagttgtatcagaagaaggatttcctagagagatcctaagtgacacatggctgaagtattgttcagaaaacataagtattcaggtgtggaatggcaaaatctgatacttgggtggcaacagaattacccggtctgagacagcagctgaactgaagtagatgtctggagataaatgcaatttagaaacgataactcatactcccaaagagctggctcaatcgatacataaggaaaaataaaatgataaaaaataacctaaatatgcaattactatttgtgagaacatccgggagagtgattgcagggaaagtggcctgcgccgacctcagattttggccaatgtcatttctggctgatgggctccagggcactacctaagggagcaattatgctgcaatgacagacagaagcttcgcaagctctctccacccagaaggtggttcaggtggtgaagtgcggggactggtgagccacaaaacactgaaatgagggaggaaagtgagaaagtgaaaggcttttgagctttttctttagcttaataatttttgttaattattaacaaaataattggacaatgactaatgtaaaagtggaccgtgttttgagtcccttagaacggaggagaatgcagcggtcaatgttgtgcccagagattactatagaacaatagtaggtggttgaacatgctccaaacacaaagcctcttgttgctgatgggacagctgccctcgtctactgcacaacagcttctccaaagtgtgtttaccctgagcattgagattgcctttctcttgtaagtgaaaaaatcggaaaactccaaataaaggaggagttgtaacgctctatgtgtaagaaattctaatgtggatttatgataactgggatatgcatccacttatctttttatctgtaaaaattcatgggtgaaagtgcaattttgttacatggatatattgttcagtgatgaagtctgggctttgaggagagtcatcatctggatggtgtatattgtacccagcaagtaatttctcatcccacacaccactcccaccatccaaaccttccaagtttccaatatttattatgccacactctatattcatgtgtgcacattatttagttcttacttatatatgacatgtggtattcaactttattcttctgagttatttaacttaagatagcagcctacagtttcatccatgatactgtaaaatacataatttcattttttattattgagtagtaattaaatgtgtgtatatatattcacaaatatatataatgtatttgtgagggtgtgtatgtgtgtatatatgtgcatatatacatatacaacatgttttctttatccaatcattcattaaaaacacttagtttggtaccgcatatgtgctattgtgaataaggcaacagcaaacataaatgcagcatctatcgaatataaaattcatttttctttgagtcgataccaagtagtggatttgccgaattaaatattagttccatttaataagagaacttaccaacatctgtttcttgtttagtttagtttttatttttgactttttaataatagttattctgactggtttaatatggcttctcgttttgacttcaaattgcatttctgtgatgattaatgacattgattgttttttcatatcctggttgatgatttttatggcctcttttgaaaaataaatgtctgatatttgctcactttttaatgtggctatttgtgctttttgtgttgctttagtttcttgtagattccaaatattagctctttgtcagatgtagtgtttaaaaatatttttcgtcattctgtaggttttctgttaactttgttgattatttattttgctgatcagatgttttgcttcttatttgtattaagtccaaataacctattttggtttagttgtgtttacttttaaggtcatagtcatgaattctttgcctagcacaatgttcagaaaaacacttcctaggatttcatttatgactttcagactctcaggcctcccagtcaagtcttttatccatattggtgtaatgtttgtatgtagtgagacatatgggtccagttttattcttctgcaaatagctgttcagtttttcctgcacaatttattgaacaaggtgacattttcccagggtatgctttttgtctggttggtcacagtcagttggctgcaggcacatgactgtatttctggaatgtctattctgttccaagtatctatggttctctggttgattgttacttgtgtataaaaatcctactggcttttgtatgcttttttatcctttattctaaaacttcactgaattaattcatcaattctaggagtacttctaaagaatattagtttttaagtacaaaatcatattgtcagcaaacacacacaaaaaactgacttcttcttttccaatttgggtgcctttatttctttctggtgtcttatttctctggctaggatttcaagttctatattgattaagagtggtgaaagtgggcatccttgacgtgttctgagtcttaggaggaatactttcaacatattgctactcagtataatgttgtatgtgagtttgtcatatatgatttttattaatttgaggtatgttttccttctattctaattttgttgagggttttttatcataaagaaatcctaaatgttatcaaatttttttttctggacctattgacatgattatatgttttttgtttatgtggtggatcacagttattgagacatgaacgttgaactatccttgcatccctgaaatgaaacttagcagattgtagcatattatctttttgatatgtagttggacttgattttcttgtgtcttgttgaggatttttccatctatagtcatcagtgatattgatctgtagtattcatttttgggtccttgcatggatgtggtatcaggctattagtggctttgtagaatgagttagggagaaaaaccctctcctcgtttttttggaaaaagtttcagtagaattactagcagatctttttgtatattggacagaattcaccttttaaaataatatgctttacggctttgatgttgagatttttttaaattactgcttcgatgtcactaatttttgttggtcctttcaggatttttatttcttcctatttcaatcttgggagattatatatttccagacatttatctattcaccctaaattttctagtttatgagcctggagatgttcatagtagactatgttgatcattatatttctatggcatcagttgtaatcttttcttttttgtttctcattctgcttatttaaattgtctgtctactttacttgcctaatctagctagtggtctgtaagttttgtttatcatctcaaaaacccaatgttttattgtattggttctttgtatttcttggttcttaactttatctagttctgctctggtctttgttatttgttttcttctgctgtgtgtttggtttgatgttgtttttctagttatttgatacgtaatgttaggttgttaatttgtgatctttctttttgatgtggtcatttaacattataatcttatcccttagcacagcttttgctgtaaaccagaggttttggtatgctgtttctctatttttattcatttcacaacatgttacaatctttttaaattttatcattgacccaaagttcattcagttgcaggttgttaaattttcattgtgtgtgtagtcttgaatattcttctagggtttgatttctggctttatattactgtggtctgagaagatatttcatttttaaaaagttattgagtcttttatttctggcatagtatataatccatgtttgaaaatattccttgctaatgggaataatgtatattctgcagtcattaggttaaatgttctgttaatgtctgttaggttcatttggtctagagtccaatttaagtctagtgtttctttgttgattttctgtcttaatgttttgcctagtattatcatttgggcattgaaatccatcacaattgtattgttacctgtgttcttccttaggtctaatagtatttgttttatgaacatgggttttctggtgcagagtgcatatatatttagaattgtcatttttaatcaatcattttatcattatataatgactttctttgtctttacttactggtgtttatttaaagtttttttatatgatatagatagtcttgcttgcttttggtttccaattgcatgaaatatattttttcaccctcttgatcttgaatctacgtatttttaccaattaagtgagtttcctgtcagcagcataaatttcaaaactcttttttattctttccactaatctatatattttaggtgaagaatttaactcatttatattcaaacttaatacagatatgtgaggtctggcttctgttgtcatgttaattattaactagtggctttgtagtcttaattgtgtaatagttttatgagtgaattttataattttgtgttgtttatgatggtgagtactgacctattgcttccatgtctaggtctcccttgagcatttcttgtaggtgcggtctggtgtaaataaatgtccttggcattttcttaccttagaaatactttatttctccttcatttatgaagcttagtttagaaggatacaaaattaatttctgacatagaattttttctttttttttctttaagtagtctgaaattgggagtccaatctcttctatcttataactttatgctgagaagtacactgtcagcatgatagaatttcagataaattattagacacttttctattgtgaattttaggatttttttcttcctatttactttagatagtctgaggactatagatcttggtaatgtctgtcttccagtgtcttctcatgtagttttctgaaccacttttatctgcatatgcaaatatctagcaagactagtgatgttttcctcaattacttcatcaaattggtcctctaaaactttttactaattttctccctcaggaatatccatgattattggctaagttgttttacataatcctatacttcccaatgattttgttcatttttttgttattttcatctgactgggttaatgcgaaatatctgtctcttaggtttgatgttctttcttctttttagtgtagcccattgtgaaagttttaaactattttttgtaattaaaattcaatgaagtctttactccctgaagctttatttttaaaatattaaagtcttaagtaaatcttgaattgttctgatttttttttttttttttttgacacggagtctcatactgtcacccaggctggagtgcagtggcgcgatcttggctcactgcaacctctgcctcccgggttcatgcaattctccttccttagcgtcccgagtagctgggactacaggcacacaccatcacacccagctaattttttgtatattgagtagagacagggtttcactatgttggccagactggtctccaactcctgacctcgtgatctccgctccttggcctcccgaagtgctgggattacaggcataagccaccacgcccggcctgagttattctgatttatttgtgttggttctcaaatttcttttggatttaattgagattccttgaggtcaacattttgaattatttatctgacatttcaaatatatcatgttgtgtaaattctatttctggagagttaaggtgatatccggcgtcttgtaattgtgttttttcatacttccacaattgcttacctgcttgcttttcattggctaaactatctcttactgtttttgaattcattttgattttcatgaaaatttcattccctttagaatgtgaatataacgtatattatgtgggtcttttgatttggttcttggtttactcattggcaaaggctctgtaagagtttcttgtatatagatagtcattatttagtggctttctgaaactatggttgtagtaataatctactgggcctgtgagcaggctcactgcctcctgcaggccctaaatagtggaggcctcagaaaccatttcttatttgcaatgcacttgtttcagcacattttatattgggatgttaagttcacctacacattagtatgtgtccttacagatttgagctgactgtggtagaagcagatgagtacatgcttgatatctgtacacagggagaagctctctgttgcctcaggcgatggactggtctatgaagtgcacagtgacttgagttctctgatcagcccctgagtgggggatgaagctggacagagatgagccaccgagcctggcaagcaaaagcgccagccttgatggaaatggcgagctgaggggcatctactcagtgtggtttcttttgttattaagagctttagtgtggtggctttttcaaattcccgttgtagtagtaacatactgagcatgtgagcaggcccgcggtcttttgcggggttggaatcacagaagtattgagaagctaatctcattttcaactgctgtacactggtggtattgagtttgtatgaggtcatgcagtttgaacgtcaggccagtaggtggtgctcgcaggtaagagccggctatggtggcagcagaagggtttatgctttaccggtggttaaagtgggaaatttgtcatgttccagatcttagagaaaagacttttagctatttctcattcattataatgctgcctgaaagtctctcgaacataactttttattatgtcgagatgtgttctttctatacccattttttacattttttttcctgaaaggatgttgagtttcatcaaatgatttttcagcatcaattgaaaaaaactatatgtcgattaaagatctaaatgtaaaatctaaaactataaaaactctggataataacctaggaaatacaatttaggacattagaactggcaaagacattatgaagaaaatgcaattttaacaaaatcaaaaaatggcaaatgagccctaagtaaactaaagagcttctgcatagcaaaagatactatcaacagagcaaacaggcaacctaaagaatggaaaataaaatatttgcaatctatacatctgacagggtctaatatttatagcatacatgcaattaaacaaacatacaagaaaaaaagtgcccaaaggacatgaaaagacacttataaaaagacctacatgtggccaacaagcataggaaaaaatgctgactatcactatcattagagaaatacatattaaaaccacaatgaggtaccatctcacatcagtcagaatggctaatcttaaaaaaataataacagatgctgctaaggttgcaggaaaaagggaacatttatacacttctagtgcaagtataaattagttcaaccattgtggaaagcagtgccatgatccctccaataacctaaaacagaagtttcatttgacccaacaatcctacaactggacatatacctaaaggagtataaacgtataggttcattccagcactattcacaatagcatagacatggaatttacctaaatgcctgtcactggcataatggatagagaaaaatgtgatacatataaccatggaatactatgcagctaagaaaagaatgaaatcatgttctttgtaggaatatgatggaactggtagtcattactcttagaaaactaattcaggaacagaaaaccagatactatatgttctcacttattttttggagataaataatgagaaatattctctcagggcctgagtcttccatattcaaaaaaaaattctaaaataagtgttcaacaagttgccgacatgcctttaaatatcctgtttcatctggaccccttatatcactcaataaagccatgagaactatatttaaaagtgggattctatgataataaataacttaacagtaagaataggaaggatatggatggttttactaatttaatgggtacataactgtggtatacactatattcctatgaataagatattctgatttcagagctaagtattgtttcctacgttgtgtgtgtgacttggttgtgttggatttgagagtgtagcacgtgcacagaccatgtggatcagaaatccacatgtaaagatgacaatctatggatgtgaactacaagtatgtaagtacttcaagtaattctatttaatggagtttgaaataaaactcaaacttattcaaaacactaattacttggtatttattttgagatctatgagtttatcaagaaattcaaattcctatttctatttaaactcccgattcctactctcagtgggagggaaaactcacagccaatcacacatcacaggacaaatctgtaaacgaagagtcattcctctgaaggtcctgggtgttcaggactctcaggcaggtgctgaggaccctgtcttgggagtgcccagcagatctcagaaccctacatggggcctgctggacactcatgtgggataactagtcgccacttattcagagttaccagtgagctttgactgttccgaatgggaccagcatggagtcaaggtgcctgctcaatgtcagagacagcgatggtctcagaaacaatccaggtaatctctaggccaataaaatgtggattcacagtgagaagtacatcctggaggtggagcttgttcttcagtgggaagagtgctgtgcacagaaagcttagaaatggggaagggggtgcgtttcctcaggcaggattagggcttcgtccctcagcgtcccactcttgtatggctgatgtggcatctgtgttttctttctcatactagataaggctttgagctgtgaaataccctgcctcatgaatatgcaaataacctgagctcttctgaggtaaatataggtatattggtgccctgagagcatcactcaacaaccacatctgtcctctagagaaaaccctgtgagcacagctcctcaccatggactggacctggaggatcctcttcttggtggcagcagctacaagtaaggggcttcctagtctcaaagctgaggaacggatcctggttcagtcaaagaggattttattctctcctgtgttctctccacaggtgcccactcccaggtgcagctggtgcagtctggggctgaggtgaagaagcctggggcctcagtgaaggtctcctgcaaggcttctggatacaccttcaccagttatgatatcaactgggtgcgacaggccactggacaagggcttgagtggatgggatggatgaaccctaacagtggtaacacaggctatgcacagaagttccagggcagagtcaccatgaccaggaacacctccataagcacagcctacatggagctgagcagcctgagatctgaggacacggccgtgtattactgtgcgagaggcacagtgtgaaaaaccacatcctcagagagtcagaaaccctaggggagaaggcagctgtgctgggctgaggagatgacaggggttatcaggtttaaggcttttttgaaaatgggttatatatttgagaaaaaaataacaatagaaacaagtacacactctaattttaagagatatattcaattcaagaattgtagaagccgaattcacagtgggaaaggccacactcaataaagttgataaaaacattccaggaaggtgctactgtgaacaagttttcaaattagatgaataaataatttggagcaatgttatttgatcatgaggtgagacagtatgattcttaaaaagtggaaaaaattctttcaaatgtttctgccactctttatcataaaattaattttagagcagttttaggattacaatgaaattgcacagaaggcatgagaattcccatgactccctgccctacacaggcagagcctcctccactatgaccatccagcaccacagtcacaaatcagttacaatggaggaatctccaaggacatttgattctttcttttttggtgatgccctaatataacaagcctaatttatctcggaataccacaagttttgttcagtggatttctaggaatcatattagttagagggaaagttggtgaggctcttactatttgaactcattcttccaaaatccacaaaacatatattaatttaaagcttatcttacttctggtttacaggatccttcccagagagtaagatttttaagattttagaggcaggttcatgtctctaaaaggccagcaagttctggggaatcccataatgaacatcctttcatgggaattggagaccctggcaatgagagactccatgtataatgccctagagttggattagatgcactgtgagctcttgggtggtggttctgaaaaaggtggtctgtgcagtaaatgcaaacacatgcacgggacacaggaaggagcaaaagcttccctttacaaagtgtgtgggcacctggaagaaaccctcacaagggcacgtctcacccttaatgactgcacattagccaggggcatgatcatgattggtcttacaaggaaagagcaccactgaggtcataggttatgaaaatgtcatcctccagctgagaaattccatctgctggcatgtgcgtgtcaaccccgtggagggtgcactctgggagttgacgagatgcatagaaacctcctgtcatgaattatcgtctaccacacagtcagaatcaacctgtgctccagaaagagatacatgcctgtagaaataaacagagcttaaggattttcttacctgctgaatatagtgcccaaaaccacactttcaggaagattagctcagaaatgtttacaaagtgactgaagggcagtggcgggtgaggtgatgggacagcctcagggctgcacttgaggagggctccctctcccatgcaggcttttcctccaggagctgcatcaggaactcacagaggataagggagaattctgagaacatgctactgtggtactgcctagagaggaaggataaatgatgacaaatacatctctgagtaacatatgggcatttgttcatgaaaactgttttttctgaaagcttatgaaggtcttgaaatgcccctgattagctgaggacaaacatttaaaccctccttccacagggagttcaagcaggctggatgtgtcctgctatggatgatcttccccagccccttcctcttcccagctcatccctggctctctgtgtaaaaagttttcatcagtggaaggtggttgatgaagtgaggtcttcaatttcctcatcttctctgtggtcatgttattttcctcatctgaggtttaaaaactcacctgcatgcagcacatgacaggctaaaatctcttgtggacaaaacagtaacaaaggcacccaccatggttgagcacccgtgttgctgacagtgaccaccaagggtcaacgtcctcttcacaatcctgtgtcagagcagcacttgagtgatttcactagcaacttcccaggagaatcggcttaaaactacttgtcgcattttccatacagatataacacatctattttcctgaagaaatagaaagagctgaatgctgaatacactgtatgtctgctggttctgcaagtttgtgactatcactttctaatttctgatctgtgtggaccaccctccagatttttctcactggtgtgaccagccttctggatgtcaaatataattaactttttttcatataaaagtcaacacaagctcctcatggtttcggtgctcactgactactttaaacttacacaatatgtttctttattagttttgttttctggtatctctactcagcatcttcaacacacccatgttaagatgcttgtacaggtaattgttaattttaaatttactggtgtttagtttaattaaataggcaggcaatagcttagaatttagaaacaacaatgtaaaggaaaagtaaatgcaataaaatttaacataagaaaaccagcagctgaaaggaagggaaatctattctgccacctaagagggtatggtgacctcatagtacaacgaacttctgcagtttaatcgatactgctcacaagtgatagcattctctctctttatatcagagcattccctaacatgtacaataaagagtgagcagatacctccaaccagactgaccagtacctctccctgagtgcctcagctgatagagatagacatcacatttgtctaacaaaataattacaggctgtaaggatacccaccagtcatatggagataatttgaaaaacttagtcaaagcccaaaccttataggtagtcatttatacttagaagaattaactcttatcttcacatgtatttttcttaatcatagagaagctactagagtcactgtccaagttactgaatatcttattcctagaatgagacattgcacaatgtgttctgacatgagggaatgtagctatagttaaaggataggagatgtgatcacggaaacacgagtctgcgatccagcagttctttctccctcacatttgcccagaaacaaagaccccagcagaaaaatggaagggttgacttcagtctccaaagtatgatgtgagatatacgtcaggtatttcatgccattgttttatagtaggaaatttaatctctaaagaaggtcattttcaggataatactattctccaggatacttaaatgcccgaaaacagagagcgctacagtgcccagtgtccaggagctacctggcacgggtctggaaaccagtggacagaaatatcagtttctcttaccacatgtatgttggaaatttgaagaatgtttctttccttcttcgtaatcataggctgcaatggactggaggtcccagtacataagaggaaatgtgtctccagtaggaacacaattagtcccataaaataattgtgctcacactgtggtgcccacactgttggaccagctgactgagaaagtgttgtaagagctgcagtgtctactgattcctatcatatttggggctacattcgcagctaccaacggaaagagagagaagtaaaactggcttaggtagagtctatggatttgctttctttccttcaaactgaagtaaaaaaaaaaatcacatcaactaaaatggggacgatgatgaagtgatcaaggacaagagccactcagtgttttaggtgggttttaacctaaagtcccacaacatgtgagaacctgaactctggagtccggggcatctctggggagaatgtggaaggtgggcgggaggaaacagtgattcatgtctagggaaatttcagggctacctgctctgggggaaaggaaagcctgagcctctccgacagtgtcctctgttaaaattgttggctgacttattgtattcttcaacaccaatatttttttagtcctcttttaattttgtttttattattatactttaagttctagggtacatgtgcacaatgtgcaggttagttacatatgtatacatgtgccatgttggtgtgccgcacccattaactcgtcatttaacattaggtatatctcctaatgctatccctcccccctccccccacaccacaacagaccccagtgtgtgatgttccccttcctgtgtccatgtgttctcattgttcaattcccacctatgagtgagaacatgtggtgtttggttttttgtccttgcgatagtttgctgagaatgatggtttccagcttcatccatgtccctacaaaggacatgaactcatcattttttatggctgcataggattccatggtgcatatgtgccacattttcttaatccagtctatcattgttggacgtttggcttggttccaagtctttgctattgtgaatagtgacacaataaacatacatgtgcatgtgcctttatagcagcatgatttataatcctttgggtatatacccagtaatgggatggctgggtcaaatggtatttctagttctagatccctgaggaatcgccacactgtcttccacaatggttgaactaatttacagtcccaccaacagtgtaaaagtgttcctatttctccacatcctctccagcacctgttgtttcctgactttttaatgatcgccactgtaactggtgtgaggtggtatctcattgtggttttgatttgcatttctctgatggccagtgatgatgagcattttttcatgtgtctgttggctgcataaatgtcttcttttgagacgtgtctgttcatatccttcacccactttttgatggggttgtttgttttgttcttgtaaatttgtttgagttcattgtagattctggatattagccctttgtcagatgagtagattgcaaaaattttctcccattctgttggttgcctggtcactctgacgatagtttcttttgctgtgcaaaagctctttcgtttaattagatcccatttgtcaattctggcttttgttgccattgcttttgctgttttagacatgaagtccttgctcatgcctatgtcctgaatggtattgcctaggttttcttctagggtttttatggttttaggtctaacatttaagtctttaatccatcttgaattaattttcgtataaggtgtaaggaagagatccagtttcagctttcctcatatggctagccagtttttccagcaccatttattaaatagggaatcgtttccccatttcttgtttttgtcaggtttgtcaaagatcacatgcttgtagatatgcggcattatttctgagggctctgttctgttccattggtctatatctctgttttggtaccagtaccatgctgttttggttactgtaacctcgtagtatagtttgaagtcaggtagcgtgatgcctccagctttgttcttttggcttaggattgacttgacattgcaggctcttttttggttccatatgaactttaaagtagtttttcccaattctgtgaagaaagtcattggtagcttgatggggatgtcattgaatctataaattaccttgggcagtatggccattttcacaatgttgattcttcctacccatgagcatggaatgttcttccatttgtttgtatcatcttttatttcattgagcagtggtttgtagttctccttgaagaggtccttcacatcccttgtaagttggattcctaggtattttattctctttgaagcaattgtgaatgggagttcactcatgatttggctctctgtctgttattggtgtataagaatgcttgtgattttttcacattgattttgtatcccgagactttgctgaagttgcttatcagcttaaggagattttgggctgagacgatggggttttctagatacacaatcatgtcatctgcaaacagggacaatttgacttcctcttttcctagttgaataccctttatttccttctcctgcctgattgccctggccagaacttccaacactatgttgaataggagtggtgagagagggcatccctgtcttgtttcaattttcaaagggaattcttccagtttttgcccattcaatatgttattggctgtgggtttgtcatagatagctcttattattttgagatatgtcccatcaatacctaatttattgaagagtttttagtatgaagggttgctgaattttgtcaaaggccttttctgcatctatcgagataatcatatggtttttgtcgttggttctgtttatatgctggattatgtttattgatttgcatatgttgaaccagccttgcatcctagggatgaagcccacttgattatggtggataagctttttgatgtgctgctggatttggtttgccagtattctattgaggatttttgcatcgatgttcatcagggatattggtttaaaattctctttttttgttgtgtctctgccaggctttggtatcaggatgatgctggcctcataaaatgagttggggaggattccctctttttctattgattggaatagtttcagaaggaatgctaccagctcctccttgcacctctggtagaatttggctgtgaatccgtctggtcctggacttttttaggcaggaatttccttgtcctaataagcccaggagtgctacaggagaccagggcttatttcatccctcagcggcgaccgtaaaagacagccatcccgaaagcagccatttcagaggcctcccctcagggatgcattctctttctcagggatgttccttgctgagaaaaagaattcagtgatatttctcccatttgcttttgaaagaacagaaatatggctctgttccacctggctcaccagcagtcagagtttagggttatctcccttgttgcctgaacattgctgttattctgttcttttttcaaagtgcccagatttcatattgttcaaacctacatgctctacaaacaatttgtgcagttaacgcaatcatcacagggtcctgaggctacatacgtcctcctcagtttacaaagattatgggattaagagactaaagtaaagacaggcataggaaatcacaagggcattgattggggaagtgataagtgtccatgaaatcttcacaatttatgttcagagattgcagtaaagacaggcataagaaattataaaaggattaatttggggaactaataaatgtccatgaaatcttcacaatttatgttcttctgccatggcttcagccagtccctccgtttggggtccctgacttcccacaacagtttattaactttgtatgactaataatgtaaaatgttccccatatttttagcaatgttttacttatttgtgaaaggtgtgtttattaatttttcattttaaggtgtcacatttatctttcttgtttctgggatttcattctagtagatatagctgaatgcattttaacaattattgtaatcatctcacattttatatttggatttgcatatacattttattaagattttgattttgatataaaatattttcttacaattgtctcttttctatttttatgagataaaattaatgtatgcataattgcatacatcttcaatgtacagtttcagggtttctgacatatgtgcacacatttgtctccagcacctaagttaggatgaggagcaggtcagtctccacaacaagtgtcctcttcagtgcttccagtcagctctcacataaggatttttatttaatttcaagttttcattttcactaatcatcagagaaatgcaaatagaaaaacgttctggtttctgtcactacagttcaattttttcctgttttgggcatcacataaatggaatcaaatgttatagttcattttttgtaaggggctacttttgctatttgtgaggttcattcatgtatttgcatctaccaaggttttgtcatcatatatatacacacacacacttatatatgtactaatgcacatataggtatttcatatctcaatcagtccattacgttaataaatgacagtttattaagtaaatccattcattaagtgaataagtgacaaaaaatatatctattttcctgttgatggaatttagtttccaaaataaatatcgtaaacacatctgttataaatatctttgtacaagttcttctgcttatatctcccatttttattgataaaatatgtataaatataagtatgcattataacttttcagctttatggagctataactgacaaataaaattgtatgaatttaaggtacaccacttgaggtattgatatacatggggaaatattcatcgtgatcaaagtaattggcatgcctatcatctcagagaatatcattttatgcctttaatttattgtgagtctgtgatgaaaacacctaagatctactcttctggaaacagataagtttataatataatattcattagtatagttacattgctgtatgtttcatctccagaactccttcaacctgtgtatcagtccattctcaaactactttagagaactacctgagactgggaaatacatgaagagaagggagttagttcactcacagttctgcaggcttagcaggaacttatagggaggcatcaggaaaattacgatgattgtggaaagtgaaggggaagcaaggaccgtcttcacatgctggcaggggagagagagaaagagcaaggggagatgcgccacacttttaaacctcaagatcttgtgagaactctaacacaagaagagcaaaggggaaagccgcctccatgattcagtcactccccatcagacccctcctacaacacttgaggatgaaaatttgacatgagatttgggtggaaacgctgagccaaacagtatcattatacccggccactcacaaatctcatatccctctcacattgcaaaatataattatcccttctcaacagtctcccagtcttcactcaattcagcattaacacaaacttctacagtccaaagtctcctctgagacaaggtaagtttcttggatgtataaccctgtaaaataaaaaacaagttagttacttccaagctaatatgagatgaatgcactgggtaaatgttcccattctaaatgggagaaattggccactacaaatgggctacaggccccatggctagtccaaacactagcagggcagtcatcaaatcttaaagctccaaaaaaatttccttttactccatgtctcacatccaggacacgttgatataagaggtgatctcccaaggcctttggaagctccacccttgtggctctgcatgttagactccccatagctgctttcataggctggcattgagttgctatgtcttttccaggcacaccatacaagctgctggtggttctaccattctggggtctgaaggacagtggtcctcttctcacagatccactagacagtgcccaagtggggactctgtgtgtggaatccaacaccatattttccttctacactggcctagtagaggtactccattagagctcagcccctgcatgagacttctgcctggatatccaggcattatcatacatcatctgaaatctaggaggaggttcccaaacctcaactcttgcctcatgtgcaccagcaggctcaacaccacgtggaagcaaccaaagcttagggcttgcaccctctggagcaatggcctgagctggaccttgaccccttttagccatggctggcacaggacagacagggatgcaaggcgccatgtcccgaggctgcacagagcagtggcgtcctgggcttggacaaagaaaccatttttctctcctgggcttctggacctgtgatgggaggggctgccacaaagatctctgaaatgccctgcggacattttttcccaccggggtccttgttacttatgcaaatttctgcagccagtttgaatttctccccataaaatgaggttttttgtctaccacatggtcaggctacaatgttttatcaaacttttatgctccgcttcccttttaaacgtaagttccaatttcagaccatctctttatgaatgcacatggcttatgttttcagaaacagccaggtcaactcttcaatgctttggtgcttagaaatttcttctgccagatataccttaaattatgtctctgtagctcaacatttcacagatctctagggtagggggaaaatgccactagtctttttgctaaagcatagcaagtgtgaccttcactccagttcgcaataagttcttcaccttcatctgacaccacctcagactggacttcattgcccatatcactatcagcattttggtaaaacccattcaacgagcctctaggcagtttcaaacttttccacatcttcctgtcttcttgtgagcactccaagcttttccaacctctgcccattacccagttacaaagtcacttccacattttcaggtatcttaatagcagtatcccactcctggtgcaagttttctgtattagtccattttcacattgctataaagactacctcagactgggtaatttatgaagagaagagttttagttaactctcagctctgcccgctaaacgggaagcattattgggaggcatcaggacgaacaatgatggtggaaggtgaacgggaagcaagaaccttcttcacatggtggcaggagagagagagcaagtgagcggggaggtgccacacttttaaaccatcagatctcttgagaactttatcacgagaacagcgaagaggaagacaatcccatgaccaaatcactttatcttaggcccttccttcaacatgcagggtctacaatctggcatgagatttgagtcggaacacggagccaaaccatatcaaccttcataacgggaagtttttaccctttgaccaacaatacccaattttttcctcctcccagcccctgcgacctactattctactctgcttccaagagcttgaatattttatactttagattctatatataaatgagatcatgcagcttttgtctttctgtgtctggcttattccacttagcataatgttttctatttgttgcaaatataagaatttctttgtttttaaaggctgaataatactcagttttatgtaggtataagccacattttatctgttcattcgtagatggacattgactcgttttccttatctagactattatgaataatctcacaatggacatagatttgtcacactcagtttattttctctagatgtatgctcagaagtggggatgctctatgtccagttcactgagtaatcttcatgttgtttttcatactggctgtaataattcacattttgttccaaaccatacatggatacctttgtaccacatattcaggtctttgtgtaactcttgaatccatttttagctgatttctgtgtattgtgtgaggtgagttctatctatttcttctgcatatggatgcccgtttttcacaccactcgttgaagagactgtcctttctctactgtgtgtcttgggaacttgacaaagatcagtttattaggaagaaatgggttggtttccaggttgtgtttaatgttccattggattatatgtctgtttaaatgccagcattataccattttgatttatatagatttgattttgaaattatagattatgatatattcagctttgttatttatgcccaaaattactttggctatttgaagtcttttatatttttatataaattggagctttttaaaaacattttgtaaaatcatgccatggagattatttatttattttattggcatatagtagatatacctattttatgggaacatgtaatatattgatacatttataaatgtgtaaagattagtgtaagatttacatatctgtcacattaaaaatgtaccctttccttgtgctgagcacatttgaatgactcctttcgctattttaatgttgtgcattagattattattaactatagtgaccttactgatctatcaaacatttaggtcttatttctcctctataaatgtatatttgtatacagtaatcaacctctccttatctccttctctcttctatccatccaggattctggtaagcaacagtctattctatcttcaggcgatccagtattttagttttgatgtaaaataagaagatgcaatatttgtctctcttttattggcttatttatcttaacataatgacttccagttccattcatattatagcaaatgacagaatattgggtttcatggctgaataatatcctatcgcatacatagattacatttactctatccatttgtccacctacagacactgaggtgctttcacatctgggctattgtgaaagagctgcaaagaacatgggaggggacatgccttcatgaggtggtggtggttttatcttctttagaacatacccagaagaggatttgccaagtcataaggtatttctgtttttaatttattttggaatcttcatactactttgcacatagtggaaacacaaatggagtaaacattaaaaaagcagtttcggttttgatgtataatccagaaacaaataatgtttgaccatgattctcattaggagtctctaatggatctggtggaaatgcaggaagttttctaaccttgttcaggaaattatgagtttgcacctttttctttttgaggcttgaaattggcatgattcatgatgcatactgttgggaggtttcagaatgatatggcaaaaatcataatgaaaaggcaagacagagagagagggagagagagagagtcaggcctagaaagagaaaaaataattttctcaacaggagaaagtgctggatatctgtatcagtgttgagttttgctcatagacacatctgtaccgagtgaggaaccatgaagtcaagggaggggtctagaacttgttcaagtgaagcatcagcatatttctcacaggcaccaatttccaccacatcacaagggtgatgcatttttgaatgccattaaatatgagttcacagtcagtaatcatgtttccatgaaattcagttaaaataccaagggtgtgtccagatcactcatgcacaaatacacaaaatttgctttttcatgtgtggctatctagagacaaagtgcactgaggagacttcagcaggttacagagatttgcttaagtttggaaaaccatagaagagtgcctttaagtgaaggttggtatataaattaaataggtcaaaatcccctctatggagtagcgttccaattgtgtggaatttttaattccttattcagttgtaaaacataatccctaggactgactccgtggagttttactgctgtgttgacaaaaatatctaacaagcttccttccagtgtttcaagggaagtttttctctaaattttttccaatgtataaattttcctggctaaagatagtaaaaggctgttaaaaacacaactggaatggcagctttaatcttttgctgattgataggagtgagcataatacatgaatctctttgagtgttctgcctcatccaaatacaataggtcaaaggctagtactggaggtaagatttccaaatgtgtttttttccagctaccaagtcataggaaaataacagatacatccttgagacagaggaccataatgccacaatgctggtaggagtacatgtagacaagggagttcaagggtttcttaaaactgataattttaatgtaagaataccattcttttaaacttatgtggaagactgtgggaggttataacaatgccatattttagtatcagccctgcctcacagaatcattttataacagttcctttcatgagtgtgcttcactcggttcatgcaaaaacctggcagatcacaggctaaaaacagaaaatatagaagcttttaatcaactgaaagagctgtagcctttgtcaaggaattattggaagacacagagaacacagatagatgataaataaaatacattcatatcccgttaagtgtggaaattgaggaaagtttacataaatgtgtccaagtggcaaactgtttatttaatctggtaaccaatttttctataaattgtagagttgaaatgcaacaaatacatatttgaaatgatctggcacaaattaagcaaatatggtaactatgtattttcactcatttttatttaagatcagcggctcagcattgatatttttgataatatctgtgactcagcagctttaccttttgaggatatgatctggtatggcagttttcttagcttcaatgttacctctttttgcattgacttccacctttatatctgccaggaatctggggaaaaggagtgcctgtaaacgttccctaacttgcccattttggtgggttttccagaatgtgtgagatgctttttttttttttttcaaagcatcctgaacccatgcactgccctgaaacatgtttatttcctagtttaacaaattggcacttctaataaatgcaatctcttctgccatctgtgctgattttacatcagatagaggactgtgttctaaaggaaatcttatattagtaagagcaattttgtcattaacctagagttttattattgaggtgtgattcataacatataatattaggtagaggttctcagtggcagtgtctaaatctcttgggtgtacagtgtcttccccgttaacatgaagcatttacgagcacagtcatagtttccagccatgcttctccctgtctcacaatcaccacaaactaactatgaccacaactggaacttggtgagttattctttaataagttttaagtttgtctttaatctttatgcctctagattattatgtgagacataatctttatgcctctagattattgtgtaaagctatttcagaagaaagttaaaaagaacattttaactgactaaacaacacaggaaatcattaataaaatgcaaagtgtagatgtgagaggctccaggcctggataatgcaagagttcatgtatgcaggcagtttctttgcccaattatactgatacaaccagcatgtcagcttcatgccccatttgactcctattatgcaagcgcatggaaatgacatgctcaagggtcacacacagatatgaaaactggtgggagcaggagaggagacgactctgcacttctcctctgaaggaccaggaaagcctggacagaccatctccccagcctccatgactgcgcgacgtgcccacatggacactcatctctgacaagataagaagactccattgatgaggctgaacattttatgatttaaattactagagacttacattgaggtttcaataactaatttttataacccaaatttacttacccccatgttgttacctctttcttcagtgaaaaattgcttttgctgtaattgagttttaggaagattcccagtgttcacaactgagcttccaagagagtgttgagaacaaaaactgaatgagggcagagaaacccatctttactgtgttcaccactaaactcaagtggactcggcactgcctttgatcactgttgcttctctgcagagttcaggtttgtatttctcacaattctaacacagactctccctctcctcaaaggtttggcctccactggctgtaaggtcacactgttctgaatttcttgtctgaaccgttttatgagggtggtgatgagccatttaatggaaattttatatcatctcagcatgaatcctatgggcggtcacgaattattattctgattatggtaattgatttttctcagcatattcattactagtgatattcaaaaaccctttttatttaaatctttgatgcttcatttttgttgctatgacactttttcttctactgagtcttcccactagcattataacatgacctaatatccagggctcagttgttatataacaaccacatatgtcaaaagctatgcattcttttcacagcagacataattttctcttttctggagatgaacacacactggctgagctacccccactcacaagaacatatggaaaatcatgacatttttatttacttgactaataaattatgtcattctctcttcaaattctttatcccccagaatgccatgacaaactcttctgcatctgttcaaaccataaactcagaaaccacatggtgagtaaaagctcacttgattcgggatattgggtcaagctcttcccctccaatgtcccacagcattgggacctcagcccacctgtccaggttctatcaagagagtttagctccttcacagtgaaggaaacaattgagttaagagggaacctgcagaagatagacaatattgaaaaccattcatatgacaagggattactatcaagcatataaaataaactcaacccaactgcaaataataatgtggctaataatggaggaataacattaatacatatttctcaaaagaagaaaagaaaaagggcagatagatgatagatagataaatagatatattagtatgtatacatacatatatcgctagaaaacactaatattcaggaaaatgcacattcacaatgagatgtcttttcatcctttatctttgcttgagagtcagaaaatctaaataaataaataaataaaacaggagctggccaggattcatagaaagggaaactcttatagaccattggtggaaatggaaattagtgaagccatcatgggaaaaaatagaactaccatataattcacaatccaactgctgagtatgtatctatttaaatcattaaagtaaaaaactaatattgaagagatacatgtacacccatgtttattgcagcactatccaccatagctaacatatgaaatcaacatatgtgtccatcaacagatgaatggataaataaaatgtgttatatttacacaatggaatattgttcagtcttaaaaatgaaattctgctgttagaagcaacatggatggaactggacaccatcatgttgagtgaaacaagacagacacagaaaaataaatacagcattttctcagtgttatgtggaaattttaaaaagttgatcttctagaagtaaataatagagtagtggttatgagatgccgggaatgggaggagactgagagacaataagaggtttgttaacaaacgtataatttacaggcagataggagggatgtgctccagtgatctacagtgcagtagggtgactgctgttaacaatatagtgcacattttatgtttacaagtagccagaagacagaaatttgtatgttaccaacaaaaagaaatgttagtgtctaagctgatgaatttgttcattgttctgatttaatcataccacatggcacacatgcatagaaatatcacactgtaccccatacagttattatgtgctaactttaaaaaatcctttaattaaaacagattttatttgcatacattacaaatgcttcaacacagagccaggaataaataccatttttctttgaaatgtgaatttcctaacaacgtagttacattcatttgaaccaaaccgtgtatttgatcatggtaagaatagacaggcttatgcatagaatgatatattttaattttagacttctacttaataccataaattcaaataattttaaaacaactaagtaaaaactataaagttgaggaaatgtgtacgtggtgtgtgatgtgtgactttttccttgcgcaccactctgtccatggtggatgtgtggtgtgggtgtctgtgtctatttctgtttactctgcttgaggttctctgtgattctaggatctgtagttcagtgtctttcacaaaactgggaacgttcttagccattatttctttcaaatactgtctctgtatctacaatttctcctttcagatttaaaatgtacatatacaatactttttaatattaatgtttactttcttcactctcttttccttgcactttactctgtaaaatttctagtggtattttaagtgagtggtttcatttaaaaggtgagccagctctactgaagggtgtgcccaaagcttactcaatgtttatactgcattgcttttgatttcttatgcatttccatttgattttttcttagtattttcaactctcagttccctatctagtccttcattatgtatacagtttccttaatagatttttacatatgaattatagttactttatatatcttgtttaattagatagttctaagatccatatcatatagaagtctcattctgatcatttgtttattatgactttggtatttctcattaatatatgtaatctttgttgatagccagatattttaggttggacagttgatattggcttattacttcattttatgcattttctgcctgtatttgaccatactttatttttgccaggcctttaatgtggaaatgtttgaatcttctcagagctacatttgacgtttacttttgcagtagacgtcatagttgaagtctgttcttctgtgtccaccagagacttcagatcctccagtgataccttgtttttctttcctgcttggctttgtctcttcaccctgttccttcctccagagaatctctttcagctccttcaggtggattaagatattatattgaactgacaattgtgaaattggtggaaggcaatagaataaagggagattttctgacctttcatgggtctatatttctacgaaggcattgtgaccctgagtctgggtgtgacattgccggtgtttctgaacttctgccagatgagatgttggtctgtgtgttcttgctgttttccctgctgtggagtcctcttgttttccccagttgttccctcccacagctccaatgttctcttttggtgttatcagcttccagagttgatgacctgacctagagattaaggctctgattaaataagaaggaggggagatacttctcaatggaacttaggtgaagacctctttttccatctcagttcctaagggatggccccagtgcccctaagatcctggctttggtggcttgctcctgcagagtaatttcttagttctgcaatggggattaaggaggtgggtctgaatgcatttcagagtgtgggctctttttctctcccagacagacacattgggacaaaagatttttgtgactgtccccatttttgggaaaaaggtttcaaggtataggaaagctcttcagtatgtggtccctgagaaattcacgctacaacacatttaccacacttgacttcaccaattcagtatgtatgtatttttttctcttataatagcctacatttttatatgccagactctgcctcagttcaactcatacccatgcctttttactctctgcaagaacttgtctctccctaaatttcggatttgatgattatcttaaaacctccagtatttaaagtatattttaaaattggcaaaattccatctcctgtgtttatctgttatgttgatgctgtaaaacagtaagtaaaatatactcctcatctatgtacattttgaagctgagttgcaggttttttggtaagacccagagtcacagagaattcaaatattgttaagctgcttaatagaaaaacaaattatggtaaatgtgttcactggaatactacccatgatttataataaataaatgcctgacacacagaacagcagcaaaaccacacatgctcttattacagaaagtggcttctgaaaaccacaccgggcacgtacagctttgtcctggagttggtttagggggatgtcagagccagtgacgagaagcacagggccagatggcagcgttcactcatcccagacatgagctcctggatgcatacagagcccccccatgtgtgggtttacttccacttctgtaaaaggagaaaatactgactcctacagagcataatttacacattttttaaaaaatgtaatagggtgatcagggcaaagtgtttatcacagcacaatttcataagacagcatattttccaaataccatcattgtcagcaaacttctgcagagcaccgtcttcttatatgggtacagcctattcctccagcatcccactagagcttcttatatagtaggagacatgcaaatagggccctccctctactgatgaaaaccaacccaaccctgaccctgcaggtctcagagaggagccttagccctggactccaaggcctttccacttggtgatcagcactgagcacagaggactcaccatggaattggggctgagctgggttttccttgttgctattttagaaggtgattcatggaaaactaggaagattgagtgtgtgtggatatgagtgtgagaaacagtggatttgtgtggcagtttctgaccttggtgtctctttgtttgcaggtgtccagtgtgaggtgcagctggtggagtctgggggaggcttggtccagcctggggggtccctgagactctcctgtgcagcctctggattcacctttagtagctattggatgagctgggtccgccaggctccagggaaggggctggagtgggtggccaacataaagcaagatggaagtgagaaatactatgtggactctgtgaagggccgattcaccatctccagagacaacgccaagaactcactgtatctgcaaatgaacagcctgagagccgaggacacggctgtgtattactgtgcgagagacacagtgaggggaagtcagtgtgagcccagacacaaacctccctgcaggggtcccttgggaccaccagggggcgacagggcattgagcactgggctgtctccagggcaggtgcaggtgctgctgagggctggcttcctgtcgcggtctggggctgcctcgtcgtcaaatttccccaggaacttctccagatttacaattctgtactgacatttcatgtctctaaatgcaatactttttttgtcctttttgtttctttgtttttttgcaacaggagtacatatcctcagctccacagaagccagggtgtcactttgggggcagaaataatcgtttcgtggtcaacaggatgagagtcctgaggaatcccagggaaacctggagagtgttttccaattagactcagggcagagacctccatgggaatttctgattagaacgggctttgagctctgatgggagccaagagacaggctcacccagggtcggggtccttaaagcctgatggttttcacagctatcccccctcgtcttgtaaactcagactgattcagttgaccctttttctgctaatccattttgcttctctgtaggtttgattctcacagttcgctttcttcttctcttccctgagaacaaacgatgtgttttctgttttcagggaaaatcccagggctcaggtctgcaggacctgggtaggctgaggagactttctcactcaccattgtctggacactcctgttgtcttctgtgcatggaggcatttgggaaatgaagtggacattagtcattaagggaataatactagttttctccaattggatattgatgtagagctgaacttgtgcttctcacactgtcacagagtttggaccctcacctataactttgaggagagttgatgatggatagtccattgtgggtgagctctgggtaacagtaattgtagggtctggctaggcagcctaaggtcaatacttctggacctcaggaaagacaggctggaattcctgggaagacctgcatctgccatccaccgtggagtcccatcatcttctgttatgctgtgattgaatcagccccacctagtttatctagaacactcttcatgacttaggaaaacataatggcaagctctcctaacacctgtatcatgccatgggagcaacacctaagctagtgtgtgattgagtagatgagactgtgatctagtcaagacgacaggtaaaattgattgttgtcattatgatattttatatttggcaatataatcatgctcatattataaatacttttgctacattttttgagtgtgtcagaggctttggaactggaacaacttcatcttgaataggggctaggaaaaataagaccgagacctgctgggctggattcctagtaagttgatgcagtaagttagtcacaggatgagataggaggtctgcacaagatccaggtcataaaggccttgcagataaatcttacagtaaagaagctgggcaaagccctccaaaaccgagacagtggctaaaatgacctcagtttgtcctcactgttcattatactctaattataatgcattaacatgctaaaaaacactcccttccagcccccaagacagtttacagttgtcaaggcaacatcatgaagtttccttgtgtggtttaaaaaggaggggaggaacactcaacttcaggaattgcctggaggactcatgaataatccatccattgtttaacatataatcaagaaataaccataaaatggacaaccagcagcccatactgctgctccacctctggtgtagccagtctcattattttacttgcataagaaacttgttttcattttaatctgtggattttccccaaattgggacccctttctcctaatatttgtgctattattcgtgttctgagcagaaaaccccaagatggaatgaagtttccctacatttttataagaagtacattcacccctttgagcgaaaatgcacagggagtggaatgaggctgggaagctaatggcgtatgatggaagcttgtccctgactggaggagagagggagggaggattgggaggaaggttcctatatttttgtgctatgcaaggaagctgcaaaagataactgagtctcgtgtaagtcagtgctacctctcaggggatccctgtgactccaagaaagggctcttcttaggaatcactgtggagtcagtcctttcattagagtagaccacaggacatgggcctcagcacacgccatgccacagatgtcagaaagcagctgctgggaacctgatccacctgcattttgctgcctgtaggaggagggagggaggtgcattctcagggtcagcacactgtttgtgaatttttatagagaacccctgcttttgctgtatttttattggaaaatatatgaacaagtgtgcacctgcaaacaactgtaattttcacatttccttcagttgcattatttcttaatcctgaatgacgtcctgacacagagttgagtttttcacaggcattgttcgaaggatcgagatgatggcattttccacattcactggtttttctccatgtggcagagaccttgagtagagcacatctggcccttatccacactatctcttgtgtcccctgggaaagagcagagatttgcctgactgcagaatctggggtaggagtctgcacacctctgagcctgcagagaagctcagcgaagttttgtggagtcagagagctttccgtgtggggaacctctagcttcctcactctcggagattaatggtcagctgtacttgaggggttaagaattagagcaccttgggagcctgtctcatcacagttccattatgtaacttaccaccattagactgcgggtaataactcaatcttgatttttctgacccgattttttcatcttattcattactaattttgtttatggaaaatgttatgtttagtttatgattaaaacctcagaactttctgaacttatcaggaataatacaaatgtgtccagtttgggggaaatgtaaatgaatgtccatgcagtttgggtgtgtgtgtgtgcgtgtgtgtgtgcatgtgtgtttgtttgtgtgtgtgtggatatgtcagtcacttacaccacaatgaacatgattgctgaattacatagtcaaactaaaattagatttgctgaaaattgcctgcagcgatgtctgtgaagctgaccctgtcactttgctgtgaagaaactcagtgtacaggcgaggttgcacgggagagctaaaagcttctgcacacaggacaggctgagctcctgaactggagccaggcacaggactgagcacctgagaaacagaacccccagccctcctttatctgggctggatgggcaccagaggacccgcaggagatgctcagaactcacacaagacagagcctcagtgaggagcagaggcagcgaggaaccagtccagggagccctgtgaccgccacctcgggttgtcttattttgcttaacagcatccaaacctcaggagaccatttattacgttatttagacttccatgccctttctgtcccgaagtaaaacaaacataaatatgactctgcagttagctctttgaacctgggttatttttctgagaatgtcatcttcgtcatcaacatcatggtcatcatgtcaaaatcaacaggcaaatccagtcaccgtgaagacagtttcatggcatgattcatacacaatcattccattccacagagaatctctttcagattcttaaggtggattaaagtgttatatttaattgccaattgtgaaattggtggaagacattatactaaaggaattgtctctgacctctcatggggtcatatttccagaaaatcattgtgatcctgagtgtgagctgactttccaagtgttcccaaccctcctccagatgagatgctggtctgtgtgttcttgctgcttcccctggggcagattcctcttgttttccccagttgttccctcccacagctctcataatctctgttggtgtccccaacttccagatctgctgccatgacctgcagattaaagctctgattccgtaagaaagtgaggggagctgcttctcaatagagctttgatgggaacctctgttcatacctcaattcttaaggggctgcaccagtgccctaggatgctgattttcatggcttgctcctgcagggtaatatcttagttttgtagtggggatcagagaactgggtctggatgcatttcagaagtgtgagctcattctctcccagacagatactatgggaaaggaagatgttttgcaggggtaaatgattcaagagattagggcaactctccagtatgaggtcccttagaatttctcactataacatgcctaacacactcgacttcaagcaatccagtgtatatttgttcttcatcttgtaatagcctacattttatatgacagcctctgcctcagggaatttcatactctggcttcattactctctacaggaacttgcctctccctagatttcaaatattttgtttgttttcaaccctcaattatctgaagcattaagtaaaatttgcaaacttccatcttttctgtttatctgttattgttgatactattgttgtaagaatgaatatatgggcccggcgcggtggctcatgcctgtaatcccagcactttgtgaggccgaggtgggtggatcacgaggtcaggagatcaagaccatcttggctaacacggtgaaaccccgtctctactaaaaatacaaaaaattagccaggtgtggtggtgcgcaccagtagtcccagctacttgggaggctgaggcaggagaatggcgtgaacccgggaggtggagcttgtagtgagctgagatcgcgccactgcactccagcctgggtgacagagtgagactctgtctctaaaaataaataaataaataaataaataaataaataaatatgtgtgtatatatatatatatttctcatctatgtacatttttaagcttagcagcatattttttagtgagatccagaataataaaagaatccaaacatttttcagctgcctaatagagaaacaaattctggtaaattttttcactggaatactactcaacatttataataaatatatttctggtacacagaacagcaaggaaaagtatctaagtatttatgctgagtaaaataagccagacaaataagaatatgtactatattactccatttatgtaatttatttcaaatgaaaaaaatctaaagtaatatacaaaagatgagtagttacctgggaaaagggtagaataaaggaaggggaaatgtggaaacatacagaagaacaagagaaaatgttgaggggaactcacttgtccacctcagtaatgatgacgcttacatcatgttttcaattctacactttaaatacgtgaagtgtattatctgccaattaacactcacaaaatttattgcaagcaaacaaatgaaaaattagaccaaaagcggtggtataaagatacaaaatatccattaaaagtcagaaatatatgagaatttgcctcctgaaccctagttctctccttatttttaggtgaatgctagagtgccacaaaaatcactcaagttctcaatacaggaagtgggttccacaaagcacactaggcatgtccaattcttacctggagttggttcagggagtaactggggccactgatgtggagcacaggccaagctaccagggctcattcatctcagacatgagacacacacagcccctcctccgtgtgtgggtttatttcacatctgtaaatggagaaaccattgacttctacagaacataatttacacaaatatgtaaaaatataatagtgcaaaatgtttatcacaacacattttcataataagacagtgtattttccaaataccataattgtcacccaattcctgcggggccctgtcattttatctggggtctgccatctcctcagggttcccaccccagagctctctgtgtagcaggagacacgcaaatagggccctccccatgctgatgaaaaccagctaaaccctgaccctgcagctctggcagaggagcctcagccccgggattcccaggtgtttctgcttggtcaacactgaacatacaggattcaccatggagttggggctgaggtgggttttccttgctgctattttaaaaggtgatttatggagaactagagctattgagtgtgaatggacataagtgagcgaaacagtggatatgtgtggcagtttcttaccaggatgtctctgtgtttgcaggtgtccagtgtgagatgcagctggtagagtctggagcaaacttgacaaagcctgggtgtccctgagactctcctgtgcagcctctggattcaccttcagtagccatagcacgcactgggtcccccaggctccagggaagggtctgcagtgggtcccagttattagtggtagtggtagtaccatgtactacgcagactctgtgaagggccgattcaccatttccagagacaataccaaaaactcactgtatctgcaaatgaacagactgagggcagaggatgcagctgcatatgactctgtgagagatacggtaaggagaagtcagtgtgagcccagacacaaacctcccttcagggtacctgggacaaccagggaaagcctgggacactgtgcactgtgctgaccccaggggcaagtgcaggtgctacaagggctgggtttcctgtcttgatctggggctgccttgttaccaaattacccgagggaacttctctagatttgcaattctgtactaacatttgatgtctgtgactgctaaacttccctcacatatttgttttttgtttgtttgttttgttttgttttttgtaacaggaagacccatcctcacccctacagaagcccgagtgtcaccttgggggcagaaatgaccctgccttggtcacattgatcagtgtcctgaggaagcccagtggaacctggggagtgttttccagtcaggctcagggcagagacctccgtggaaatctctgattagaataggtttgggattcagacttgggccaagagggagtctcacccatgggagggtccttaaatcctgacagtttttacagctgttctccctcctctggcaaaactgtgcacatctgactcagaactgatccagctggcccttacttgctaatcaatttttcttctctctacacttcattctcatagttcccttttcttcccttcccagaaaacagagagtgtgttttctgtggtctaaatctcagggctcaggcctgttacctggaactcaggtgtggcccaggctgtggctcctgtgagacctggggaggctgaggggactttcccactcaccattgcctggacccgcctgctgtcttctgtgcatggaggcatttgggaaatgaagtggacattagtcactgaggggataatggtagctttctcaaatgagatactgatgtagagctgatcttctgtttctcacactgtcacagaatttcctccttcatctgtgactttggggaaagctaaggatggacactctattgtgctgtgagctctgggtgacagcaattggagggtctggctaggcaaatcctacagggtttcaggtcaatggagttggaatttctgggaagacctacactgtcatcctccatggagtcccatcatcatctcttatgctctgatggaatcagccccacctaggttatctaggacaatcttcctgacttaggaaaaaaatgatggcaggctttactaacacttatattataggatcagtacaacacctaggttagtgtgtaactgaataaatgactctatgagtcaaggggacacataaaattgattgttgccatgacatttatttatttatttatttatttatttattggaaaccagagttttattgttactgaaatgagtctcgccaagcattcaagaatgggattttttaaggatagcttggtgggttgggggcagccagtgagtcatgagtactgattgatcaggtcagagataaaatcatagggagctgaaggtgtcttgtgctgagtcagttcctaggagggggccacaagatcggatgagccagtttattgatctgggtgatgccagctgatccatcaagtgcagagtctgtaaaatatctaaagcattgatcttaggctttataatagtcattttatccccaggagcaaactaggaagggttagaatttgtagccaccagctgcatgactcttaaaacataatttctaatattttggctaattcgttagtcccccaaaggcagtctagtccccaggacgaaggagatttgttttgggaaagggcagttattgtctctgttttaaactataaactaaactaagttcctcccaatgttaggtaagcctacacccaggaatgcacaaggacaacctggaggtttgaggcaagatggagcaggttaggtcacagctctttcactgtttcagttgcagctttgcagtggtggcttcaattcctccctttgagttttgaccttatcgacttgttttgtttctctttaagtgatggttttataaccatctatgaaactctaacaggtgctctcacatgcagatttctgattaaaaactctgaagatggttacaatagtatagagataaaactatcaaatagaagactatcttttttgacttttcacttaaaatgttgcccaagaaaacttttcttttgagctatttatagctttcaacaattgagtatagtcctgtacataaaatttggagaatatttgtttctctctgtccactttctccagaatttggaaactctttgtgaatatccttaacttatggcaatatgatttttcataagtgcagtaagattttttttttttttgcaacaggacacaattggagaaactggttattttaccaaggctttgactgtaatggcgtgcttcaccttaagcaatcgaacttgacttatacagccaataagagccccttgggaaaactggcctgtaccttgtccacacagtctttgtacaaggttcctgaccagtggtaagtaaagaatgtcactttctaacaggcccaagaaccccatgttttcctgggaccccagaggaaaaataatttaccagacttacaggtatttgatggtaaaaactcatggctgggcttggctttaaaaaagtcttatctgagattccttatggaacagagttccaccaaagccaattttaaaagcctgtgtaaacaataattatttgtattgtgctttatgcaaataataaggccatgaataataagactaaagtttattttgcaaataaatcagtcctatcttgatttgttttaaataaaaatggggacaagagagaaaaaaattatgctttaaaaatatagtacacctgttgtttgctgttcttgtttttttttcttcagcagtttggacgaaattctaaattatttgtaggctacaaagccataaactaatgcgttcaaatctttacttttaaaactgcgaattgcactccttaccccagttctcattatgtactttatagtatgttgttccctccaatgtggtgctggaattatagatgacagcactgacagctttgccatgcaagccttggaaccccacgcaggcctgcgtgagtacactcagacagttgcaatgaggttccagtcctcttatcttgaggtcagcacctacccctactacgccccaggtcatcaataaaaagttgtaacagtcttggcccttcttacatcttcattatccaacaccatgatttttgttttttgccaaaacaattgccaaatatagtcataatcataggataaataattttgctgaaatatatgtgttattattggtcttttgagatggaaagtccaagactggattatgctttcatgcatttttcataagaagtacttccactcttttgacaggaaacgcacagggggtgacatgtggctgcagaagctgatggcatatggtagaaatctgtccctgagtaaaggagagatggacggaggattgggtgaaacattcttaggtttctgtgctgtgcaaggaaggtgtaaaacatatttgagtctactacaagtcaacattacccaagggggaacccctgtgactccagcaatgactctgcctcagaatcactaaagagtccttcctttcattagagtggaccacaggatctgggccatagcatagacgtcagaaagcagcagcttgacacctgatccatgtgcattttcctgcctttaaagggagggagagaggtgtattctcagggtcaacacactctttgttgatttttacacagaacactggcatttactttatttcattgaaagatatatgaacagatgtgtgtctgcaaatgattgtaattttcacatttattccaattgcataatttttaaattctgcttgatgtcctggcacacagttgtgttttctataggtatttttcaataaatcaagaaaatacattttccactttcactggcttttctccatgtgcagaggccttgagtagatcatgtctgactattagtctgttttcatgctgctgataaagacataccagagacttggaagtttacaatagaaagagttttattggacttacacttccacatgactggaaaggcctcacaatcatggtggaaggtgaaaggcacatctgacatggtggcagacaagagaagagagcttgtgcagggatctccctttttacaatcatcagatctcgtgaaactcatgcagtattacatgaacagtgctggagaaacccgcagccataattcaatgacctaccactgggtccctaccatgacactgggaattatgggagttaaattcaagatgtgatttgagtggggacacagccaaaccatattattttgccccatggcccctcccaaatctcatgtcctcacattgcaaaaccaatcatgcctttcctacagtcccccagagtcaacttgtttcagcgttaactcaaaaatccacagtctaacatctcatctgagacaaggcaagtcccttccacctataaacctgtaaagtcaaaagcaagttacttcctagaaacaatgggggtactggcattggataaacacacccatccaaatgacagaaattgcccaaaacaaaggggccctctgcaagtccaaaatccagcagagcagtcaaatattaaagctccaaaatgatcccctatgactccatttcccaaatccaggtcatgctgatgcaacagatggtttcccttggtcttgggcagctccacccctgtggctttgcagggtacagcctccctcctggctgctttcacaggctggtgttgagtgaatgtgccttttccaggcacatggtgcaagctgtcagtggatctaccacactgggatctggaggatggcggccctcttctcacagctgcactatgcaataccccaatagggactctgtgttggagctctgaccccatatttacctttctcactggcctagcagcggttctccatgagggtcccactgctgcagcaaacttctgcctggacacccaggtgttttcatacatcttctgatacccaggcagaggttctcaaggaccagttcttgacttctgtgtactcactggctctacaccatgtggaagctgccaaggcttggggtttgcaccatctgaagccatggcctgagccctacattggcgtctttcagccatagctggagtggctggacacagggcaccaactccttaggctgcacacagcacgggcaccctgggcctggaccacaaaaccacttttgcctcttaggcctccaggcctgtgatgggaggggctgccgtgaagacttctgacattcacaggagacattttccccattgtcttgaggattaacatttggctcctcattacttatgcaaatttctgcagctggcttgaatttcacctcagaaaataagatttcttttctactgccttgccaggttgtaaattttctgaacttttatgctgtttcccctttaaaactgaatgcctttaatagcactcaagtgggctttttgaattctttgctgcttagaaatttcttctgccagacaccctaaatcatctctctcaagttcaaaattccacaatttgctccagttcccaatgagttcctcatctccatctgagaccacctcaagctagaccttattgttcatataactatcagcatttttggcaaagcaattcaacaagtctctaggaagttacaaactatcccatattttctggtctttttctgagccctgcaaactcttccaatctctgcccgttacccagttaaaaagtcacttccatatttttggttatcttttcagcaatgtctcactctactggtaccaatttactgtattagtctgttatcacgctggtcccaagactggacaattcataaaagaaaggtttattggacttacagttccacatggcttgggaggcctcacaattatggtggaaggtggaaatcaggtctcacatggtggcagactagagaagagtgcacatgaaggaaaactcccctttttaatccatcagatctcatgaaactcattcactatcacacgaatagctcaggagagacccatgcccataattcagtcacctcccatcaggttccttccatgacatgtgggaattgtggaagttacaattcaagatgaaatttgggtggggacacaaacaaaccatatcactgaccttctccgcatcatctctcatgaccccagagaaagagcagagatttgtctggggtaggagctgctcctgtggaacttagaggctgcagacgaccccagtgcagttttatggagtaagagagttttcccatgtctgggaacttctagcatacccactgccagagattgctggttggctgttattgaggggttcagaattagatcacctggtagcctatctcactgcagccccattgtgtaacttaccaccaatggccttcacgtgaggactcaatgttaactgttctgacctcattttcttacctcctttatttgtaagtttggttacagatttttttttactttaatttcagggatatgtgtgctgaatgcgcaggttttagtttcttattcaagccttataattgctcaactgatcaggaataatacaacatgtatgcagttttggggaaatataaatgaacatccatgcaaaattttttgtttggatatgtccgtcagttacacccctatgaacataatagccggtcctcaccagaaattgctggtcctcaccgatctcaaaagcatctagatcttcaacttcctagccttgagaattcagaaaacaatgtttatgatatttctgagccacccatttaatggagttctgttatagcagctgaaacagactaaaccatttaccaagtctcagtaagggcagtgaggatccaccatgcttgagagacaagcattactctctcatttgcagctcaggatgacagaagcatgatcatgagctgatctgaaaagaagatgtggctttctctccctcggatctcagttgaagccatggtgtcacatctctatggtggagactaaattccagtctgtgatgtaatggatgcctgcctcctcccaccctcacttacgagacagagtttccatgccatgcgttattgaccaagaaccaagaaggactccaattattctcacccctgctcacttgtatggcagaggttctggggatattcctgggagaggcataatgagactatttaagtccacgattcccaaacagttttatgctcttaaagcaggagtatcactttgagatatatgaataatttcatgtgcactaaggtggaggctgttatatttttataggtaaagatgcatggcataaagacagagatacagcactctggaaattgtgtgactatgtttgcagttgactgtgaataatttttaccatgaagttatcctaaaacacataatatatttttactgtaagtaattaatgaaaagctgacagctccacaagagcaatatccacttggtttagcagagagaatgagaaatagcataatttaagaataatcagttagacactgtgccatgtgcctgtattttcaactagtgaggatgctaatgtgggaagatcacccaagcccaggatttcaaggccagcctgcaagatattgctagacccattttcttaaaaaaaaaaaaataacattctgggtcatgacaaacctcaaaaactgaccctctaaataggaacaaatttaattgcattaaaatgtggatgaatttttgacacaaaacagtgacagcatgccagcaatgagtacagaataacatccagttgttatgttaagagatacagactccgaaaaagagacatcaggtagaggctgtcaaaggcctcactgcctaatgactgcttttccattgatactgtgtgtatatcccggaatgcacctgtgaatgaggacatcatgtctttcatagtgtgagagaaagagacattactacccatctgacaaaggattgatcagaatataccaggatctcagacaactctataggaaaaatatctagtaatccgaataaaaagcaggcgatatttatttcttaaaataagactttcaaattgcaaacaggcatataaaatgtgctgtgtaacactgatcatcagaacaatgcaaaacaaaactacagtgaaatatcatctcatctgattttaaaatgatttcatccgaaagccagacagaaacaaatgctgggaaggatatggagaaatgagaacactcataacctgttggtgggcacttaagtttataaaaccactatggagaacagtttagagtttcctccaaacctaatagtagtgttgtcatataatccagcaatcctgctgctggcatgtactccctcccacaaaaaaaaaatgttgtttgcactaccatgtttgttatagcactgttcgtaatagccaaaatttgaaagcatcctaactgcccattaacagatgatggataaataaaatgtggtacatatagcatatggattaatattatgccataaagagaatgagattttttcatttgcaacaacgtggatgaaactggagttcattatattaattgaaataatcccagaaccgaaagacaaacttcacatattctcatatatttgtggaagttaaaaattaagacaactgaactcgtggagatagagagtgaaaggatggtcaccagaggctgggaaggtctatggtagatggggattattggggatgctcaatggatgaaaaaagtggttagaaataacaaataatacatagtatttgataacacaacagactaagtataatccttaataacataattatagattgtaaaataactaaaagtgtataaatggaatgttggtaactcaaagaattaatacttgaaaggatgtaggaaccattcatcataatgtgagtattatgcagttcatgctatatcaaagtcaggtaccccataaatatacacatataccatttacccacaaaaattcaaaattaaagtatttatgtatctcatcttctgtatctatattacattaaacctaagaagatactggtttcttcacactaccaagatccacatagacatccgtagcttctttctttgcctgtccataatctgacattgaaaaatgaggaaacctttcctatcatatgacattaatttacttagtgcacaatttcaaaatacacaaattgtgttagaattattaaactgacccttgttgaaaatatgtttatcgactagaataccgtgcttatatgcagcttatttatattttacaatcacaacatcaaattatttccaaagatacttgtttctgatattcatgcccccctttctgcagtgaaattagtacaaacctgtttatcattgttagatatttttatacagctttcattttattctgtgtttcatgaccagctaaatacttttgaagttgtatgcatttaggttaacactttgtctcaaaaaattatgagttttcacaaattatttatgccatgtgtttatcattgaacaccatgaaaatagtttcattgtgattaaaaagtgtgtgtttcacctaatccacacaccttttccccagattcctggaaaaccacaaaggtttactggatctatatttttgtctttggcaaaatagcctggctattctcttagcttcttctgcaaagcatcaagattcaccttcactgactgcagcatttattgggccctgatggctggaggagaggggctggagtgggtggtagccatgagtgacccaagtggaagttctcagtggtgctctgctccagcacaaagaagattcacagttcctggggacaacacttaacatcacaatctcccttaaaattatctactggaaagctgaggagtaggcagtgtattactgtgagagacacagtgagggacatatgggtgagtctagacgcaaacttccctgcaggaagacaagaggggactttgtggtaaatggtgctcagaaccactaggggacactcagaaccactaggagacactcaggatagcagaaggtgctcaggatgccgcagggtgctcaaaacactaggggtgctcaagaccagcagggggcactcaggacaccaggagacacttaggacatcagggggcgctcaggacaccagggggcgctcagcacaagcaggggccacagaatgacaagggtgcattccagaccaccaggaaacactcaggaccaacaagagattctcagaaaccaccaggtgtaacaggaccacctaaaggcccacaagacaaccaggagacactcatggccactgaagaacattgaggacaccaggggttcagggccaacagggagtgctcggggccaccatggggctttcagtaaccacgagggaatcaatcactcaggacaccacggttttcttaggaggcagctccacatcaggtgcctggggaaggtgacgtttgcttttagacctagctgattcctgagctggtcaagcaaaagtcttcccacgatctctcactatttcttccttgtaacccatggtttctttcacatacaaatcattaacttaggataggaattcaattcaacttttaaccttgcatatttttagaataataatagcaatagtaattcaatgtgttttgataataagaaattgtgtatgcctaattcaaactctggttccacgcatgggtttttgtttcttgtgctgtgccagtcacactacagtcaatgcttttctaataataactcaacaatgtcacggtgttaagtttcctttcattttgtctgccatttgtggagatgaaacaccactttcacgggtcagttcctccactttggttgggttctggtcttctgctcttcacactgtttctccaccttcccttctgtcaaatccttttgtcttcctcagtctcctggcaaagaagcaacaaatctatttattttgtctcctccacgtctggtgaatctgttcacttctcttcatgatcattgaacccaaccatgtttagaaggataacagttcaccttacaatatgctcatgtaggtcaggtgcagtggctcactcctgtaatcccagcactttgggaggccaagacgggtggatcatctgaggtcgagtttgagatcagcgtggccaacatggcaaaaccctgtctctactaaaaatagaaaaattagccaggcatggtgtcgggcacctgtaatcccagctactcgggaggctgaggcaggagaatcacttgaacccagggtgagaggctgcagtgagctgagataatgccacttaactccagcctgggcgacagagagaaactccatctcaaaaaaaaaagcatatgttcatctatccgcagactctctgacatcgtcacccttttctagggtcctgcagacatcaccccacaacatccagtccttttcctaagtaccacagagtgggctctgcagctcctgctgctctctgtgtgctcagcgctgaggctcaccagtgctttgatgatgaagttcaaatccctaatgtgtttgcaattctcagacaaccctctagcaagctgccattgtgagtgcattctggggatcctgggctgatttcaggtccatattgctggatgttctctagcatccaggcgtgttggcaaataaacatctagaatttgtattgaaaatttgtggaaaatcaatggtagaaaacaatcctaatttctaaataagaacattttatcctgactttataaaaacacaatgttaatttaaccaataatgtaataaaatgtgtttaaagtgatgtttatcttgttattagatgtattaataattggtattttaaagtatactaacagcataaatgacaaacaaaccaacacagcgattatacataaataccattgtacattaattaatttggcaagaatggcatttattttcatttctaccaaaccttgcctttaaatatgtttgttaattggcattaggatagtgaaacaatcacacagagcaacaacattttggaatattacattatactataaaatagtacattcgattcaattatataattaaaataacattaaataaattcatgttttggtttgatatttggatatgtgttcatttttgtattttctttttttgtatcttttgtagagatggggtttcaccatgttggacaggctggtctcgacttcctgacctcaggtgatttatcgggggaacccacccccaatatttcaatgtagggtctttctattttctgtaagtgtcggctggtctgagaaataaagagaaagagtacaaagaaaggaatgttacagctgggccaccgggggtgacatcacatattgataggtccgtgatgccccctgagccgcaacaccagcaagtttttattagggattttaaaaggagagggggtgtacgaacagggagtaggtcacaaagatcacatgctttaaggggcaaaaagcagggcaaagatcacatattccttccccagggtattaattactaatattccttgctgggaaagaatttagtgatatcttccctacttgcacatcagtttataagctctctgcaagaagaaaaatatggctctattctgcccgaccccgcaggcagtcagaccttatggttatcttcccttgtttcctaaaatcgctgttgttctgttctttttcaaggtgcactgatttcatattgttcaaacacacatgttttacaatcagatttcatattgttcaaacacacatgttttacaatcaatttgtacagttaatgcaatcatcacagggtcctgaggtgacttacatcctcagcttacaaagataacaggattatgagattaaagaaattatgaaagtattgattttgggaactgataaatgtccatattaaaatgaaatcttcacaatttatgtttagagattccagtaaagacaggtgtaagaaattataaaagtattaattttgggaactgataaatgtccatattaaaatgcaatgcctagggccaacaaaggagtcatattaatatgaaaaataatagctgaatattttggaaatgacacatgcagtaacaaatgtctatatgaaattaagaagatattgacacaaaattgagaaaaaattaacataattatgctcactactggtttataaaatgcctataataacactttttaaatcatattatagaaaataaaataactatataaatagcactctctttgcttgattttagtatttggtgcttcaaatgttttttatacaaataaacattggtcattttttgatggtaatttcaatattttcttccagaatacatgttcataaatgtaattgaaattgtataattttcagaaacttattttatcagttgtgacttgtatttttatgatagactttttacatttatatacttttgattcagaataattatagataaaaaaattataaagttaatacagtgtgttcccatctccaagtatctcctaagatgaatatcctctatcatcataagacatggtgttaacacatttacattgataagtgtaaatatattcaataccagaccttattttatttatcatttttccaataatttctattgtaaatgaaaaataaaattctaagcttcctcaagcaactaaatgaactcaaccctcagccaagggaatttcaaagtaaattctaaaacttgttccagcaatgatgggaaagtgagaggtcagacatgcctcattacatgctcctctctttggaattaaggcaccagtggccagcattagtactacaacaaagatcttaagacgggcaaaactatatttttgctgtaaacactttctatagcaaaaagacatcaaattacaacttgattctagtatagcatcacatgacaaatagcaaaacctaatgatttattctgtatgaaatctgctacctggaggcttcatctacataataagaactatgatctccaggaccccttatcttaatccagacactcagttgtaatgattgtattaccttacatttcaaccaattgccaatcagaaaatctttgaattctcctatgtcctggaaccctgtgcataaactttcctgcctttctagactgcataaatggtatagctcacatgtgttgattaatatctgcctgtaacttctgacccactaaagtatataaaatcaagctgtaatcaagccattttggacatgtgttctcaggaattcctggggtcgtgtcatgggccttggtaactcatatatatctcagaatgagccattttaaatatttcatagtttgtcccttttagtggatatcttcttttcttttttttgggacagaatctctctttgctgttgctttcgtatatttgtttgtttccagattccatcaaggccatcagtttgaattcagttgtcttgttcctttattctcttctggtaaatgacagtttgtatttctgaagttttctagttgaatattttatagataaaaatttatcaagtaggttgatagtgccatttgggactcttatatctttacctatttaatcattgcttgttttctcaatcacaatgagtgttgatttctccatgttctatacatgttagtctattttctgttccaaatccatttattaggtcttttaaaatggattttggaaaagttgatcctattattttatgcaatatttcacttgagttgcaaaggtattctttttatgattattttgtctgaaattaacatagctattcaagttttctttggtttatattttcatggtctatatttttccatcttatttcttctctttgtgaatatgttaagaagttttcttggagaaagataattgctgggtcttttttttttttagtcaactatgaggaattattttttaatgatattacccttttgtccaataatggttgttttgtctttttacaataatatgtattgtttctattaatttattatttaattattattgatgaatatcttattggttaccataaggataacaataagacatttctataattgaattctaattcaaaaatgtagtacttctttctctttcttatttctttgagacggagtctcactctgtcgcccaggctggagtgcagtgggacaatctcagatcactgtaagctctgcctcctgggttctcgccattctcctgcctcagcctcccaagtagctgggactacaggcacctgccaccatgcccggataattttttgtatctttagtagagacaggctttcaccgtgttagccaggatggtctctatcttctgacttgtgatctgcctgacctggcctcccaaagtactgggattacaggcatgagccaccgtgcccagcctacccctttatatatagaacagagatattataactatatatgtctaattcctcttttctatcccttttttattttatcagtttgtaattacataagctataaaaatgtaatattgacatttttataattgctttacacatttatgtaataaagaaaacacaaatgcaaaaactaaatttaaacctcatttttttcattgttgacaatctttatcttttggatacattcaggtattggatgtatatcatatggctgctcatctagaaactctgctaaaacgtctatggcaagattaatatgctgggaatagattttctcaggatttgtttgtccgacagagtatttatttgtctttgatttatcatctcaagagacaatgtcaagaagatgctgtttctgcaaatgggcaatctgcaaaccaaggacacgtcactacattactgtgcaagagaagcacatgaggaaaggccggtgtgagacacaaacctccaggaacacctgggctaatgagctgcagggggcgctcaggacccactgatcagtcaaccacagaggggagtgcaaaggttaggactgctttcctgcaagcattgaaaaaagaagaaaaaaactccgtctgacagtttctccaaggaacttctgtaattttagaattctgtgcctaccaatgacatctccaaatatttttttaaaatattgtgtttggaggacatactctcacatggacaaaacacaaattgacacagagatgaaaagccctcaaccatagtcaccaaaattggagacatgtagaagctcactgggacctgttgagtcttctccaatcacactcagaacagagaccttagtgggtctcccttagagtagtcattaaggatggtgataacagcctaaagatggtagaccatggtcagtgtcatatagaatatggggaccctcacaagttttttgtctgacccttctcctgacactaaattatgcaaattaataacactgatctggtgcttcttttgattctaatttattttatttttagttgtcgttctcacttttcctttggattttcctgctccctggaaaaggtaaatgtggtctccgtgacctcaattcaagggctgaagccctttccctgtagctcagctggggctcaggctgtggctactgcagccatgtggaagaggctgaagggactttcttcactctccttgctcaggaccatccactgtattgtgtataggcttctctggaaatgcaagtggccatttgtagtgaaagaaatatgtttgtctggttaaaatgggaggtggatgtagagttaattggctgctacataaactgtccttctccaccagtgcttttaggatgagattgtgaaatttgtaagaatcaaaatggagtcacatatgttaaaaccctgacaaatggattcaggaagtgtagggagaattcttacacacatatccctgacaacaagaactatcataaaatagttcttgcaaaaagaccaacatgacctcataatcatgacttctgcaaagacttctactcagaatctacttgcccagccttagattaatgccatctgaattacactgatcatgttactatcactggtcctcaccacagatgcaacaccctcctgagtcctgaaacctgactccatcccatagagtagggcacagatgaggggaatgcaaatctccaccagctccaccctcctctgggttgaaaaagccgagcacaggtcccagctcagtgactcctgtgccccaccatggacacactttgctccacgctcctgctgctgaccatcccttcatgtgagtgctgtggtcagggactccttcacgggtgaaacatcagttttcttgtttgtgggcttcatcttcttatgctttctccacaggggtcttgtcccagatcaccttgaaggagtctggtcctacgctggtgaaacccacacagaccctcacgctgacctgcaccttctctgggttctcactcagcactagtggagtgggtgtgggctggatccgtcagcccccaggaaaggccctggagtggcttgcactcatttattggaatgatgataagcgctacagcccatctctgaagagcaggctcaccatcaccaaggacacctccaaaaaccaggtggtccttacaatgaccaacatggaccctgtggacacagccacatattactgtgcacacagaccacaaagacacagcccagggcacctcctgtacaaaaacccaggctgcttctcattggtgctccctccccacctctgcagaacaggaaagtgcagctgagatacgttttcctgccagggcctgcatttcccatccccattagactcagagccctgtcttcctccttcttctttaataataaatggcatgactcctgttaatagttcatagaagcagaagctgagtcctgtttgtcaaacattcagcatgaaatgttcatgttacctgggccagatgcatcactggtatgtggccgccagtttaatgggctcatactactccaagcggccgaatacaaaacagcagaacatatgcctttattaaactgcaggaaatgacactggagaaaaatgtggggataagggagcaggaggaattgtgaaaattcagataatagcttttctcgtagagagaaaggtgcgttaataaaataattttataaaacaataaaacagatggaatgtgtccccatcacggagtgtctcacagtaacagtgcagaaataaatttctaaaaatgtcgtagggtaggtgtgatagacaaggcttatttccacacagggagcccataaatacccatgtaattaaaaatccagctcttagaaagggagtgcctcaacttgacatcagaaacccacgtcagtgagtctgaggagcaatgtggaaaagaaatggaaaattcaacaatacctttcttatgaaaatcctagctcacgtttcaacatgaaacataactgtctacaattttaggaaaaccatcccatggcaacaagtcactacactcaaaaggtactgagctaacagagttccagcagtgagcaggtcagtgctgaaatccccggagaatcaaggctctcaggtacgttgtacaaaacccagaactgagccacacaatctatggtcaagtgatctttgacaaagtcaacaaaaatatgcacggggaagaggccacgctcttcatgccatgttgctgggacaattggactgccatatgcagaagaatgaaactggacaccaacctgtcgacatatacataaccataagaaaatggactgaaggcttgattataggacttcaaaatataaatgtactcgaagaaaacaccaggagaactcctctggacattgggcttagtaaataatttaccacaaaaacctcaaaagcacaagcaataacatcaaaaatagatgaatggaatttagttaaactaaagagcttccacacagcaacagagtgaacagacaaattgcagaatgctaaaaaatatttgcacacattgcatctggcaggggactgataggcagaatttacacggaactgaaacaaccccaccacaacaacagctatgaaaaaacaaataacctcattaaaaattggcaaaggacacgagtaggaatttttttaaagaacacatataactggacaagtgctaaacatcactgattatcagggatatgcaaattaaaactgcaaagaggtatcttacaccagtcagaatggctactataaaagaagcaaaaatagcagacatcggtggcgatcaaaggcaaagggaagtctcagtcattgttggtgaggatgtagatgagcacagcctctatggaaaacaatgtggagatttttcaaagaaataaaagcagaactacctttgattcaatgaccccaccattgggtaactacccaaaggaaaaataaatcatcatatcagaatgataaccaaacttttgttttcctgcagaactattcacagtagcatagatatcaacctaaggaattaacctgtgtcttacaacagataattttatttaaaaagtcacatatatatacaattaaatactatccagccatattaaggaatggaatcatgtattttgcagctacatggatggaactctgggtcattattttaagtctaataaacgagaagtagaacagcacacaccacactttttcacttataaatgggagctaagtaatatgtgcacaggcccatagagaaaggaatgatggacattgcagactcagaaacatgggagagcagaagttgggagaatggtgagaaattacttaaagggtatgatgtacattatttggatcatggatacattaaagccaagacgactatgcaatatatatatgtaacaaaattgcagtcactccccgtaaatgtatacgaataaaataaaaaaaaatacaattgaaatgtgaaattattaacagttgatcaacaatcctgaaaattaaaacgtgtgatgcaataaatgaaaataattttagttgaacttcatcaaattttaaaacattttctattcaaccgactatcaagaaactgaaggacaagcttcaggggagaaagtatttgcaaatcatacatctaacaatgtaattataataagaaccctcaaaactcaacagtaaaaagaagcaatctgtttataaaataggcaaaggtttgtgcaaactttctatcaaagaagatgtacagatgacacatcagcatatgaatgtaattttccagtagagaaattcaaatcaagaccaaaaggagacacgactttaggctttagaatgaggaaaaataaagaagaaatactgacagtaccagtgtcagtgagcatgccaggccccgagagactaaaatattgctagtgcaaaatgaaagagtttctgggagaactgtttacagtttcttataaaattaaacatgtccttaatccatgacctagaactctcatccctgagtatgtcctacaaaggattaaaatcatgtgttcacacacacacgtattcagatgtttaacattgtgtgtgtgtgtgtgtggtgtgtgtgtgtgtgtgttagaaactaaaaacaacatgaacatctttgaaaatttgacacaaaccattacaggtgaactccagactttcttctgagtgacagaaggcctgcctgaaagatccccagagacacagtcatggatttcactgtcaccctcacatgtcactggcttgggctgggctctctctggctcttccctgaccaggaccagatgttgagctccactacctgcagttggaagtttatattttcaacaatgcactgagggctaagttgctctacagactgaaccaaacaaacatgggcgcctttgaacaaacagtgcctgacatttgtactgaccccaggagaactcttcccgctctctttcttcttggttctctcctgcaggccagcagccctgcagtttagcctggacctctcatgcatctacccatctcctcccaagtgcattttaccacagcctccactgtttttgtaattctccacactctgttgtaaatgaagtcaggtccttcgagaccagattcgggactctattttatgaccaaatttcagcctcacccccactcctgagacagagctcctaaataagattctgcaggtggagattaagagcgtttttcttcctcaatgtaggagatgagtgctcagtggagggatggggaggagctttccactttaccagcatgcagatcctgctggggtggaccctctgccataggagcagggctgggaaccaggcagccaatgtcctcctccttggtgctgcactcagggcagagcctgcatccatgagtggggctgtgtggaagaagtgagtctctggttctcagtaagtcttgtctagaactgagcctcagcagcatgacctgtgggcaaggtcggagggccaatgtcctggcccctggggaagagtgtgctctgctgggagctgggcagaaggaatcctgtctacttggctgcagccatctgtggtggaatttacatcatgctgagctcgggcatagaaggaaggaagagaatctttgatcaaatatcaatatcatgtctgaccttactgaggttttgtagattatctcgaataaatgttccttcactttctgtatgttgacagggcctttccagacccgttaatttttcaaaattaatctcaccagtttcatggaggcatggatatatcgagctccttataccgtcatgtgagatgtggaactgtttccttcactggttataaaataatgggttgacttttttcccaacactttacagataccatcaattgtcctattgcttatatggttataaccaaagcaatgctgatattattcatttctattctattgcaaggtatgccccctctactcgtctccaattgctggcatgtatttccatttgtctgtatgttttagtaatttgaatatgattcacctaagagtgtttgtgtgtgtgtgggtatgtgtgtgtcgtgtgtgtgtgtgttaagggcttatcctgctatttggtgttctctgacctgcactgatccatgacttacaatttctctaatttggaggaaaaaatagagggaaagtgagtttgagtccagacacaaacctcactgaagtgagcacaggattctaaccccaggggtgctcaggacacgctgatcacaagagccagcctcaggggcaggtgcagatggaggctgagctcttctttcccgtcagcactgtggcttcttctccataaaacatcttcccttgaggaatttatctgaattcatgattttttgcttatctccaaagtctctgaaatgaaaatgtttgttttaataaaagaaaaatcttctcacatgtgtaaaagacagtttcctacagtcgcttaatcttgtctttaaatgtcaattatcaatgcttctgaagtaaatcagctaaatctataaaagacactttgtttaactcaacactgcagcccagcatgacagcactgaaagggccagcaagcagcaggcaggatacggtgcatgccagacactggggcggaaggagttagtatccagtgcaagagaagaaagtgcccgtggtggtcactgtcaggacccaagctcacagctccaattgcaggtgaccccatgcaaaggaagagataccctcaccaatgtttagtgtggatgtcgagtctgatggtgccacattcacacaccacgtgaatatggaaagatttaccaactccattattgaggcgtctgctgagggctgcacaggcctctcaataaagtccaaactggctcaatagagcaggaaagaagctgcctcagggtttttatgatggtttggtgttgaaggaatggtggggcttcctactaaggggaaggagcttgtataatttgaacctaatactggcatccagtgaggacacttccatgattttctactaaatttcccatgtgtgggggacaaaagtgaaggaaaaggattaatcctgtcatcagtaatgaggcatcaaaatagagtctgatgacttattctacttagcaacttaagcaaatgagtgaaaaatgaggtaagtgttcactctgggtggacagcaaataggtctgcagaaaatagagtttttttaagtgtaagcacataacaaaaagaaagagaagaacaaattgaacagggatcttggaccaatgtcctgggtggaagctcttcactctgtgagatcatcagcttgctctgagggtctcgggtcaagtccttcttcaatatatctcaggccttacaggatacatgggaatgctcagcttggtgtccttcactagggaaaagaaagagaaatcagactgtcactgtgtctatatagaaagggaagacataagagactccattttgaaaaagacctgtactttaaacaattgctttgctgagatgttgttaatttgtagctttgccccagccattttgacccagccactttgagccaacctggagctcacaaaaacatgtgttgtataaaatcaaggtttaagggatctagggctgtgcaggacgtgccttgttaacaaaatgtttacaagcagtatacttgataaaggtcatccgcattgtctactctcaataaaccaggggcacagtgcactgtggaaagccgcagggacctctgcccttgaaggcggggtattgtccaaggtttctccccatgtgatagtctgagatatggcctcgtgggatgagaaagacctgaccgtcccccagcctgactcccgtaaagggtctgtgctgaggagggttagtaaaagaggaaagcctcttgcagttgagatagaggaaggccactgtctcctgcctgcccctgggaactgaatgtcttggtataaaacccgattgtacatttgttcaattttgagataggagaaaaaccaccttatggtgggaggcgagacatatttgcagtaatgctgccttgttattctttatgccgctgagatgtttgggcggagagaaacataaatctggcctacgtgcatgtccaggcatagtaccttcccttgaacttaattacgacatagattcttttgctcacatgttttttgctgaccttctccttattatcaccctggtctcctactacattcctttttgctgaaataatgaaaataataatcaataaaaactgagggaactcagagaccagtgctggtgcaggtccttggtatgctgagtgccggttccctgggcccactgttgtttctctatactttgtttctgtgtcttatttcttttctcagtctctcatcccacctgacgaggaatacccacaggtgtggaggggcaggtctccccttcgtacttgagcagccttacaactgggtgggtttatgaattaattcctcggttgcattacatgaaaaatcacacaatctacaaattttaaaaaataagcctttactttttataaaagattacagccatttcacaggctgggaagcacagccattggtgaagacgagagacaggcactcccaaggaggagcggtggggcagaaactttatgctgaacgtgttggctaaacagacataatcaacggattacaggaggggctatgcgtgttcataaaggtggtcatgacacatgaatatgggagcaaacatacacgtcacatgtgacccacttagcagtggggacttagcatttaaatgtgttacagttaggccctaagtgccaaaagctggagcaggggcacaaagaccctcagagcgcagcctccataaatggccagaaccaggccatggtcagtggtctctgatcaggagaaaattcctgaaatcaatctggtgtcccatccaagctggggttatggctgtggaatggggggtcagttagtcaggggatgagctgcagttggttaaatcgtgcttatctcaggatcagtgcttattttgctgctacagaagaaaataacagtttattctttaagagttggggtgagggatgtaacccctgcctggcatggccttaggtcttgtttataacggggcatcttattgccccggagaatctgttctgtcagtcttatgatctccattttaatgttagtgttggtccatgttgtctctgaaccacaaaagggagtgggtataatgaggtgtgtctgatctcttgttctgcccagctgggaactcagtttttaggtgtttttggtgcctccttggccaagagggggaaccactcaatctcatggggtgactgaaattttacttttagtttaaagtttataaatatggacctaagtattgacattctaaaagtcactcctttgttttggctaaaagtacttggcaagagtccttgaaatgaggttcaagagcagtattttctcatgactttatttgcaatagacacatgagagactgttgaaaagatgaagtaccaaagtagccttaatctgttggtgaatggagttggtataatacagaaatcactttcaatattttgtaacacatgcatgcatgcaataagacagcggtgagcactgagtgtaaagtctctaaaggtacgatctttcagccaccaaataatagtgtaataacggacatactctggaggagctgactataataccgtaacaccacggggagaaactttggccaaggaagtccaagattttcttttccttttcctttttttttttttttttttttttttttgttgttgttgtttgagacagagtctcactctgttgcccaggctagagtgcggtggtgcgatctcgactcactgtgacctctgtctccctgattcaagcgattcctgcctcggcctcccaaaagctgatattacaggcatgtgccaccacacccagctaagtttttcatatttttagtagagacggggttttgccatgctggccaggatgatctcgcactcctgacctcaagtggtcctcctgccttggcctcccgaagtgctggtattacagcgtgagccaccacacccagccgagattttcttaaagttttgaaaattttaatttaagggttacaattttttcaacatttccagaaagctgtagacagtattattctgtgttatatgagtgattgtagttccttccatttttagatagtattacaaacaattttagggctgcttgctttaaatagatagatgatagatggctacatacatacatacatacgtacctcgatagagatatagttgcaaacataaatacatagatagatagagttacagatgtattttagttattatgctacttttttctttgccttttcttcctatgttatgttagtcaggtctccaggacttaggagtgcatttacaatcccttcccttgtccattttgacgtgttctagacaatgcgagaatcctttgtgtgtggatcacttccaagtcatgcactacccttgcaataaatgtgtttgtgtatgtctttgccttactgacaagctctgctgagtgcagttatttctgccgtctgagctaactttacacttggtagagaaatatattctagatggaggcttccactattaatttaaattactaattcataacctccagcttaattattgaggtataatctatcagagatggtattagaacaaaggtttccaatgaaatctaacagaagggatgtcaaaaaattttcctaacttaggtaaaataaccctgagcccattcttagtatccagccatgtctcctatctatcacactgaatcccacactaactttgacctgacttgggacttgtaagcttcaaatatgaccttttgattgcaatgcctctaattcaggacgtgtggttattttagccaagagtaaagaaaaccaaatttaactcgctaaaaatgacaaagattaaaacctaatgaaatggaaactgggatatgagtggctccagacttggctattttaagagtctatgtgcccaggtgatttcttttctccattttacacacaggcaaacccaaaacgtcagcttcatctcccgttgactctcatcatctcgttcttcatcagcttgcttagaatgttgacttccagctgcatccatgttgccacaaaagacatgattttattctttttctgtgaatgcatagtgttccattgtatacatgtaccatattttcttgatcaaattcaccatgaatggacacataggttggatttatgtcttaggtattaagagtagcatagcaatgaacatgtaagtgggtgtattttttggtagactgatttattttcttttgtgcatatacccacatatgagatggccgggccaagtggcagctctgcttcaaatacttttcaaatctccagactgctttccacagtgcttggactaattcacattccacccaacactgtacaagtgtttcctgttctccgcagcctctctccagactgctttccaagattcctctcctccactttgacactttggtatatccatgtgtgtcctctctggttcagccagggacagagaaccaggaagacatcatgcattttctagagggagctggcttggggaatcaacgaccggagtagaaagtgcctttgtccatgcatcacaggcctgagggccctgggcaggaggtcaggaagagaggatgaccagacagctggggaaaccgggatgaataaagccagtttccttcctggtgaggaggggcaggtcgaagcctcgtgtccctgtagggatgaagcacactcacctgccactgctacctgccaatcaggtgacctgcagagcagcagctcctgagtcactgatggtgacttcctcctcctccaaaccctctaggatctgtgcttctcagagtgggaaccccagcaggtccccaagttttcaatggattcacctagctagtgtctctcctcagccccatccccaggctcctgccctggtgctgtgtacagtgtcacaacaggggtgacagtaacagctggtgcctgcactttccaggccaagaagtttgaaagaagcaagtcacagggccagccgggatatggggtaatcacacaaatttccttcttggaggaagtgctgggaaacatccttgagtcctcctcagctcacgtgcagctgctgctgttcatcccagtgcgggggacacatgagccctccccatgcccaggatggagctgtttcaatcacagcaggatgggaatgtgtcttctctatgggggcttttgaagcacagctctcctgttcctgagatttgagatttataaagacaagtcccacagagtggacctgcacaaataagacagtacaggatccccaggagagacatcccataagagaagggacaggcgggtcccatcacagacactcatcctcagaaaccctgaccggctactcaccttcacaggtccccagttcctgatcagtgcctgtgtctgctcctgagaagagatgaaaactcaagacaaatacttctcatgatcataggcttaaaaattctcaacgtaggaaatcaaatccagtagtttatcaaaaagttaacacactgcaatcaagtaggctacattctgcaaaagcaaggctgctttaactgctttccacagtgcttggactaattcacattccatccagcactgtacaagtgctttaacctatgcaaagcaataaatgtgatgctctactaaacagaatcaaaagcaaaaaccatgtgagtattccagcagatgcaggaaaaaagctttcaatagaatctaacaacgcttcatgataaaaaccctcaaaattatagacattgaaggagcacacctcaatctgatgagccgtctatgacaaacccatggccaacatcatactgaatgggcaaacactggaagcattttccttaagaacagaaacaagaaaaggatgcccgctctcaccacttctattcagcctagtactggaagtattcaccagatcaggcaagagaaagaaataaaaggcatccaaataaaagaaaaagaagaatgcaaaccctctgttttcactgataatatgattctatatgtagaaaatattgaaggctctgccaaaagtctcctagtattgatacattcgtttaggaatgtttcaggatataaaatcaatgtacgaaaatcacagtaacatttctagtcaccaacaacgttctggctgagagtggaatcaagaacatgctctcccaatagccaccaagacagtggaatacctaggaatagagttaagccaatgagatgaaatatctctaccagaaaaacagcaaaacacatgtgaaaaaaatcagagataaaacaaataaatggaaaaataaacattccatgcttatgaatttaaacaataaatatatgaaaaagttttaaaatttgtgattaattctacgtagcaatgccatttttttcaacatttacagaatattgttgctggtaatagcagtttagcatttgagtaatggaaacaccttacagaatcactttataacagttgcttcctgtagtgggttgcttcagttacctgatgaaaacatctgcatgtcacaggttgaaaacataaaatatgtctatcaactgagaaggttgtaggcttttgtcaaggaattacttcaagtcattcagaaaaacagcagacagtaaacgaaacttgttcaaattccatggagagtcaaagctgaagaaaatccaactagaagtgtccaaaggcccccaaggctcagttcctcggcaagtcccaccttctcaggttttccagaattttgtttttaactgatttacactgagtgaagtagattaccaggagttttccattattttaacataaaatcgggggctaagtgttgttattttataaagacatctttgaatctctcaggaaatttacctcctgagggttcagataagatcctactctaggttaagattacatgtttggcgcaatgaactggtacaaatcttactttagctttcatgttatctatttttccgcactgacttccacctttttattagtcaagtatatgggatggaagagtgcttctaagaggtccttaacttgcccatttcaatggattttcaagaagacatgagaaaccactttgtttgcaaagcatcccaaagccatgtcctgctccagaaacgtgatctcatttcctggtcgtttcttaactgacacgctctaatcagtgcatctgggccaatttgaaatgaggtgaagaaatgtgtcctaaagtaaagctaacattgtaataggaattcgtgtttaaaaacatttagttttattattgggcaggatccatcaacatataacagttgaagtttctcaacaggagtttaataaatataaggaatgtacagaagtgtttcctaatttaaataaaatgtagtgattacctaggctgtgagtgcaatcttggtaatcttctatgtccatgcccatcactctgtgcaccgcaaactaattttgacctcagcagaaacgggattaattttcaaattagtaatttttttccaatttaatttatttagatgattatgaatgactattttagcagaaagagaatcaaggaaacttgaactaaataaccagaatttaaaatgacaaacaattcaacaagatgccaggatgtgagtggctccaggcccaattaattcaaaactttatgtgcccaggttctgtattttcccaaaattacacatctccattccagcttcatgccacagttgactcccaccgtgtaagacatggcgacaccattcccaaaggtcgtgtgcaattctgaaaatggaataagcaaggagaggagatgatagtttatattctcctctgaggaggaagaattgcctcaacagaccacttctcctgcatctgtgactagaactatgtcacaggcacacatggagcaaaatccctcaaggggataatacggtaacattaatcagggtgatcatttttaatactataaaattcatagatgacactgcattccagcctgagggacagagcaagaccctgtctctaagaaaaaaagaacaaatcaatagatactgataccaacattttagataatgaaattttcataatgtaattttaaatacactcacatcattacataaatcttcccagaaatattcctagtcatgttgagtttcatcaacttttccagtgttcaaatctagaaatccaatagactcttgaggataaatcaaaatgagggcagtgaaactggtatctgctcagcacctgttaactcaggaggactcaatacacccttgcacactgctgcttctctgaatggctcacaaggactccagctcactctccatcctcctcaaacatctggcccccacttgccctaagttgactctctgctcttagtctgtgctctgaagtcttcccagaggtgaaagtgagctgtcagatggaacttccctctcacctcagcgtggaatttactgctacatttaactatcactctttccataatggttgatttcttggtctgttcattacagatcaaaggcatctgatttgaatctttatttctttgcatttgtctccatgacaattttgggaggttttaccgccagcactatgacacgatgtagtaacatgacacatttgtggttaacaacacctacaaattcagaagctcttcggttgtcttcccagcaaatatagctgcttcttttctgtgtatgaacacatcctggaaacacgtacacacccacatagatatatacatgcctatgacattttcttctctgtaagtgaaaattaacctcaatttcatacgaagttcatcatttccctgaaggtgaaggtaggtcgtttttcatctgttctaacaaatgctcagacaccagctagtaagtgaggagctaccctgcttctggatgttggatctgtctcttcccctttgctttaccacagaagattggccacttgtccaggtcccaagaagagagtccaggtttgtcctgataatatgactcatccaacttctgataactctactgttacacacattcatggaggtagcctattaattacataattcactaaacaaataccaaatacccacattgcaataccccatacccaagggtatgttcatgcattcagtgaaggaaaaggcttttcagagacagatagatcaggctagattggtcaatatatgggtgaaaacactggacttgaatgtatctgttttcccccatgtcacatgtgagacctgtcagacaggaccagggttccttgtgcactcagaggtgagggctcacagaattcctctctggtttccaggaaaggtaactgcagtaatcttggtaatgagaatatcctccagtgctgacctattatagagtttacatatgaaattttcactgcaattcacaatctactctttcacacagaagtgtacagaggtcaggacacatcctcagggtcacacattgagaatgatgaagatatgtcccacgagtttttcctaaggtctcagaaagaattccaggactcaaaaggtctcagagggcagctcccagtgccttagttaaaatggtggctcaggcctgtaatcccagcattttgggaggccaaggcaggtggatcacctgaggtcgggacattgagactagcttggccaacatggtgaaaccttatctctactaaaaatataaaaattagacggggggggttgtgcatgcctgtactcccagctactcgggaggctgaggcaggagaatcacttgaacccaggaggcggaggttgcggtgagccgagatcaggacactgcactctagcctgggcaaaggagcaaaagttcatctaaaaaatttattttaatttaaaaatttttaaaaaatggcccactccctagaacagagagattccctctaaacatgatggaggtcccgaactatacattaagtgaatcctggtgtgtctgaactcacatgattattacgttaagctgctgttccaatctacttcctcacctgggaaaagaggagccagggcatggctagttgaggccccaggaagagaactgagttctcaaagggcaaagcaagcatcctcatcccagggtgagcctaaaagactggggcctccctcatcccttttcacctctttatacaaaggcaccacctacatgcaaatcctcactcaggcacccacaggaaaccaccacacatttccttaaattcagggtccagctcacatgggaaatactttctgagactcatggacctcctgcacaagaacatgaaacacctgtggttcttcctcctgctggtggcagctcccagatgtgagtgtctcaaggctgcagacatggggatatgggaggtgcctctgatcccagggctcactgtgggtctctctgttcacaggggtcctgtcccaggtgcagctgcaggagtcgggcccaggactggtgaagccttcggagaccctgtccctcacctgcactgtctctggtggctccatcagtagttactactggagctggatccggcagcccgccgggaagggactggagtggattgggcgtatctataccagtgggagcaccaactacaacccctccctcaagagtcgagtcaccatgtcagtagacacgtccaagaaccagttctccctgaagctgagctctgtgaccgccgcggacacggccgtgtattactgtgcgagagacacagtgaggggaggtgagtgtgagcccagacacaaacctccctgcagggaggcggaggggaccggcgcaggtgctgctcaagaccagcagggggcgcgcggggcccacagagcaagaggccgggtcaggagcaggtgcagggagggcggggcttcctcatcagctcagtgctctccctcctcgccaggacctcagctgtccccaggcctcctctttctttattatctgtggttctgcttcctcacatcctcgctgcaggcaagaaagaagggagaaatttctctgtttaccattaaggttttaacagtcactggcacctttttttcaacaaattcccacaaggcccattttaccttcttgacaaagtatttcaaggcttctcaccatctcttgattggcgtcatcggctgcatcgtgtcctgctcttaaattcatgtgatgaaaccccaatcccagtggctctgtatttggagagagggattttaagaaggcaaataagttaactgtggccataaatgtgggaccctaatccactaggactcttgtccttatgggaagtggaagacatcagaggcctctctctccacatgcacacagaggagaggccatgtggggacgcgctgcatgagaaggtggccctttgcaagcctggaagtggcctctcaaaaaactaaccctttcttcacccagatcttggacgtcaaggctccagaacaataagaaaattaatatttgttatttgaaacaacctagtctgtggtatcttctgatggaaagccaagcagattcacagatacaattgtgttagctccgtctcctggagggagaagcagcccaccgaggctgacacatctctcagattatttttataaagaaaaatagatccaagatgaaaaccccaccacatttctgctgagtcattcacttagcaggcttctctgagatcagccctggggggctgtgttctaggtcatgtctctcactttccactatgagaatccatgtagatcatgagaaccagccagatggagtcctgatcccggcccaccttctgctgctccccaagtatcccaaagaaaaccactccagcgtcacccctgtgtcttctactctctaaaatcccactaaagctgaccttaaaccaggagatatttggggccgggctcttgttctcttcttcttagtcttccataaggtccaggtgctgagtaaagcctcagtaaagattgagcttcagttcccctaacccacatcattcccttacatccttgtcatgcatctgtcctctgtgggcactcagggcaggttacacaggaattgcctgaagctggcctcaactgatgtgctgagaccacgggtcatgcacatgtatgattccgggtcatgcacatgtatgattccaggtcatgcaggctctactgcaggacagacctgtgtcctgtggggcacagacagctgctgaccccgggtctcctctaataactcacacacctggtgtttgtgtgtgtccagatggccccatgagcacagcacactagggtggccaaccttacaggtggggccgtcagatggaatggacaggctggtcactcccatcatcagtgatttcccagtgaattttaaataaattaaacaaaattaacaacaaaggggaaggatatgtacctgtctctgggaggtatacagggtcccagaactgtgctgggagtgggtgtgaaacgcccttttgtgtggaaagccctccagcatgagtgaaagctgaaggaatgatcactgtgcaggtggaggatgataggcagctggcagggtacatttcctgaagctgttcctgggtgcatgatggttggatggcccatggtgttgagggctggactcacataggaacaaggaaattatcccatgggaatggcagaaaagaaaatggagatggacacccctggagacagcttattagatttggtggaggaaaaatagaaatttattccaatgaccccagcattttcagctaaataagagttgcattaatagacagaattatgaaaggaagggagaaggagtttatggagggaaaaaaaaagaagataaattaaaatttaaaactatgcaaatctatcaattggcagataacagagtggagctgatgcagctacttccttgttctggaaacctgccagagacacttagcattcctgtaaggccagtctagtggtgatgaacttgtccactttttacttttttggggaacttctcaaacctcctgcattattgaagaaaagctttaatccatgtaacgtatttatttggaagtttcttggctttgtttttattttcagcaacttgaacagaatcatgcacatcatgatatttcggtgaacaacaggccacctacaggacaaaggtctcattagattataatactgtattttcaccgcatttttccatgcttagatatgttcatctgtataaacatctaccatggtgattcagctgcccacagtattcactacacttacatgacatacagatttgttacctaggagcactatgctatcccacgcagcctgggtgtagcaaggtatttcatgtaggtttgtgtaaacacactctatgatccttgcacaatgacaaattgcctaaggacacattgttcagatgtattcctactgtttttcatttttttttagatggagtctcactctgtcacccaggctggagtgcagtggcacaatcttggctcactgcaacctccgcctcccaggctcaagcgattctcctgcctcagccttccgagtagctgggattacaggcatgaaccaccacgcccagctaattctttttttctattttttagtagagatgggatttcaccatgttgccctggctggtcttgagctcgtgacctacatgatccacccactttgccctcccaaagtgctgggattacaagcgtgagccactgcgcctggccaatgtatccctactgttaagccacaaatcatcgtatctcatttctctcccttttttgtccctgttaatattttcatgttgtgcgtgcattcttctcctagctcagtgaacatatttataaggtttactttgaattttctgctaggtaatcaatgtatctccttttaatttgtgtcagtttctagtgctttttttgttaaataatttggaccacttttttctgttttgtgattattgttattattattattttttactttctctgttgctttctcctcattagaagaaaaagctaccgtaatcactcttcacagaatatgcccagggaaaatgccatcacctatcaacccaggctgtcattgtggcatctcttaaaacttcataatggttgaaattttttgttgttgttgttattagtggcactcagacctacagaggattttaagttttgctcctactctaaattaggtggcattgaaattcatcctgcaggcagtctctgataaagtggaggaattgggcagttttgttatgcatatggttcataaaaataatatgagtttaaggttttctcagccaagtgctatatcctgatattttataatcacttctttgaatctctcttgggtttatcttttgaaaatttagatcagaatataaaccaggtttgaggctttttgtttggtgtaaacatctcctataggtcattgcgtgaaaaggcacagagtctatctgaggaggagaactcagggaagcctcacaacaacaggggagacaaaaccgaggtcactaaaaaaatatgaagcttctggctcctgcagcctccagacatgccccacaccctctcattgcacagaaatgaattcctttctctttcctgagtgatctttgccaagattcctctcctccactttgacactttggtatatccatgtgtgtccattctggttcagccagggacacagaaccaggaagacatcgtggcttttctagagggagctggcttggggaatcaatggttggagtagaaagtgtctttgtccatgtgtcacagccctgagggacacgggaagaaggtcaggaagacaggatgaccagacggctggagcaaccagtatgaacaaagccactttctttcctggtgaagaggggcatttggaagcctggtgtccctgtaggggatgaaccacactcacctgcccactgttacttgccaacgaggtgacccgcagagcagcagatcctgagtcaccgacagtggctgcttcctcctccaaaccctccaagatctgtccttccaggagtgtgaacctcagcagatccgcacgttttcaatgggtccacttagctagtgtctgtcctcagccccatccctgggatcctgtcctggtgctgtgtacactgtcacaatagtggtgacagtgacagctggtgcctgcactttccaggccaagaagtttgaaagaagcaagtcacagggccagcctggatttggggcaaacacacaaatttcactctgtggggaagtgctgggaagcagccttgagtcctcctcagctcacgtgtggctgctgctgctcatcccaggtgggacacatgagccctccccatgcccaggatggagctgtttcagtcacagcaggatgggaatgtgtcttctctatgggggcttttgaagcacagctctcctgttcctgagatttgagatttataaagacaagtcccacagagtgaacctgcacaaataagacagtgcaggatccccaggagagacatcccatatgagaagggacaggcaggtcccatcactgacgctggtcctcagaaaccctgaccagctactgaccttcccaggtcccctgttcctggaacagttcgtgtgtctgctcctgaaaagatgcccatcaagagtccccagggttctgcccccttccttgatgtgcctctgggagtggggctggctgggctgtgggtctggcgtgaccctctccacaggtcagcggctcagtgcaggctgcaccgactcggtggggctgggctgtggctgaccctcccagggggagcctggactcttcttaggggtatctgcaggatcccaggttctgggagaacagggaagccacagtgtgtgcagggccccatctccagtaaagtgtttgctgtcgctctgttgacaagggcatatccccaggcctaggggcactgtgggcgcacgaccaatgcgcgagacacagggagtaaggcacagttccctcccattactgtgaggacactagacacagtgtgtgtgtgtgtgtgtgtgtgtgtgtgtgtgtgtgtgtgtgtgtgtccattactgtggggactctaaccaccgtgtgtgtgtgtgtgtgtgtgtgtgtgtgtgtgtgtgtattaggagttttgcagtggcctctgagacccatgatcttgcaggtttagaaattatctgatgagatgttcatccacaggaaccgacaagagattaggtgttctcccaaagcccctggaagctcctggactcactgtgagtgtggactgatccagtgcttccagagctccacagaaggggctccctggtggtttcatagaatccttgcttggggtgtttctgcagagttcactggctttcctacgaccaatttaccattgcaagcgatggcgtcagcagcacatggtgtcacgtgtcactaaaggagcattctgagccaggacacagccacttcatactggggggaaaatgctctgggagcccagacaggagcctctctgcagtgcaagggctgggctgcagggggcgctcaaggcccacccagcacaggctccagccccagagcaggtgcacaggaggctgcggatggagtccccttaagatctgtgtcattcttctaaaaaaatctaaaataagtatttgacaaaaactgctgaagagtccataaatatcctattcaactgcaagaatttatcaatttacactggagatttctaaccctgctacatatcttaatagtaagcatctggaggtcaattaagcttttattttatataaataagtgcaacttttggagaaacacactcatcccccaaataacacattcatgtattaaagcctagaaatattttaaattacctctgagctattcaagtgtgggttcccagtgaagtcctgttctagggaaaattgttctccagtgggagaagctctgtcaacatacagtttagggatatggcagggcacacatggcctctaaggggattatagcttgaacccttagcatcctcctgttgggtaatccatgtgtcatctctccactctttctcatgctgtgttaggtatgaaatagcatcgctcatgaatatgcaaataactgagatgactatagatatctttgtgccctgagagcatcacccaacaaccacatccctcctcagaagcccccagagcacaactcctcaccatggactggacctggaggatcctctttttggtggcagcagccacaggtaaggggctgccaaatcccagtgaggaggaagggatcgaagccagtcaagggggcttccatccactcctgtgtcttctctacaggtgtccactcccaggttcagctggtgcagtctggggctgaggtgaagaagcctggggcctcagtgaaggtttcctgcaaggcttctggatacaccttcactagctatgctatgcattgggtgcgccaggcccccggacaaaggcttgagtggatgggatggagcaacgctggcaatggtaacacaaaatattcacaggagttccagggcagagtcaccattaccagggacacatccgcgagcacagcctacatggagctgagcagcctgagatctgaggacatggctgtgtattactgtgcgagagacacagtgtgaaaacccacatcctgagagtgtcagaaaccccaggggggaagcagctgtgctggcatggaggaaatgacaaagattattagattgaagactttctcagaaaatgatattaagtcattaaggaaaaggaacaatataaacgtgtatttgagaaattttaattatttgagagatttttcatacaatatttattctgcaagcaaatttcagggattgaattaataaaactgatacagaacttcctctgtaggtatctgtgtaaacatcaatttctgaatcagtgttgtaaatattttggaacacacacacaaatcacattttatctctacttttatctctatttttaaaaatgccaaaaaaactcattttgtgcatgtagcattttgaattcccaccatcaatgcatgatagttcttggttttccacattcatattgccatttatcattatgagaattgtgtgttttaaccattctaataggtgagtaatggtatctaatttttagttaaatgcacatttccctaataaaaattcacatttaacaattttcatataatttttgccaagatgcctcttctcatatttggttcatttttaactgcattgttttcttttgattagttgtaagtttacttgcatattgattataaaatcatttaacaaattaaaagaattcatttaacaaatatgtgacttggaagtattttctccaagtctgcggctgtcttttactcccttatcagtatgtattgcagaaaagtgtgtgtgtgtgtgtgtgtgtgtgtttatacaaatttagatttaaaaaatgtaaaatgttattcatccacagatcatgtctttggtattatatctgaaatctcattataaaatacagtaatagcaattactttttccacgtctctaatctcaggctacaatcaactcatgagtgtttaagcttcacctacttgattagaggactatcaacctaacatatttggaatacttctgtaaaaagatgtgttcctcttcctattatttctttatttgatcacttattaatatgtgtattggtttatggatgtctatttcatactctgaagaagatccatgctacattattcattttatttttcaaaccaccacggctttattatgtgctgggagctcattgagtttggatcctgcatccttacagctcacctcatgcttttgtttttgaacacttccctgtttcctgctattataataaattctaaactcattttctatattatctttttcatacatagaatcagccatttttctaaagattgcttgcttctgatgttaaagaatagtatttaaaaaattgtaatactgggtatgtgcattgttaatgtggtataagtacttgcaggacctctcaaccaactggcctagtaaactatgtatctaaccttctgtaatgtgattacattaaaaatgagaacacactggtctctctacccaattatgctaccacatggatctttctagccttccttccttgactgtctataacctctcactgcaaaatgaggaaccccatccaaccatatgccattttattacttagctgcacaatttcaggacacatgcatagcagtatcagaaatgtaaagctgtacccttgtaggaaacatgtttatctactagaatagagtgcttatgttcagtttctttacactttaaacttacagagtttcctcattttcaaagttccttaggtcagcaacttcattttccactttcttcagtgaggtcatttcaatgacactgtataatttgatttatttgaaattctataaaagccaaaactgtagtcaagtgaacaacaacatatagaggatattcgaggagtttagagactggtataaaataagttaaaaagacactgtttaagaagattaaaattatttttagtgatatgcaatggttcagatatgacacaattaatttgtctaagcacatagttttgtgatggaaaatataaacctaaatatatacaattaaaaaaaaatttagcagttcattaacccaaggatcaaatgcagattgtataaaattatctcattacttattttgtgagggtggagatttcatgagatgtatgcaacaaagaatgaggtaattttcctgatttgcatataagatgttgccattcactaaagacctttaattttttaaattgttttttttttaaatcaattttctatgtgacccaggtttttttctcttgacaagcaaataacccacaggattattttctttccttggttgagaaatatttccccaaacttcagctcagttcaggcatacactgtccctgaatgggcatttaccctcagatgggtacacacacctgtcaacatgtggactcttctgtcagacaaacgcacctttactcacgtggattcttctctcagacaaacacacatgtccccacgtggactctttcctcagactaccacatatgttcttacatttactctttcctcagaaaacagacatttcctcatgtggactcttgtctcagacaagcaaacatgtctccatgtgaactcttcactcacataagtacacatatgtccacattgactgtttccttacacaagtacatatatccaatgtcgaattgttctgtggcaaaatgatctcaagataatgataatcataaaccccctccctgacaaggcatagatctgtatttttttcattgcaacctaactttgccttattgtcaagaacagtagtttgcagctctaaatataccaattagagacaggtgtccattttctctggaaacgtatttttatgttcttactggacatatttgttgataatgtttgctattatgaagataccccaacagtgtccacattagagaataaaaaatagtaatgggcagattaactctgtgcatccagacccagaaatcctttgaccttgacttccctgaaatgtagacacagaggatggatgagcaatgctgagcagtgcacccatgaccacaaaaagaaagacgtggaaatgtgtcccctccacttctcatgaaaggcagctcatcccctgttccctcaggccctggcgaggagccaccccatgtctgtgcccttcctcagtgtccacaccgtggggtctgcattgatctggattctcttctcatccccgtcaatattagtgtccttcgtaaatcaggtccagctgtggcttctcctcacggggctgttctcagtctgtttgctgtgttcacggaagtcctgtgtgaagtttactgatggagtcagagggggaaaaaatttacagcccagtggtgagactctcctgcaaagcctctggtttcacctttactggttacagcatgagcttggtccagcacgcttcacaacagggataggtgtgggtgccaacagtgagtgatcaagtatgaattctcagggttactttccatgagtacaaataaattaacaatctcaagcaacacccttttaagtgcagtctgccttacaatgaccaatctgaaagccaaggacaaggtcatgtattactgtgagtgacacagtgagggaaaccctgtgtgagcccagacacaaagctcaccgcagggagacaggaggggactatgtggtagatgctgctcagaaccaccagggggcatcaggaccatcagggagggtgcacagaaccaccaggaggggctcaggacaccagggggcgctcagaaccaccagggggccctcaggacaccagagggtgctcagaaccaccaggaggcgctcaggacaccagggggcgctcagaacactaggaggtgctatgaatcactagggggcgctcaggacacaagggagcactcagaaccaccagggatagctcaggataccagggggcactcggaaccgccagggggcgctcaggacactagggggcgctcagaaccaccagggggcactcaggaccatcagggagggtgcacagaaccaccaggaggggctcaggacaccagggggcgctcaggaccacaagggggccctcaggacaccagggggcactcggaaccaccagggggcactcagaaccatcagggagggtgcacagaaccaccaggaggggctcaggaccaccaggaggtgctcaggacaccagggggcgctcagaacactaggaggtgctatgaatcactagggggcgctcaggacacaagggagcactcagaaccaccagggatagctcaggacaccagggggcactcggaaccgccagggggcgctcaggacactagggggcgctcagaaccaccaggaggcactcaggaccatcagggagggtgcacagaaccaccaggaggtgctcaggacaccagggggcgctcagaacactaggaggtgctatgaatcactagggggcgctcaggacacaagggagcactcagaaccaccagggatagctcaggataccagggggcactcggaaccgccagggggcgctcaggacactagggggcgctcagaaccaccagggggcactcaggaccatcagggagggtgcacagaaccaccaggaggggctcaggacaccagggggcgctcaggaccacaagggggccctcaggacaccagggggcactcggaaccaccagggggcactcagaaccatcagggagggtgcacagaaccaccaggaggggctcaggaccaccaggaggtgctcaggacaccagggggcgctcagaacactaggaggtgctatgaatcactagggggcgctcaggacacaagggagcactcagaaccaccagggatagctcaggacaccagggggcactcggaaccgccagggggcactcaggacactagggggcactcagaaccgccaaggggcgctcagaagaagcagggggtgctcagaacaccagagggtgctcagaagcaccagggggcgctcaggacaccaaagggcactcatgagactgtggcaagggggtgctgagaaccacaggatgtgaccaagacaccaaggggcactcagaactgccagggggtgctcaggacaccagaggattctcagaaccaccaggggatgctcaggaaactagcgggtgctcagaaccaccggaggacactcagaaaaccaggggatgctcaggaaccaccagggggcgcccacgacaccagagggcagtcagaaccaccggggcatgctcagaaccaccagggggcgctcaggacaccaggggatgctcaggacactaggggcgctcaggaaccaccaggggacgctcaggacactagtagggtctcagaaccaccaggggatgctcaggacactagggggcgctcaggaaccaccaggggtcacccaggacaccaggggtcgctcaggaaaccagagggtgcccaggaaaccaggggaggttcaggaaccaccagggggcactgaggacaccaaggggtgctcagaaccaccagggggcgctcaggaaccaccagggggcgctcaggacactagtaggcactgaggaaccaccagggggcgctcaggacactagtaggcactgaggaaccaccagggggggctcaggacactagtaggcactgaggaaccaccagggggcgctcaggacactagtaggcactgaggaaccaccagggggggctcaggacaccagaggtcgctcagaaaaccagggggtgctcagaaccaccagggggcactcaggaaccaccagtgggtgttcaggacagcaagaatggctcaggacaccagggagcactcaggacctccaaggggctctttggaggcagctccatatcaggtacctggggaggatgaggtttccttttccaccttggtgattcctgacctggtcaagcaaaagtcttccccaggatctcttacgatgtcttccttgtaactcatggtttctttcacctataaaacattaacttagaacaggggttcaattcaacttttaactctgcctattttcagagttatactagcaatgatatatctcagtatattttttttaattgtgtatattcaatccaaagtctggctctatgcacaatttttttgttttctgtgctgtcagacacactattgtaaatgcttttctaacaactcagcatatgcatggggtccagtttcttttcctttcatcggctgtttgtgcagatgaaacaccactttaagggctcctgtcctccactttggcccctggtgttctgcttctcaaactttctccatcttctctttttctgtcaaaatattttatcttcctcagtctccatgcaggaaacaggaagtccttttacttcctgtcctccatgtctggtaaatcagttcacttcttttcatgatcactgaagccaaccaagtttaggagagtaacagttctccttagaatacactctacctgcagaccctctgccctcatcacacttttctagggtcctgcagacataacccccacccattcctctttttccctaagtaccacagactaggctctgcaacttatgctaccctctgtgtgctcagcccaggggctcagtagtgctttcatgaagtccaaatccctaatgtgtttgcccactctcagaccaccctccagcaagctgccattgtgattgaatcctgcaaagcatgggctgctttcagtttcctattgctggatgttctttattataaaggcatattggcaaataacgactagagtttgtattgaaaattaacgccaaaaagttttttaaaaagtttttcaaatagaaaagttctatcctgcctagtttaaaaaaatacaatgttactttaatcaatgatttaataaaaatttaagtgatgtttgtcttattagttattcaatttattaataactgactgatatttaaaaagtaaatactggctgggcgcagtggctcacgcctgtaatctcagcactttgggagggtgaggtgggtggatcacctgaggtcgggaattcgagaccagcctgaccaacatggagaaaccccctctctactaaaaatacaaaattagctgggcgtggcggggaagctgaggcaggagaatcgcttgaacctgggaggcggaggttgcggtgagccgagaacacgccattgcactccagcctgggcgacaagaccaaaactctgtctcaaaaaaaaaaaaaagtaaataccattgtacacttaagtaatatatttggcaagaatggcatttacattcattcaaaaatgaaactgcaaatacgagttacattcaattaaataattaaaataatatagaaaaaaatgggtgtgttgttttggtgtttaatatacattcatttttgcatggacgggtatatgtgtcattgctgggctgttgtgtatgtgtgcgtgtgtgtgtgtgtctgtgtgtacaactatgaagtttaaaatatattattaaattacgtagttatattaatccaaatttatcatgttaaaatattaggaaaaaaacaccagtagagaaattacagagaacatcagcaatgcctacagcatttacaagagtcacattaataacaaacaaactagttcaaatgtttagatatgacacatgcagtagaaaacgttcacatggtattaacacaaaaatggtgcacaactgaggaaattataatacgttcatgatattggctacataaatgcttatgatagtaatgcttttcatccatcaaatgcttatgataatgcttttcatccatcatattatagatgataaaacaactctataaacacttccatcactagcgtttaatatgagatgcctcacatctttttctgaaataaataaacatctgtccaccacttcgatgatcatttcaggattatcctctgaaataattatccataataattttagtaacaatattattttcagaagcctattttataaggtctttgaactattatttttatgattgttactttatattttacacactttttatttggaataattataggttatcagaacaattgtaaggaaaatacagtgtgttcacatccatctccaagttttcactaaagttaatatgtcaaaaaaaacatgggacatgggactaatatatttacattgataagtttctgtttattcagctctgggatttatttgaattttgccaatttttaacagtttccttttttcctttttcttttctttttgagataaggtgtcactttcctattgctttttgtttgtttctttgttcaacccacgtaaccacatcaaattcagtcaccatgttcctctcatatcttctggttaatcacagtttgggttcctgctgtcttcccattgaatattctataaatgaaactagtcaaataagttgattctggtcacttatatatttacctattttatcacgtttgttttgtcaatcacagtaagtgtcgaattcgctatctgttatagatgttagcctattttctatcccagatccattggttaaatctttggtgatgccttttagaaaactgatccctttaccctatgtaatatgccccttgattcctgaaagtcttatgtctaccttgtctgaatttaacatagctaagcacgctttcttttcgttcatattttcatggtccatgttttcctgtatttaacttttctatgtagagcaaatttctgtacagagctagtagttgggtcttgctttttaaatcaactataataattctattttaaaactggtattactatttttctgttaatttctgttttaatttggcattttatgatcatgtttatttctctattaacttattgtttagttcatcttttatgaatattgtattggccctaagatatacaataagaattgtgtataatcagattctaattcaaataacgtaaaacctcttcataggttgtagagctattataacttattcttctaaacactctttctcatccgttgtcttagtttattctcagtttgcacttatatgtgctataaaatataatatgtgcatttttatcattacatagacatatattagaacaattaaaaatataaaaactacatttcaacttcattttttcattcttgaccacatgttttatttggatagattcatgtttcggatgtatatcatatggctactcaccctggcagaaaatttgccaaagcacctactgaaggatgaatgcactagcaataaattttctcagaatcgatttgtcttacagggtattcatttgactttcgctttaaatgaaatttttaatatatatagaattccagtttgactttaatttgtaatttattttcttgtactcatgtattcattattttcttcctgaagatggtcacacattccattctgctgggccttcattatagatatttgtgtgtatctattcagggctatatttgcaatttatggatgccacaattatcagagttgaagtcagcttctgctgtccacagagatttcaagttcctcccatgatacttgcttttgtgtccctgtttgatcctgggtctttatatttagttttccccagggaggctgtctgtttcagctgtggaaagtgcaccctactgacagtttaaattgatgactgtgtggtgaaggaggttggacaaagcgggacttcctccaaccttctgactgagtctccttcttatgcaggagtagtaagcatagttctggggagtggccttccacattgtcctgtccttaactctttccccagggctggaacgtcttttcccagacacaactgtttttcaccagtgtccccagctttttacccactatccttaccctaaagagtaaggatttctttcctgaggaaggagatgggaggtgtttctggatcaagtttccttggtgtcgtctgtttccttttgtttctgttgacttcaccacagctcatatgacacatgctttggtggatttcccctggaggtagtggaggtgcattcaggcattccacaggagctgctgttcttttccccagtcaacaccacaagacaccagatgaggaagttgtccgtggatttttcaagttctctaggaaaagcttgcaagcactaggccaatctaacaccattagtacatgcatactaaaaaaaaaaaagtcattaagtatttctaggttagtctgtttctatctcaaatgccatccagtggcacctgccctacgtacactagcaggtaggtcctggttctctctgcaggctcctatcttctcagatttcagttttcttgtttgcttggtgaaatcaactcagatatgttgaatgttttttctctcttttatttgtagctgttcagcttcgttgttaatgaggtcagaataaaatcacagttttctcatttttttcacattcccacactgaatagctgctttccgtataaaagccagaaactgagagaacacattgaatatccattacaggtgaatgttaaacaatttgagatatgtttgtgtactggaataaaatgctgcattacaatcaagtcatcactcattcacataaaacatggccacattctcaaataatgtagggacctgagtgcccctccatctactggcctctcctggggccctagcctggccacaccttcttgcagggcagtcttggacgccctgggatcccgcaccaaaatttctgccctggcagaacatgcctgactggtggagagctccaatcgggcagccctcatgtgcacacaccagcttacacacttcctccgaatactgtaggttcacccaggcccacgtaacttcccacatcactttgcagtcacatgtctgtataggtgggttttgcttttcttgtcccaccattgcgtggagtgcagtcccctccccccaccccaaccaccatggcagaggaagctttggtggggaaaaagccagggccgctcctgtcagcgtcccgcacttgcgctaattctgcacagagaatagcagatcatctcacacattcagaaatcactcctgcttgtggggcatgaatacggcacccgggcctgtgcccacaagtgtcccatccctgagccaacacctcctccagtgtgaccttgaacacagtcaccaacagggccccacagacgcaatgcctctgccactgtggcgaacacctgcagggaggcaggcacccagacacccactagcactctgccacagctgccacacctccaacagcccaggacagtggattcctaaccttaaggagccggagaaccaagtcagggactagtataacttcccccagagtcagagcacacagtctaggtgttgggagctgagcactggccacctaaatttttccagaaatgaagccagttggctgaatccaccttataccacaatcaaaccctcaaggtcatccaatagggtaaaagaaaataaaaatgtatccaaaggtcagcaacttcaaagattgaaggtggataagcccacaaagatgagaaagaaccagtgcaaaagtcctgaaaacaaaaagggcgccctctttcctccaaacaaccacagcacctcttcaacagcagttctgaatggggctgagatggctgaaatgacagaaacagaactcagaatatggagagtgaaaatgtagatgaatacagctatttatggagaatactataaatgttcctcaaaaaataaagaaacaaaatctactgtagaatccagcagtctcactgctggctatgtatccaaaggaaatgaaatcaacatgtcaaagagatatctgcactccatgttcacgttcattgcagcattatttaaaatagtaaagatatggaaacatcctaaattcccatgaatggatgaatgaataaagaaaatgcatacagacacaacagagtaatgttcatccttaaataagaaggaaaccctgcctctgtgacagcatgcatgaatctagaggaccttatgccaagtgaaacaagccaggaacagaggaagagtcattcatgatttcactgtatatattaaagcagtagacttgcagaggtagagtagaatgttggttaccagggcctagaggggtggactgggaaagggagatgtgggttaaagtgcacaacgttccagttagaccggaggtataagttatgcctttctaatgcacagcatgtcaactatagctgataaggtagtatatatttcaaaattactaaaaaaataaacattagaatttccccactaagaaatgataaatttgtgaggtgatgaatataagcggcttgagttacccagttcataatgtatacatgtatcataactaaacaacatatgtcataaatatatgcaaaaattatttgtaatttataataaaataagtttcatatttaaataattacattaagaaaatgaacagaaactttcagatttcaagaatattttatatatatatatatatatcttaaaacaaacttgcaacagaatatagaaataagttttacgactcaatggaaaagaacagaattcaataaaaactggctaaaagaaacaacagctgcatcattatagaaaattctggaataatcagccatataaagattctcactctcttagaactagaattccgtaggacttgtaattcctcctgacctgggtgggaggcaaaaggaagaacagctaatggtgattcagtgagttttatacctgtgtgtacttctgtgctcactcagcagaaagaaaagaagaaaagaaagaaagagagaaagaaagaaacagaaagaaagaaagaaagaagaaagaaagaaagaaagaaagaaagaaagaaagaaagaaagaaagaaagagaaagaaagaagaaggaagaaggaaggaaagaaaagaaagaaagaaagagagagagggagagagggaaggaagggacagcagaagtcattgtggtgtgtgtgaaagcacaatccttgggctcccccacatccatctctactccagtcccatcaatgtccagcaaatacattttctaagatgaagtattttaaactttctaaatcctgctagaaaacccctcagctctttcagttttgctctatcacttgaattattgaattaaatctagtttttgtgggcctatcaataccataagccaaaataacacatgaagaaattgcactgagacacatgaaaaccttctgaaagctccataatttcagatctgcattcttatttccccgaacctaaatcactgaatagagactcagaacgagttgatcttgttcctgaacgtgcacagagccaaggacatcctgtctgtctggaacagctcaggtttgttcctgtttctcctagaggatataaaatcttgagttagggaaaaacagccagggacaccctgggctttgttcttctctcccctggaggcaggatgtccttcagagctttgtcccagtgggtaacacagctgctgaggtgtacaacccacgtggcctcgttttggtcacttttgcatggtgagcctgctttgcaccatggcctacaatatgcgtgtgtaactaatctgtctccatcttcaaaatgacattattccacatcaaatctagtgcaggtgcctcacacagaacattctcaattacctccatcattcataaaattgatgccattaatttcaagtatacatacatcagactcatttaacgtattgttattctcattgtttgaaacataacttttagatcaaataattaacaataataaaaatataaattttgaagtcaggtaatgtgatttctctagttgtgttctctttgctcagaatggcttgggctgttctgcatcttttgtttttccacatatattttaggattttttaaaaatttctgtgaagaatatcattgttgttttcatagggattgtactgagtctgtagattgctttaagtattatggacattttaacaatattgaatctttgaattcataaacatggaatattgttccatcttgtgtcctctttatttcctcaatgttttatagatttattgtagtttttttttactttgttcattacacattgtatgcctgtaccaaaacatcacatatacccaacaaatagaaatatatatactattatgtgcttataacaattaaaaattatgtatgtatattgaatctattcaaaatcagaaactatttctttttactgtttgtaaggtcttgtctctaggctataaaaagaatttgtaaaactcaacagaaagcataatataaacagaattctaaaatgagtgaaaatctgaacaaacacctcaccaagaaaaaatgttatctgaaaataagaatatataaaattgttcagtatcaattgtcataaactgatactcatatttaccaaatacaaaagtaaacatgatgtatttcaacagaattgattctcaaatatttgtatactcatacagtggaatactatcagtcataaaaactatgggttattaattcagaagacaacattttaacattttttctaagtgaaggaagatggacaaaagagactaagtattgtacaattccattcatgagacctgctaaatacagtaaaattaaaaggattttaaaaacaggtttgtgataggcagggcttttggggaaagacaagagactgacttggcaaagctcaggggatatttttagggtaaaacaaactgtgtgccattgtgatatgcctaatttcttattatatttgttcagagttaatagtgtacgtttcaaccaactcggtgattttatattttctatttgctgatagagacatgttcatttttgtcaatcactttgctaaatgtggctgagaggctgttgaaatgaacgctgagcaaatgtattcaccaaatctacaagagcaaattatttgccaattgctgattgagtggggtctataatgtatttgagattgggtgtggggatgttattgtgtgagatcatgatgtttagaccatgacactctctggtgagggatcactcattcattgcacatttaatgaaaggcaggtaggaggagcagaaggggatgagtcacactcctgaccacagccacaggttattgaaggcagaactgatgtaatcccctaaggtagaccactgcccctccaaggtgaccttatcctagagttgacacacatcctgggacaccagagacaactccttctctcccctttctctgcacttcagctggaagcaactgtctcaccgagcaccttgtgttaaggaatgagagttcctgttccaggtgtgagggcccaggtgcatccacttgatccagcacaagagcaagaacagccttccagaaaatgacatcgcctgaggtataaccagctctcacctgctgcagcttcctctgaataaaaaggaaactgttgaaacttcctcataagtgtcctgctgtgccattccctttgtccccacatgttcagttgtgtctgtccagatgtcacttttgtgtagggagattagggttctgcttccagtaccagaacacacatgacctcttaggggacttcagggttttgctgacatatgtgatgatcttaaaagtcattagctccatttctacatcaaaaaacatctgaaccaaaggagcacataggctcaggcctgtaatcccagcactttgggaagccaaggcagaggaatcacttgaggtcaggaatttgagaccagcctggtgaacatggtgaaaccccgtctctactaaaaaatatatacaaaaattagccaggcgtggtggcactagcctgtaatcccagctacttgaaaggctgaggcaggagaattgcttgaacccaggaggtggagattgaagtgagctgagatcgcaccacttcactccagcctgggcgacagagtgagcctccatctaaaaaaaaaaaaaatttatatatatatatatatatatatatatataataaatatatattatatatcatatatatattttatataatatatatgtatatttttatatattatacatacatatcaatatatgatatataatatgtatatataatatataatatgtatattcatatattatataatatgtatattgatatatattacacatatatattttgatatatatatatctccaaaccatctaaatatcaagtattttttaatccatctaagagctgaaattgctgaaaaaactactccctccaaaagctgtagagacaggcacatccacagtcacagcagagacttgctgacttggaagagaagctcctggagacacattggtgagaacatttacctggtgattatgctgaatgtctggaggacaaatgtggactagggggagggtgagcactcctagaggctgtacaccccacacttgtgtggacttgccctccagggccttcaggttctcgtggaagcaattaaaatagattccctatagccatgaactggggaggagtaatcacggagaaaagatgcacaaaaagacttttctagaaagctcatccaagggaaggtattctccaaaatcttagtttatgtgggggaaggaaatacttccaaattacagacccctcctcctcagccttcctctatcacgcaaatgataaaattagccaagaggagtcagattcaaggcggtagccctgggtgcagcatctgcagaagggaggaaagagagaaaatcagctgtatcactggagattccttgtgaaggtcactgctcaggagaagagggcaaccaaaccagggagagtcaactgtaagaacataccatgctcccctgccccacacattacctcctcaacagcatcattaatatggattaaagagggcagtgtgattgctttagatctgtttgagaaagaaagtcacatactgaggcctagggtcagggtcggcggcacttcccgtgagtaagatactacgaagaaggaaaaattaggggtccataactgtgaaaatcagccacagtgtgtgtgagaatgtttgtgtttgtgtttctgtgtgtttgagtaggagttattggaacagcggacgtggagtgagctttaatccacatccatctgcagcttcaggtattctcagatgcagtattcatctgcaagagccgaaatgagaaaagagccacctccaacccccccagagttttagcctccctttgtttccagtgatccagtgcatctagacctccaggaagtggactccctggtgattttagcgattcttctcttggagccaccctgaagaggacattgggtttccaaaggcccattcactatttcaagaagtggtgccatcagctcatgttgtcactgaaggagcattctgagccagggcacagtcacttcctagtgagctacagaggctgagagaaaaatgctctgtgagacccaatgggaagctccctgcagtgcaaggtctgggtggcagggagcgctagggcctcgcccagcacaggctgcagccctggagcaggtgcaagggaggctggggaggggttcctcccagggtctgatgtcttccttttctcggacaaacatgctttaataagttaaacaagactttagtaaagactattgatgtgtctttgtgtctttcagtatacagttctatttgtaggatttatctaacctaacaagtcaatgagaatcacatgtaaaaggagaaatttctaggattttcagatatcttaataggtaggagatggagaaaagggatggttttattaattcagtgcttgccaatcttaacagagacagtagtaagacatgcagaaagcaaagcccagaaaagtatgaaggtgtcaaagtgccatttaagtatgggttcacttggaggaccatgttctgcgggaacttgttttcagcagacaatctattttagcagagttctgggcatacaaggggacacacatcattaaacaaggattgggacagggacttcagcgtcccactgttgcatggcccataaattatgtgtgttctctttctcatcttggatcaagtctagagctatgaaatagtatccctcatgaatatgcaaataacctgagatttactgaagtaaatacagatctgtcctgtgccctgagagcatcacccagcaaccacatctgtcctctagagaatcccctgagagctccgttcctcaccatggactggacctggaggatcctcttcttggtggcagcagccacaggtaagaggctccctagtcccagtgatgagaaagagattgagtccagtccagggagatctcatccacttctgtgttctctccacaggagcccactcccaggtgcagctggtgcagtctggggctgaggtgaagaagcctggggcctcagtgaaggtctcctgcaaggcttctggatacaccttcaccggctactatatgcactgggtgcgacaggcccctggacaagggcttgagtggatgggatggatcaaccctaacagtggtggcacaaactatgcacagaagtttcagggcagggtcaccatgaccagggacacgtccatcagcacagcctacatggagctgagcaggctgagatctgacgacacggccgtgtattactgtgcgagagacacagtgtgaaaacccacatcctgagggtgtcagaaacccaagggaggaggcagctgtgctggggctgagaaatgaaagggattattatttttaatgttgtttacagtatgtcattaataaattgaaaaaaagtaacaatagaagtatatactctaattatatgggaactttgttttttcagttttttcatttttttttttttttttggtttgtttgtgacagagtctcactctgccacccaggctggagtgtaacggcacaatctcagctcactacaacctccacctcccaggttcaagcaattctcctgcctcggcctccagagtagttgggattacaggcacccgccaccatgcccggtgaatttttgtatttttagtagagacggggtttcaccatgttagctaggctggtctcaaactgctgatctcaggtgatctaccctcctcagcctcccaaagtcctgggattacaggcgtgagccactgcgcctggcccaattatatgggaattgtttatataattatcaccctataagcaaaattcatggaggaggaaaagctctactgaagaaagctgataccggcattcccatgaaagtatctgtgtagaagtaagtattaaaatcagttgaataggcaaggcatggtggctcacgcctataatcccagcactttgggagaccgaggcaggtggatcacaaggtaaggagttcaagatcagcctgcccaagatggtgaaaccccttctctactaaaaatacaaagaattagctgggcgtggtggtgggtgcctgtaatcgcagctattcgggaggctgaggcagagaattgcttgaacctgggaggtgaaggttgcagtgagccgagatcacgccactgcactccagcctgggcgacagagtgaaactccatctcaaaacaaaacaaaacaaaacaaaacaaaaaaacagttgaataaagtaccttagagtcatctgttcaattaacatgtttaactccaaagaaatactgaaaatattttccaaaaaggaagtgccattttacgttcctaccaacagtgaataagattttcttttctggagccttgtcagtattcactaatgctttgctgtgcagccgttgtaatattatagtaaatgagtagcagtatttaatggttgttttaaatatacatattcttaatacaaagtcttgatgaacacttttttatacattgttttatgaggtgtgtgttcagatctatgtatgccagaaatgcctggcagcgttaatttaagcacactgtgagaatgaccctatagtttatgaagaatgtatgttcagagctctgagctaagaaatccaggagctgtcaacccagaagtttattccttgtctgtgaaggacatctgaatccctggcctatcccttggaacacaggatgtccaggtgattgatgctctttgttaaatctggaggttgctaggtagagggtgctaagtgaaaatcataatataaactacacgtgttttacaaatggtagtggttttcctgtccaacacacttttcctgggccacattgtatgcaagtcctcaatacaccctaggtcttgttcatgggctccaggtctcctcttcagccttttggacatggtgccatgcctattacagtcaataggggtctagcatgacaactggtaggcccagaacaaggtcaaagaaaatcctgcaagctcttagacaacagtgtcaaggaaggggagacctgtggggaaatcccaggcaggccatgcacatctctgtgggcccaacagctgcaatccttgatggatggggcccgctgcatgtgtacggggatgcctccaaaatgccaaaagttctggaggacctgttgcctgaggtggatgtgacaatgtgacaaagtgacagtcagattcctgagctgtggcagctgttggccactcctgactgcactctgagcaaccactgaggcagagctcattgcacaggctagggtgtgtcagccacgagaacagttgtaactataatgagatgccgcctgtagggataggatagcaaattggagaccattgtttatttggtaggccatttaaagtgttgctgactgccacaccaatgcattaggactactatgactacgtcatcctgggagcctaagtcctggcgtccgatgtagagctccagtgggaaggagatgaaggttaggatgagtccataaaggttcttgctctgcagcccctgctttgctgtctcacttggtgaacagagaatgggaggtcaatgcggacaaagtccagggtccaggcttatcagtcaaatacttggtgtcatctggttacataagactatagttattccatatttcatcatagataagataagatgcaggtctactcatgtcccaccacaccaaagcagttggaaacctcccaaggcctcctgggacattggcgatcctttattccccatttcggcaaaccccttgggcccccatggcacttagacaagaaggtgccccactgcgactgttccaaaagggaggatgagggctctgaagaagctgaagtcacagtgaaatgaatacaaaccttgggagttctagtgcagggacagccctgtgaattggatgtagtcagttaccctgaggggtttaggtggggactgtgttaaaggcaaggacataagtgtgtgtccctaagaccctggtctcaaagacagaaggaagctgaagtgagatatactgtttaggagtagcaactgcactacatgtcatgccttacgagtgtaggatgtgacaaagagggccactccacatccggaacaacctttagcaggctggctaaaggatgccttccagacacaaaagccttggaatgccaggacacagtctgtagccaaatggtacttgtggtggtcaccaccaacataaaagtgggccaactgtgccagcagaagttagccccacagaactttcccccacctaagagaaggcagtgcaccacaatgcggaattccaccactgtggaattgggggagcttagaattggattcagacacaaggggagagagtggatcacagggtggcttctctatgggatagggggtggagagtattatactctctggactcaagatgagtaaaatgacacccatcacaaaccatccagccctatgatggcacctttatggtaagtggttgcaggctccaagggggccgggtccaatgaggaagatgcccccacagctcgttctcaatggcagactatagaagagttgcaggatatcttctgggagtcgagatgaggcatgctaattatgctgagaattattgaagtcccaacaatgaattgtttactgcaaaataaaagctacagttatgtattcagtgcctacccaatggcatggtgcactgatttccacgttaagccccctgggagggcagccaacatttcatgtgccccaggtagttgctgacttaggagaaaagaagaaactgagtaagcaagggatgcaccctactgtgatgaagaacaatggcaccaaaggaagagagacagccaaggagccagtcagggtggccagacaacgaatgtgctctaactggcaacacctaccagttctctgggcccatagcggcaataggtggttatggaagggccacggaagtcagaccggttgaactagtgatacgacctgggggactgccacccagaccctgtgtagtatacacagcttccatcctagaacacatgagaatggatatcttcttaggcgtgaccctccaaacaacggccagggaattccaacggagagttagagtggtgatatgtgtgaccaagcagaaggcaaactggatgccagtagagctgccaacccatggggagtcccacagctggagcaacaccacccgccctgggaggggaagatgatccaatcatgaagattgttaaggagctagcccaggtaggcattaggaggccactgcatggttcctacaacagacctgcatggcccatgcagaggccagttgagacatggagaatgacagtagattactgggagttaaataaggtggtctcccgagtgaatgcagctgttcctaatatctcctccagtctgacgagaataggagaggtgttagccacgtagcatttccttatcagtttagtcaataccttcttcagcatttctgttgccccagagtcaagatcaatttgcattaacctaaaaagaacaatggacttttactgtcttgttccagggatatttacacagcccaaatctcacagcctagtgacctccaacctcagtcgatgggctgacccaaaggggatacatgttttccactacattggtgttatcatgataacctctgagtcttttttcagcttataaattacagcccctgtcttgctgtctcacttgctgaatagaggatgggaggttaatacagacaaaatccagggtccaggcttatcagtcaaatagttggtgtcatctggttgggtaaaactaaagtcattccatctgccatcatagataaggtgcaggcctacccacgtcccaccacaacaaagcagctgcaaactctcaaggccttctggagcatcagtgtccttttattccttttatttgacatccctgaaggaggctgctaggggagactgtgtccctcctaaattcatgtgctgaagtcccaacccttggtccttcagaatgaaatcatacttggattagtgtcctttaaagaggtgaataagttaaagtgagattcctggagtggggccctaatgcaatctgactgttgttataagaagaggaagcaggagggagggtgcacaggccccgagggacggccatgttaccacagaacagtgagaaggcgccatctgcatgccagggagcgagacctcagaggaaacccacccagctggcagcttgatcttaggctttcatcctccataagtgtgaggaaattggttttgtattgtaagccatccgatctgtggtatttcgttataaaagccctataaaatgaatacagtaggtaataggagagcttctatacattgaaaaagtcggatggccagaaaaacctagacactcctgttcagacctgagcagggtgatggacctgctttgggacaggagaggggaagagatgaacccagcacccagacccagctgagcccattcctcagcaggccgtccctgggccggagcttgcacaggtgtgaaagagcctgtcttggtcttcaggggctcatggagttggacggagaatggtgtagactcaagaacacgtcatcggtgtgcccgtgtttatctgaatgggatgtgtttctagggtgtgctcatccccaaagaagaattaatcaggtctcttgggctaaaaagaggttgtggcatttgtgtgtattaataactgtggtcggacagtaaattatgttaaactgcttatgggaaggcacaatggaaagaaacactttgttacagaaggaaaaaaaaggtgattatttaaatgaggtgcctttgaaggtcaccatgccaagaggagcccatcacatgatagtgctggctttcatgttcaggagatcaggagggtccgtccgctggcttttatgacaccctagacagagctgagagtgtaatgtatgaatggaggggaagtggagagaggggaggccaaatgtttggtgggaatggagggtcactattggagccattaggaaatacacaagcatgaattatgctggaggacagaacagtgttcctggggaatattgtgttgctttgggagctgctgaacatacaggagtttcactgttcctagttctcaaattctctagactctctggacaacccagttttaaatattgggaatataggtaagacacattcgttattaaaaattattaagagaagatgtaggaagaaatttaaagtaatccatttggttatgaaaatttagttacagcgaactgtgatgtccgtttcttacttggaataatggaatgtaagtcattagtcatctcaacggttcatttttccataaccatcaattacaaaactgctgagtaatttcctgaattgcccaccatagaaactgacctcacatttcctcaatgagaaactgccagtcccgttgatccagcctcgttcttcccatcagggattttgtatctctgtggacgtgtggcacagtgctgcatatccatcggcatatggcctcaggaaaggcgccagcctatccatgcatgatgaagcttacttaggggatgaagcccgcatgctgggtgagccagtgccaacagctgaaagaatcaactgcctggtgtatgatgcttttatgaaaacaagcccagggcctcttgcattcttctgtattagattctctggtgaagatttttattcatttctgcctgaaattgccacatataattacctggaagcattacaataaactgatttggaagttaactgacttcctggtgaggttaaaatgagtgtcaggtgcatagtgagacagaccggagacatggatgcatagcaaacttgtgctcaccatggtttctatcttagttagggaaacttctgtaccttccttagatgttcaggcactccattgaggaccctggcataacattatttattgacagaccatagctcaaagtatagaactggatactaccaaggaggatatactattactattttatctttatcttaaaatatactcttccatctgaggtgaaaattaatccagatggtagaacttattgcagttactacagcattttagcaaatcaaaagccgcagaacaaacatatggacagatggcaggtatgttttcggaatcgtaaacaagttcgtgatgactgtaaaaccaaggggtgtctcacgagggctggaaacctctcacaatgaaacaacacaatgaggatctttgaaaagtactctgacctcctggtgagctggctgatatggaggctgagctccatgtagaaagccaaaggaatttctgcaggacgtcatcatgccaagcacagccgtaacctgggtcccagcccttttcacacgctcaatggttagatcttgggagggaatcaaagaagccatagtaaaatatcaaaatttaaaccccgattttgaatttaaaaagtgttaaaatatggttgtggcctacactcagaaaatctgtgtccttcagatggtttctcagtggcaccagatggtttcaagtggctattcattaagtttctcagtgaaattaccagacatagaataaataaattgtcactgtcttaaatcaacccatgggaaaggaaaactgtgtaaatacagcagagaggaaacattgctcaagggaaaaacaatctccagaaagtattgttaaagaaacagaggccctctttccagccagcgccgagcgatgggcacctctcgggacaactggcacaagggccgcaaagctgggggcaagagaaggccctgccacaagaagcggaagtatgagttggggcgcccagctgccaacagcaagactgacccgtgccgcatccacacagtccgtgtgcgaggaggtaacaagaaatactgtgccccgaggctggacgtggggaatttctcctggggctcagaatgctgcgctggtgaaacaagggtcatcgatgttgtctacaatgcatccaataacgagctggttcgtaccaagaccgtggtgaagaattgcatcgtgcccatcgacagcacgccctaccgacagtggtacgagtcccactgtgcactgcccctgggccgcaagaagggagccaagctgactcctgaggaagaagagattttaaacaaaaaacgatctaaaaaaattcagaagaaatatgatgaaaggaagaagaatgccaaaatgagcagtctcctgggggagcagttccagcagggcaagcttcttgcgtgcatggcttcaaggccgggacagtgtggccgagcagatggctatgtgctagagggcaaagagttggagttctatcttaggaaaatcaaggcccagaaaggcaaataaatccttgttttgtcttcacccatgtaataaaggtgtttattgttttgttcccaaaaaaaaaaaagaaagaaaaagaaacagaggcatcacacttactagaaaaacatattctatttcatatattatggggatatgacgtgatgttttgacatatgcgggcattgtgaaattattaaatcaagtaaataaacatgtccatcacctcacatacttattttttatggtgtaaacgtgtaaaatctactctcttatcagttttcaagtatatagtacattagtatcatggaagtcaccatgctgtgcaatagatcttcaaacgaattccttctatctaaccaaaactctgtaccctttcaccaacgtctcagctttcacatgcccctgacgccagcccctggtaggcaccattctactctctactctgagttcaacatttttagattgcatgtgtaagtgagatcatggagtaattttttatacctggcttatttcactcaacataaagagtcaaatgctcaacatcactaatcatcagggaaatgcaaattaaaaccacgataagatatcacctcacacatgttacaatggcttagtctcagtctgtctttttgttactataaccgaataccagagactgggcaatttctaaagaaaaggaatttatgctttatggtgcttgagtcagagaagtctaatatcaaggcactggcatctcacaagggccttctcactgcctcatctcacagcagaggtgggtgagcaagagaccatttgtccacgagagaaaagagaccatcttttattagaaattcactcctataataactaacccactccattgatagtgacagtaatccattcatgaggacagagccttcatgacttgatcacataataaaggtcccacctctcaacactgttgcattaaagattatttccagatcctaaactttgggagacacatttaaaccatagcattccattcctaatatcaaaatttatgtccttatcacaatgcaaattacattcattccatcccaattgtctccaaagtcttatccagcatcagtgcaaaagtctgaagtccaaagtctcatctaaatcagatatgagtgtgactcgaggcacaatttagcctgatataaattgtttccatctgcgagcctataaagtcaaaacaagttatctactttcaaatacagtgaacaatggggcaggtatgggatagaaattcccattccaaagctcagagagaggcaaggagaaagcggtgcctagttcaaaacccaacagggaaaaaaacattaagtcttatagctggaaaatcatcctctttaacggcatcttgtgcacactggggagggggatgggcccccaaggcctccggcagtcttgcctctatatattttctgggttcagtccactcagccgctctcacaggtgggactctcaggcctctagctctcctaggctgactggaaactctttgtggtacctccaaacccacatttctgcttggcattgtgctaagggcccagtgtggtgactctgtctctgcaacaagtcactgcccgagaccttaggctgtccttaggctgcccgagaccttaggccgtccacagcattctttgaaatctaggtggagaaagccatgccctcgtggttcttgtattctgcacacctgcagaattaacaacacatggatgccatggaagttgatgacttgtaccattaaagtgatggcttgagccacacctaggtcctcctgagccacagcatgggcagccaaggagtgctgtgcctggacaccgggaacagagtcctaaagtgcctgctagaagtcaggccatagatttccttcaaatttctcccaccatataacctcgttcatggctctgaacttccaccttacagaaggacctagggatgaacacaattcagccacgttctttgccactttatggcaaggatggcctttgctccattttccgatgagctattcttctttttctcctgagacctcatcagaacggcctttattgtccacggttctactgacattctaatggtcatcacctaaataatctctaagaagtttcagaatttcctcacagctctcttcttctgagtcctcaaaagaatcacctctagtgttctattcagggcaatccagactttttatagtctgatcctccaaattattccagtctttgtgcattactacatccacttctacattttggggtatttgttatcgcaacagccccacctcttgatactgatttttcgtcttagtccactttgtggtgcaatgagtgaataccacacactggctaaagtataaggaaaagaaatttattttctcgcagctctagaggctgggaagtcaatatcaaggtgttagcatctggcaagagccttcttgctgtgatgtccatgtggaaggcaggagagcaggtgcgaaggatggaaaggggtttaaactcattttttaatgaggaacccaggcctgtagtaactaatctgctaccacaatgagtaacctactctgacgataatggcattcattgcttcatgagggcagagccctcatgacctaatcatttcttaacattcccacctctggacactatggaatttgggattaagtttccaatacacatcctttctaaacagcaggggctttttaataggttgaccacccaaggctgcaggaggctctgaagcagtggcctgaggttggctgtcctttgtgagaatggagagaagtgaactgactcatggagacacaagtagatgaggtaaaggcattcattgcttcattacatggatggtgaggtcgattgaaggcattaacggattaaagatggtggcaaaaccgtctgaggtggagaccacggggagtccatcagaaatggaggacacgtcccaataaatggtgcttcatttccctgcaaagcagaagaaagcaaagaacaaaacacaacatcatagtgtacactgagcagtggattgagagaagagtttcctaaggcataactgacagagtggagaagacacacaaatctttgcatgatgctaacatttggactgtggcttcattatttcttattaatattttactgaaatatcgctagaaggagactgaaaatgaagtgtgaaaagttaaatgggatttctgctctatgtccttttcagatgagaggaactagggaattccagggaagaaacaataatagctgctgagcaaggcttttgcagggcaggacaaggaatccccaaagagaaaacggaaacctcagcttcactttgcatctgctcctgagccaggtcctgagcgacccctgtaggtcctgagtgcccctccgtaggttctgagcatcccttggttgctgggcgccctctggtggtgtctgagcccctctggtggtttctgagccccccgccttatgtctgatcctccctggtggtgtccgagtgcccctgctagtgtctgagccccctggtggtgtctgagtccccttcttagtgtctgagccaccctattagtgtctgaggacccctgatggtgtctgagcccccagttagtgtctgagccaccctattagtgtctgagcccccctggtggtgtctgagcacaggagagctcctctgaaggaagggtctacatggggacaggcgtgcttgtctcagggaagggtccatgtggggacaggtgtgcttgtctgaaggaaggttccacatggagacaggtgtgcttgtctcagggaagggtccacatggggacaggtgagcctgtctgaggggacagaagtgcttgtctcaaggaagggtcctcatgtggacaggtgagctcttttgagggaagggttgacctggggacaggcatgcttgtctgaggtaagggtcctcctggggacaggtgtgcttctctcagggaagggtccacgtggggacagaggtgcttgtctaaggcaagaatccaagtagggacaggtgagctcgtctcagggaagggtccaggtggggacagttgtgctcatctgagagaagcgttgaagtggggacaggtgtgcttgtctcaaggaagggtccatgtggggacaggtgtgctagtatcaagaaagggtccacatagggacaggtgtgcttctctcagggaagggtgcatgtggggacaggtgtgcacatcggagagaatggtccacctggggacaggtgttcttgcctcagggaagagtccaccttctcagggaagaagtgtgctcctctgagggaagggtgcacatggggacaggtgtgcttgtctcagggaagggtccatgtgggaacaggtgagctcatctgagggaagagtccacgtggggacaggtgagctcatctgagggaagggtccacatggggacaagtgacctcgtctgagggaagggtccacgtggggacaggtgagctcgtctgaaggaagggtccacttggggaccggtgtgctcctctgagggaagggtccacgtggggacaggtgtgctcctctggagggaagggtccacgtggggacaggtgagttcatctgaaggaagggtccacatggggacagttatgctcctctgagggaagggtccatgtggggacaggtgtgcttgtctcagggaaaggtccacgtggggacaggtgtgctcaccttggggaagaggacagatgagctcatctcagggaaggggccatgtggggacaggaccaagggttgggacttcagcacaagaatttaggaggaacacagtcttccctagcagcctccttcagggatgtcaaatattttccttctgttccctgtgaaagccttaaaggggtagggaaagggcgttcaacctgcacactcgtagaggggaaaccagcttcattagtaatcgttcatctgtggtaaaaaggcaggatttgaagcgatggaagatgggagtacggggcgttggaagacaaagtgccacacagcgcagccttcgaaacacaccacggtcacgttaagtttaaatggagtgaccacattcgccaggaaagggaaatatttacacttttgaagaaacagtaatttgtgtttctgattatgatctggccttggattttccctcccctcataagcaatgacagaattggcagaaatatgtgaaacgttagttctcagacatgagacacccacagagggccccctgtgcccttccctgagagctgatcagctcctgcatctgaagaaatgaccaaagaccaggagagaaccacacagaagcatcggagggacagcacctggggctctgatggggtcaggaatagcatctgttcccaatagatggactaagtaaaaagtatcataattcacaagagttttacatagcacagaagaaaaagttaccctatatcaactgttgatcttgtgaatccaggaactctggattcaaggtggtcgggcacatcttgatttacgcatttcagggacacatgagacatcagtcaatataagtaagaaggacattagttccatccagaaaggctgagacaactcaaagcaagtcctccccacttagggcttccaggtcacaggtaggtgagagacagatggttgcattcttttgagtttctgataagtgtttgcaaaggaggccatgaggatatgcacctgtctctgtgagcagagggacaactttaaatagactgggaggcagatttgtcctgagtggtttccagcttgacggggcccaagatattttcctttcacaatctggtaacttcaaacaaaacttcaaagccacaacaaaacaacacaacaacaaaaagaataagacatgggtacttattaagagtagaaaaacattcagtccccaaggaaaatattggcagtgtctacctccacatgacaaaggagtaagcagtgtgagccacagaaaggagcactattaacccacagagcaaccgagaataacacgggtgatgcgagggcattggacgcacatcattgcattttgtagattcagaaagaaacggaaaagattgacggtggtaaaagagacagccctgcttccctctcccttttccctccccgatgaggcctcacagccatgaccctcagcctcatcccgcagtgcagcagctgccgtcctgtccaggcccaccccctgccccgccctgggactgttacctcattccctcccggagtccaggtgccccccggggtgtggtgcgggagcctggggaggccctttgttctctgtcagggtctccctgggagggacgcagccaccgcagctggttggggcctggcttcgcccaggacagtcctttcctttcccattgtctttggatgactatcgctgggctgggacatgaggcgggcagaggcgcgggtcacccttaggacccccctcttgctgctggggctctgggcgctcctggctccggtccggtgttctcaaggccgtcccttgtggcactatgcctcctccgaggtggtgattcccaggaaggagacacaccatagcaaaggccttcagtttcccggctggctgtcctacagcctgtgttttggggtcaaagacacgtcattcacatgcggaggaaacaccttctttggcctagacatctgctggtgacaactcaggatgaccaaggagtcttgcagatgggtgacccctacatccctccagactgctagtacctcggctacctggaggaggtgcctctgtccatggtcaccgtcgacacgtgctatggggacctcagaggcatcatgaggctggacgaccttgcgtacgaaatcaaacccctccaggattcccgcaggtttgaacatgttgtttttcagatagtggccgagcccaacgcaacagggcccacatttagagatgatgacaatgagacagaccccctgttctctgaagcaaatgacagcatgaatcccaggatatctaattcgctgtatagttctcatagaggcaatataaaaggccacgttcaatgttccaattcatattatcgcatatatggcaatattacaacttgttccaaagaggtggtccagatgttcagtctcattgacagcattgctcaaaatattgatctgcggtactatatttatcttttgaccatatataataatcgtgacccagcccctgtgaatgaatatcgaattcagagtgcaatgtttacctattttaaaacaactttttttgatacttttcatgttcattcatccacactacttattaaatacgtgccacatgaatctaactatgaacctgaaaggtataacttctgttcccgtatagccctgttacacattggtactccaggcagacattatttattggtagccgtcataataacccagacacagatgagaagtattggtctggagtatgatgataactactgcacatgtcagagaagggcctcctgcattatgcagcgatttcctgggatgacagatgcgttcagtaactgttcttatggacatgcacaaaattgttttatacattcaggccggtgtgtttttgaaacacttgctcctgtgtataacgaaaccatgacaacggttcgctgtggaaacctcatagtggaggggagggaggaatgtgactgtggctccttcaagcagtgttatgccagttattgctgccaaagtgactgtcacttaacaccggggagcatctgccatataggagagtgctgtacaaactgcagcttctccccaccagggactctctgcagacctatccaaaatatatgtgaccttccagagtactgtcacgggaccaccgtgacatgtcccgcaaacgtttatatgcaagatggaaccccgtgcactgaagaaggctactgctatcgtgggaactgcactgatcgcaatgtgctctgcaaggcgatctttggtgtcagtgctgaggatgctcccgaggtctgctatgacataaatcttgaaagctaccgatttggacattgtattagacaacaaacatatctcagctaccaggcttgtgcaggaatagataagttttgtggaagactgcagtgtaccaatgtgacccatcttccccggctgcaggaacgtgtttcattccatcactcagtgagaggagggtttcagtgttttggactggatgaacaccatgcaacagacacgactgatgttgggcgtgtgatagatggcactccttgtgttcatggaaacttctgtaataacacccagtgcaatgtgactatcacttcactgggctacaactgccaccctcagaagtgcggtcatagaggagtctgcaacaacagaaggaactgccattgccatataggctgggatcctccactgtgcctaagaagaggtgctggtgggagtgtcaacagcgggccacctccaaaaagaacacgttccgtcaaacaaagccagcaatcagtgatgtatctgagagtggtctttggtcgtatttacgccttcataattgcactgctctttgggacagccaaaaatgtgcgaactatcaggaccaccaccgttaaggaagggacagttactaaccctgaataacactaattcagcctcccgatccctgtaaagatacagagaatataacagcaaaatctatgaaacaggatcaggggaagggatggcaaagctcaagtccacatttcttgaagtccacaggaagcacagggtcctgtttcacatcacagggaaacgggaggcattggcttctgtcccaggttcttgtaggtcgctgatgctcactctgaaataaatcttcaaaaacacacattggtgccttccacattttcttagactcctctgggagcccaaacttggccagaacctcttgcctggagagacatgaatgagcatctggctcttgtcctgaggtctctggtcccagaattaacggaagttgccaccagctccttacagggaacattcatgacatttctccagaagagagctccagagcaatgagcttcctcattccccaggtaatctgtccttctctaaacccgaagtcagtttagggtgatccagggctactccctgttccctgtctgttcctcacgggggtgctgtgggctttgcagtgagagggacttgggttcaaatcccccaccaagcaaatccccctacctggggccgagcttcccgtatgtgggaaaatgaatccctgaggtcgattgctgcatgcaatgaaattcaactagaaaaataggtagacgtgaggggcaagctgtctgtcatttagtgtgagctctgtgagtggcagctgccccctttcttcctgcccccacatttccttgaactgaaacaggaagggaagctgagtaagtcgtgatgaggaagagaaaccaggcttgtagcagcacaggctggtccgggtggaaaacagggctaggtgtatcactgagttattgtaaaggaaaatggaagttaaatgtataaataactgaatgagataacattttattttaacttaaaattcacactaatattgacttttaaaatgcagtgtagatatgtcagagagaatttcaaaggcaaagcccaccgacggaagaaatcacccttcccataccatccacagaaaactgttggtattctagggtagtactgagatctagcatttttctgaatacatctgtggttctagatgtcctgcttccatagatattgtttagaattcccacccctttctccaaacacagcttgatatcctttctctgaacctgttagaaatttcctccattcagctgtcataaagatgcgagcaatccattcctgtgcctctgtcagtgtgttctattattttgtggctgaacgctaatggacagttaagtgtgaggtcagtgaatacagtgccctccctctatgtgtccttcgggtgtgaggggttttgctgatagagcagcaggccccatcccaccctttatgcatctccgccccccacctcacgctccagctgacctctcccctgtggcctggggcgttccccagggggaatgacctctcctctctccagggcccacccactcagtgcccgtgcaagaccaccacgcttggcacggccccacctcgtgtcagggcctgtgtcccctgccccaccccctaaacagatgggaaccactgggactctgctcagggcagggggcggaggtatgtgtgaaaggaaggcaaatgtgcactctgttggagaaatattataggtagtttgagcaaaaaatctaatgccatgggaacttttagaatgatacgtattttaacaaagaacatgaccaatagagtttgtattgaagccaggaaaacactatttagagcaacagcaatatcaaaaacacaagccaacagttcaccaagaaaaaccaccattaaccccatggaaatggtcttccaagagcatcggcacttaaatcctggaaatctgcctgcctcagcacctgttgtcctgacctgccctcctgtgtgtcctaatcactcccaaacacggggcctgcactgtgggagattcacactgtgccaggtggagggagcaggacaactgctaacaggttgttggtgtggatgccgaggccacccaagcaggtgtaaactcccacctgtggggcagggaagagtgcacgggagacatgtcccgggcatagggtgagggagagctgtgggggctctgggttctgaagtgggttctgaagagggttctggcctggcagggataagaccaaccagcatgtgaggccaggctggagtctggacctctgaagctgcaagggtcatgggctgcttggccccaggggctgtcctggttctctatggagtactttcaaacattctttcttcttccaatccccctccttctctcccaaagcctgcatctcccaaatcctctttgtcggatcctcggcttcactctgcatccgtcctgagcatcgatcttccaattccatcctcttctcttctgctatgtctaagctgctgtgaagccacctgctgtaatttactgctttatatttaatattgtaccgtacatctgttctgtttccctcatcataaatgcttcatttcatgctcagcatctgagaacacaaggccttgtcagctgtcacctccttccgttctctgtttccttcctcctatccccatattgctcatcatgtccagtctcctgccatcctgaatgcttctgatggaaggtctgagatgtctcatgagcactgtgaagattctttgtaatgtgagcttgttccaggcaggaattctccttcacccagccctggaagccaagtataggcagatggccatgctcaatcaaagactgagctaacttaacagtggctttggttttaaggtttctccaatccccagggcacaggatttcagggaattcaggtgagagtctgggtgttacccttcaggaggctgtaaactccatttcacctagtctacaccacagactatggaaactatatatatatatagttctgtccctctagagaaacctaatatgtatatatacaatatataatacgtattatatattatatataatacgtattatatattatatatattatatatatattagagtttattgaggagtattaaactcacaatcacaaggtcccacagtaggccatctgcaagctgaggagcaaggaagccagtccgagtcccaaagctgaagaatttgaagtctgatgttcgacggcaggaagcatccagcacaggagaaagatgtaggctgggaggctaagccagtctagtcttttcacgtttttctgcctgctttatatcctggccacactggcagctgattagatggtgcccacctagattaagggtgggtctgcctttcccagtttactggctcaaatgttaatctcctttggcaacaccctcacagacacacccaggatcaatactttgcatgcttcaatccaatcaagttgacactcagtatcaaccatcacaagtccaccccttgtcaacttgaacccatacaaatctcctgagatcatacataatcttcaaataaagacaataataaggtcataattacacctaatgtaatacaactatcttttgtacaaccagaaatgcaccaatccccaacccaaatgctattatgtaaagttaagaacacttaaatgctgatatgaagtcaataaattttatgtcacatgataaaggaaaaaagaaatgaaggaattttcttagtacaagtgtgtacatgcacaaacatgtttttaacaaaagaagaaggaaatactgatgacaattacagtcctcatttctgcaactgatcacgtggttgtagctggtattgatgactaccttcttctactacccattctgtattccctttgccttcagcaagcatcacagcaggtagagttttttctcctagtggagtgatgcaaaccttcattcctgaagggtctgggccatttgtagtcctgcctggattgggctgttgtagtttcccgttgaccttaatgacagggcatggtaatgttaagagacgccctaatggatctcctgtattccatacatattcttccttacctccattgtggagtaatagactgattgcatcttgatagtccaggtcaatcagcccagccaacactgtaactcccctcttagcctgtggacttaaaggtaggaggggcccaaagtggccaggtggaaatctttacttccagtttaatggaattgttgttgtttctcctgatggcagcattattcccactggaactaagacctctaggccaacagaatgtaatgtcatgggaccaggaagcaaaaattttgctagtggatcactaggggtgatggtgaatggtgccatttccacttccaccccttgattcctggatccatgaattatggctatgggagaaagagtaccatatattggatgctgatttggagcatacatggccttttggagagctttgccccagccctgcaaagtattggagcctagttgacattgtaattgtgactttgaaaggccattccattcttctatcaatccagctgcttcaggatgatggggaaaatggtaagacaagtgaatcccatgagcatgagcccactgccacacttctttagccgtaaagggagtgccttggtcagaggcaatgctatgtggaatactgtgacagtggataaggcattccatgactccacagatggtagtcttggcagaagcattgcatgcatatctgcagtaagtgtctatttcagtgaggacaaacctctgccctttccaggatggaagaggtccaatataatccaacctgccatcaggtagctcactgatcaccctgaggaatggtgtcatttgggtagagacccagagccaaaccagatcacgccacccaacccctcccaaatctcatgtcctctttgcatttcaaaaccaatcatgccttcccaacagtcccccaacatcttaactcatttcagtattaactcaaaagtccaaatccaaagtcacattggagacaaggcaagtccctttcatctatgaacctgtaaaatgaaaaacaagtcagttacttccaagacaaaatgggggtacaggcattagatacatgctcccatttcagttgggagaaatgagccagaataaaggggcttcaggtcacatgcaagcccaaactccagtggggcagtcattaaatcttaaagcttcaaaataatctcctttgactccattcctcacattcagggcatgcttatgcaaagtgggggctcctacaaccttgggaagctctcaccctgtggctttgcagctctgaccccatggctgctctcatgggctttgcagagttcagccctcctggctgctctcattgagtgcatgcagcttttccaggtgcacagtgcaagccgttaatggatctaccattctggggtctgaaagatggtggccctcttctcacagccccattagtcactgtctccagtggggactctgtgtgggggctccaaccccacatttcccttctgcactgccctagcagaggctctccatgaaggctttgcccctggcgcagacttctggctggacatccagtcatttctataaatcctctgagatctgggtggaggatcacaaagctgaactcttctcttccgcacatccctaggcccaacatcatgtagaagccaccaatgattggggctttctgaagcaatggcctgagctgtacattggacttttttagccacagctagacctggagcagctgggacacagggcaccaagtcccaaggctccaaagagaagctgggccctggacccagcccatgaaaacatttttccctgataggcctccaggcctgtgattggaagggctgctgcaaagatctccgacatgccctggaaacattttccccattgtcttgattattaatattcatctcttcattacttatgcaaatttctgcagccaacttgaatttctccctagcaaatgtgtttttctttactaccacatggccaggctgcaaattttccaaacttttatgctctgtttcccttttaaaaataagttcctatttcagatcatctctctcaagggcaaagttccacagatttctagggcagggacaaaattccatcaagcttggttttatacattttagagaggcatgagacatcaatcaaatacatttaagagacacattggtttggtccagaaaggtggaacaactcaaagctagggcttccaggctataggtgaatttaaatattttctggttgacaattggttgagtttgtctaaagacctgggatagatagaaaggtaatgttcaggttaagataaagattgtagagtccaaagttcttttgaagtcttatagtggctgcccttagagataataggtgacaaatgtttcctattcaaatcttagttgaactctttaggattgggaggttctagaagaaaaagatctagctatgttaatagagattctttacagatgcaaattttcccccacaaagaacagctttgcagggccctttctttctttctttctttctttctttctttctttctttctttctttctttctttctttcttttttagatggagttttgctcttgttgcccaggctagagtataatggcacgatcttgtctcaccacaacctccacctcctgggttcaagtaattctcctgcctcagtctcccgagtagctatgattacaggcatgcaccaccacacccggctaattctgtatttttagtagacacagggtttctccatgttggtgaggctggtctcgaactcccaacctcaggtgatccgcccacctcagcctcccaaagtgctgggattacaggcatgagccaccatgcccggcctgcagggccatctcagagtatggcaaagaaacatgttttggggtaaaatattttgattttcttatttgtctcataatgttatgccagagtcagtttggaaagtaaatcatgatatataggtttaaataaaacccatctgatgagaatttatgatttgtagagcatgcctccccagactctttagataggaatttgggcaagatgaaaaaaaaatcagagtttagtcctcactacctaagaccagctcagcttggacttcactgttcatgtcactatcagcattttagtcaaaaccactcaataagtctctaggaagttccaaactttcccacatcttcccttctcctttcaagttctccaaactgttccaaccgctgccaggaggtacccagttccaaagttgcttccagattttgagttatctttatagcagttccccactcctggtaccaatttactatattagtctgtttccacagtgctataaagaactgcccgaaagtggttaatttgtaaagaaaagaggtttaattgactcacagtgctgtgtggttagggtcggaggctcaggaaacttgcaatcatggtggaagtggaagcaggcatgtgacacatggcagcaggtgagagagagaaagagagagagagggaatgaaggaggaaccaccatacatggataaaaccatcagatctcatgagaactcactcactatcaggagaacatgaggacagcatgggggaaaccacccctatgacccagtcacctcccaccaggtccaccccttgacacataaggattactatttgagatgagatttgtttaatgacacagagccaaaccacatcagcatgtgacaaaggtctaatatcaagaatctatgagggggcagttccaaaatggctgaataggaacagctccagtctacagctcccagcatgagctacacagaagacaggtgatttctgcatttccaactgaggtactgggttcatctcacgggggcttgttggacagtgggggcaggacagtgggtgcagcccaccaagagtgagctgaagcagggcgaggcattgcctaacccaggaagtgcaaggggtcagggaattcccgttcctagccaagggaagcggtgatggacggcacctggaaaatccggtcactcccaccctaatactgcacttttccaacggtcttagcaaatggcacaccaggagattatatcctatgcctggcttggaggttcccatgcccacggaacctcgcttattgctagcacagcagtctgagatcaaactgcaaggtggcagtgaggctgggggaggggtgcccacaattgctgaggcttgagtaagtaaacaaagtggctgggaagctcaaactgggtggagtccactgcagctcaaggagacctgtctgcctctgtagactccacctctgggggcagggcatagctgaacaaaaggcagcagaaacctctgcagacttaaatgtccctgtctgacagctttgaagagagtagtgtttctcccacatggactttgagatctgagaatggacagactgcctcctcaagtgggtccctgacccccgagtagcctaactgggaggcaccctccagtaggggcagactgacaccttacacggctgggtgcccctctgagatgaagcttccagaggaattatcaggcagcaacatttgctgttcagcaatattcgctgttctgcagcctctgctgctgatacccaggaaaatagggtctgcagtagacctccagcaaactccaacagacctgcagctgagggtcctgactgtcagaaggaaaactaacaaacagaaaggacatccacatgaaaaccccatctgtacatcaccattatcaaagacaaaaggtagataaaaccacaaagatggggaaaaaacagggcagaaaagctgaaaattctaaaaatcaaagtgcctctccccctccaaaggaatgcagctcctcgccagcaatggaacaaagctggatggagaatgactttgatgagttgagagaaggtttcagatgatcaaacttctccgagctaaaggaggaagttggaacccattgcaaagaagctaaaaaccttgaaaaaagatcagatgagtagctaactagaataatcagtgtagagaagtccttaaatgacctgatggagctgaaaaccatggtatgagaactacgtgatgaatgcacaagcttcagtagccgattcgatcaactggaagaaagggtatcagtgattgaagatcaaatgaaagaaatgaagggagaagagaagtttagaggaaaaaaaagtaaaaagaaagaaacaaaccctccaagaaatatcagactatgtgaaaagaccaaatctatgtctgattggtgcacctgaaagtgacagggagaatggaaccaagttggaaaacaccctgcagtatattatccagcagaacttccccaacctagcaagacaggccaacattcaaattcaggaaatacagagaaccccacaaagatactcctcgagaagagcaactccaagacacataattgttagattcaccaaagttgaaatgaaggaaaaaatattaagggcagccagagagaaaggtcgggttaccctcaaagggaagcccatcagactaacagctgatctctcagcagaaactctacaagccagaagagagtgggggccaatattcaacattcttaaagaaaagaaatttcaacccagaatttcatatccatccaaactaagcttcataagtgaaggagaaataaaatcctttacagacaaacaaatgctgatagattttgtcatcaccaggcctgccctacaggagctcctgaaggaagcactaaacatggaaaggaacaactggtaccagccactgcaaaaacatgccaaatcataaagaccaccaaagcgaggaagaaactgcatcaactaacgagccaaataaccagctaacatcataatgacaggatcaaattcacacataacaatattaacctttaatgtaaatgggctaaatgctccaattaaaagacacagactggcaaattggataaagagtcaagacccatcagtgtgctgtattcaggagacccatctcacatgcagagacacacataggctcaaaataaaggcatggaggaagatctaccaagcaactggaaaacaaaaaaaggcaggagttgcaatcctagtctctgataaaagagactttaaaccaacaaagatcaaaagagacgaagaagaccattacataatggtaaagggatcaattcaacaagaagagctaactatcctaaatatatatgcatccaatacaggagcacccagattcataaagcaagtccttggagacctacaaagagacttagattcccacacaataataatgggagactttaacaccccactgtcaacattagacagatcaacgagacagaaagttaataaggatatccagcaactgaactcggctctgcaccaagcagacctaatagacatctacagaactctccaccccaaatcaacagaatatacattcttttcagcaccacaccacacctattccaaaattgaccacatagatggaagtaaagcactcctcagcaaatgtaaaagaacagaaattataacaaactgtctctcagagcacagtgcaatcaaactagaactcaggattaagaaactcactcaaaaccactcaactacatggaaactgaacaacctgctcctgaatgactactgggtacataatgaaacgaaggcagaaataaagatgttctttgaaaccagtgagaacaaagacacaacataccagaatctctgggacacattcaaagcagagtgtagagggaaatttatagcactaaatgcccacaagagaaagcaggaaaaatctaaaattgacaccctaacatcacaattaaaagagctagagaagcaagtgcaaacacattcaaaagccagcagaaggcaagacataactaagatcagagcagaactgaaggaaacagagacacaaaaaaacccttcaaaaaatcaatgaatccaggagctggttttttgaaaagatcaacaaaattgatagaccactagcaagactaataaagaagaaaagagagaagaatcaaatagatgcaataaaaaatgataaaggggatatcaccaccgatcccacagaaatacaaactaccatcagagaatactataaacacctctacggaaataaactagaaaatctagaagaaatggataaatttctcgacacatacaccatcccaagactaaaccaggaagaagttgaatctctgaatagaccaataacaggctctgaaattgaggcaataattaatagcttaacaaccaaaaaaagtccaggaacagatggattcacagccgaattctaccagagctacaaggaggagctggtaccattccttctgaaactattccaatctatagaaaaagagggaatcctccctaactcattttatgaggccagcatcatcctaataccaaagcctggcagagacacaacaaaaaaaaagagaattttaggccaataaccctgatgaacatcaatgcaaaaatcctcaataaaatactggcaaaccgaatccagcagcacatcaaaaagcttatccaccatgatcaagtgggcttcatccctgggatgcaagtctggttcaacatacgcaaatcaataaacgtaatccagcatataaacagaaccaacgacaaaaaacacatgattatctcaatagatgcagaaaaggcctttgacaaaattcaacaacacttcatgctaaaaactctcaataaattagatattgatgggacgtatctcaaaataataagagctatctatgacaaacccacagccaatatcatactgaatgggcaaaaactacaagcattccctttgaaagctggcacaagacagagacaccctctctcaccactcctattcaacatagtgttggaagttctggccagggcaatcaggcaggagaaggaaataaagggtattcaattaggaaaagaggaagtcaaattgtcgctgtttgcagatgacatgattgtatatctagaaaaccccatcgtctcagcccaaaatctccttaagctgataagcaacttcagcaaagtctcaagatacaaaatcaatgtgcaaaaatcacacgcatttctataacccaataacagacaaacagagagccaaatcatgagtgaactcccattcacaattgcttcaaagagaataaaataccttggaatccaacttacaagggacgtgaaggacctcttcaaggagaactacaaaccactgctcaatgaaataaaagaggatacaaacaaatggaaaaacattccatgctcatgggtaggaaggatcaatatcctgaaaatggccatactgcccaaggtaatttatagattcaatgacatccccatcaagctaccaatgactttcttcacagaattgggaaaaactgctttaaagttcatatggaaccaaaaaagagcctgcaatgtcaagtcaatcctaagccaaaagaacaaagctggaggcatcacgctacctgacttcaaactatactacgaggttacagtaaccaaaacagcatggtactggtaccaaaacagagatacagaccaatggaacagaacagagccctcagaaataatgccgcatatctacaactatctgatttttggcaaacctgacaaaaacaagaaatgggaaaacgattccctatttaataaatggtgctgggaaaactggctagccatatgtagaaagctgaaactggatcccttccttacacattatacaaaaattaattcaagaggattaaagacttaaatgttagacctaaaaccataaaaaccctagaagaaaacctaggcaataccattcaggacataggcatgggcaaggacttcatgtctaaaacaccaaaagcaatgacaacaaaagccaaaattgacaaatgggatctaattaaactaaagagcttctgcacagcaaaagaaactaccatcagagtaaacaggcaacctacagaatgggagaaaatttttgcaatctacttatctgacaaagggctaatatccagaatctacaatgaactcaaacaaatttacaagaaaaacaaacaaccccatcaaaaagtgggcaaaggatatgaatagacacttctcaaaagaagacatttatggagccaaaagacacatgaaaaaatgctcatcatcactagccatcagagaaatgcaaatcaaaaccacaatgagataccatctcacaccagttagaacggcgatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggattataaaacatgctgctataaagacacatgcacacgtatgtttattgcggcactattcacaatagcaaagacttggaaccaacccatatgtccaacaatgatagactggattaagaaaatgtggcacatatacaccatggaatactctgcagccataaaaaaggatgagttcatgtcctttgtagggacatggatgaagctggaaaccatcattctcagcaaactatcacaaggacaaaaagacaaacactgcatgttctcattcataggtgggaattgaacaatgagaacacttggacacaggaaggggaacatcacacaccagggcctgttgtggggtggggggagtggggagggatagcattaggagatatacctaatgttaattgatgagtttatgggtgcagcacaccaacatggcacatatatacatatgtaacaaacctgcacgttgtgcacatgtaccctaaaacttaaagtataataaaaaaatttttaaaaaaagaaacacctgcttttttctgttttccatttgcttagtagatttttctccatccttttactttgagcctggggatgtcattgcatgtgagatgggtctcttgaagacagcatacatttgggtcttgcttctttctccaacttggcaattctctgccctttaattggggcatttagcccatttacattcaaggttaatattgatatgtgcatatttcatcctgttatcatgttgttagctgctcaatatgcagatttgattgtatagttgatttatagtggcaatcgttatgtacttaagtgtgtttttgtggtggccagtaacgttcttccattatcatatttagcaatcccttaagggcctcttgtaaggcaatctagtggtgatgaatacccttagcatttgcttgtctgaaaaggatcttatttctccttcacttgtgaagcttcatttggctagatatgaaattcttgcttggaatttcttttctttaagaatgctgaatataggcccccaatctcttctggattgtacagtttctgctgaaacctccattgttagcctcattgggttccctttgtatgtgacctgaaccttctttctagctgcctctaatattttttttcctttcaacctttaagagtctgatgtctgatggctatatgtcttagggatggttgtcatgtataatatcatgcagaggttatttgcatttcttgaatttgaatgttggcctctctggtgaggttggagaaattttcatggaggatagcctgaaatgtttttcaagtttctttttttctctttctcttcttaagggataccaatgtgtcatagatctggtctttttacataattgcacatttctctgaggttttatgccttcttttttattctttgttctttatttttgtctgactgagttaattcagagaatcagtttttaagctctgtgattctttcctcagcttggtctattctgctgttaatacttgtaattgtattctgaaattcttgaagtgagttttttagctctatcaaatcagtttggttctttcttaaaatggccatttcatctttcagcttctgtatcattttactttatttcttagctcccttggattgggtttcaacattctcctgaatctcagtgatcttctttcctgtgcatattctgaattctatgtctgtcatttcagccatttcagtcaggttaagaaccattgctgggaaaccagtgtgattatttggaggtaagaagacactctggattttagagttgcagagtttcttgcattaattctttctcatctttgtgggctgtttctttaatctttgaagtggctgtcctttggatgtttttgtcttttttgttgttttttggtgtgtgtttttgtttgtttgttcatttgtttgttttttgctcttatcttctttgatactcttgcaggtttgattgtggtataaagtggattcagttagctgtgtttcttgaaaatcttagagggtccaggctcacctcagcactcttgtggtgtgttctctgctctgggactgggcccctggctttattctctggccccttgagtttagaaacttgctgcattggaggggctgaggtgttcccagtccattggccacaacactatagtagggggtgccggccaaagcacttcattagagtggtggcagtgggatccattcttactcatgggtgccagcagttgtggagtcatggcagggtgcacatgcatctgctggggtgggggtactggcaggagcagagtggcagcatccctacataggttcctgctggcagtcacagcgcagtgaggtgcccgtgtgttggcagggacagggtggtggggcacacatgcacatgcttgctggtggtagagggagttgtgatctgctgtgcactcatgccagcaaagcagttgggaggtactatgggtggactggtgcacatcagcagaggctggcctgctggaggtctccaatggttaggcatggtctgctggcaaaggagctatgatgagggcccccaggaaacaccctggttgggcttccaaggctgtactgcaagcaggcacagccagcctggggccccaggagaggccagaaggcaaggaaattctcatttcagatgggccctgtcccatggacaagaccaccctgctttattcaggtcccatagtcactctaaggttaaaatctcctagaggaggttggtgagccttgggggatgggtgtcccctggctgtgctccactacagccattctcatgtcaaacactctgggctttacacagactggagtcctgcccctggcatctctctaagcagctgtcccttccagcacaagtgtccatgggggtcatggggtctcctgctgctaggattctggaggcccatggcaacagcaggccactcctcacctgttcaactcaacctttccccaggagttgctgggagccaggaatgagtcctggtgcttggcatccccatgcagggttcccatcttcctccaccttcagctcagcatctgtgtcctcccccgtctactctcaatccactctcaatgcctccccttcaaagatctgcttggaaagcacccgtcttcctgatgtctcactccctccatggcagatattcctcctggctgcatctagtcagccatcttgactcgcctccaaagtctttttaattaccacttcggttaaattagtaactatcattttacaatggcctgtgattctgttttgatcaaatattttgagccttttagcatctataacaaatgttctcaaaaatcaaaatcctaaatcaagtctctgccttagtcttatttctggggcttattaaggctataaaaattaatcaccataaggttgtacaagctttttacagcttccagtcaggctatgaactccagtatcaccacctccagcctgataattacatatattggaagaaaatcagttaaaggactccctctagacccttgaaagggtgtgagagacaacatggtttcgcctgccttcatgtgtcccagtccatccctgtggctgcctctgtccacctcagcttgcccactgtctttccttcccaactgtctgccctgctgacttctggcctcagtgacagatgcaaagacaaggcgacagccccacatagaccgtttaaccagtcccacatttgcataagctaaatggtcatgtcacagtctgttgcccaggctggtctcaaactcctgggctcaagtgatccacccaccttgacccccaaggtgctgggattacaggcttgagccacagtgcccagccaagaacccgtttttgagtgggcaccttggcacacacctgtaaacgcaacactttgggaggccaaggtgggagtgtggcttgaggccaggaggttgaggttgcagtgagctatgatggcaccacctcactccagcgtgggtggcagagtgagatcctttagaaaaaaaaaaaaaaaaaacttgttttctctgcagccgggctccgtgaccaaacacaaacacaaacttcccctccagagggtccaggaggggctgggctgcaggaggtgcttagggcctcttagggaatggtaagtgaccacccaacgcaggcactcagccccaggggcatatgcagagagagggtccaggaggagctgggctgcaggaggtgcttagggcctcttagggaatggtaagtgaccacccaacgcaggcactcagccccaggggcatatgcagagagagggtccaggaggagctgggctgcaggaggtgattagggcctcttagggaatggtaagtgaccatccaacgcaggcactcagccccaggggcatatgcagagagaggctgggaggacactttcagtgactggggttacaaaccccaaccataagacattgctggctctgtgagccgccacctccagaaatctcccacttagttcttagcacttatccactcttcccttttcctactctcaattcctggaggatgccctcctttctcaggctcagaccaacctaccagctccactctagacctgaacacatgactcctccctctgtctccacctggaaatctcatcagtgcctcacatttacactcctgaaaatcaggtcctgcctacccaccctcttgctccacctgattcctgccctgtttcagccagagaccttgcagtctcctttaactctcaaacccacccatgtcgtgtgagcatactgactgtgttctatgcaagaaagagcagtttcttggtggtcctgcggttttattagtccagaggcaaagcgttggcagagctggtttcttctgaaccctgggagggagattctgttttcatgccttttccagattctagaacccatattccttgctctgtgtccccttcttccatcttcaaaggccatcctctcatctctgtgtccatcatcacatcacccttcccctgactctggttctcctgcttccacttataagcacccttgtgattacatcatacccacccagacaatgcagggccatattctcccctctcgagattaatttaatcacatctacaaagttcctcgtgccatatgaggtcactaaaccacatgttctgggggtttgaatgtaaacatttgggggatgcattattcagccacccacaagcactgctccccactggccacacactatgcacagccgagatcatgcaagtgaggcacgttcatcaacagcagcttcagcaggaaactatatgctccactttcctgccatttgtatctggatttttttttcgctatcattgtagaaagagtggtattgtaaaattaaagatggattattttctttctagaacactttggcaatctatccaacattatttatccccttctgagtgtcaagtgtgaggtcattctttcattgagagctcaatgcctacaattatgataatgcatattgggtactttcacacatcagaaagttcttctttcttaaaatctgttcttgaattattcattcttctctagctttttgttgatctattttataattttagaaaaatcagaaagtaacttgaagtatctgtcatctctacaggtttacctccctctttgtggccttcagaatgtcatgacacgcttttcccttgctcatcacatggtttctatgtatgagacctcatcacaggagctgtggtcccccgggagcaggcatctgtggatggtgccttgctcctggctgctgggacctgtgtgctgccagtggcactccacgacagtgatttcccagctcagttttgcagctccagatggtgggtgagacactaggaccactttgtgaacagcgagggcttggggtttgcttttctaccatgtccagggctgctgttcatgagggaatgtttctaacctgacatcatggctgaagccaacttagaacctctctagccgtatggggagtaggtgagtgatacagatgttaattagctcagtggagccactcccctatgtagacatgttacaaaacattatgctgtacagaataaatataggtcatttttatgtgtcaatcaaaagagaaactaattatttaaaaaaaaaaaaaaaacctctctactcaagccgaaacctcagctccagtcccacaagtcacacaaggctgctcccgtcctgtgtatgttaaacctacctcagaaatgcaagggggcattcaggtttcattctcaattcaaatgccctttttaattttgtctattcctagcacctggcaacttccagctctttttttcggggctcattcattatttaaagcacgtataatttttcacccacattctaacacatgtagtactgtagagaatccttccctaggaggatctacagcattagaaaagaattaagaactccaatatttacaagaaggaaaaagcaaaaagagatcaaaaaatgggcaacttctagaaatagaaaaccctcatgagtatgatgataaatcgctggcacacatgtgaatagttacttgatgcttatagtgatgtctgggaaaataacatgaaatacttataatctgtttctcacacatgtaattcaaaagaatagagagaagatgatttgaaatattcttaagtttgtaggaaaaaagctacttccatatgcataattgcatgtattttgatactgccattattaagaactatctaagagggtccattaaaaataaaatttcttggctgggcacagtggctcatgcctgtatcccagcactttggaaggccgaggcaggtggctcacctgaggtcagaagttcaaaaccagcctggccaacatggtgaaacgctgtatctaccaaaaatacaaaaattagctgggcatggtggcatgcacctgtagtctgagctacttggggggctgaggcaggataatcgtttgaacccaagaggtgtaggttgcagtgagctaagatcataccaccgcactccagcctgacagacaaagcaagactctgtctcaaaaatattaaaataaaatttctcattcctattacagagtaatttaattcattaatgccctgccctgttacaaaactcatttgtaaaatactaattgtaattgtgaaaaaatggcaattgatactaattttaaattctaaaaacagggcacccatattaaagattattctgcagtaagagaattagctataacattttgtaataaggtggagaaaacattctccaacttacaatggttggtgagaagaaagtttccagcacggtagatggaccctaagagcccttgttgaaataataagacaaaaagatatacagagagatgagccagatgaagggagacagagagagagagagagagagagagagaggcacagaaatgagagatacaaagtgaaagagggcaacctgtggggtcatcagatatttgttttctgttttgtttattctaacataaaggcagtggtgggtcatcgatgtatttagagtttgcacaatcactgtggaacacagacagacacaggggaagaggagaaacacagggcggtggcttgcccttggactgttcttagttcctcaaaacgtaacagctttgcccaacctaagggaactttcagcagctgctcttctgccataggcctctttcctgccttgttttcatgtggctgactgtttctgttcctgcaggtcttagctcatcagacaggcatttattacctctgtgtcaacagtgggagcttccattactctctagcatgacactccccttcctcttttaggaaatttaacatggaagtgagtttgccatcggccttctccccacagtgttaacagtggtgaggaagccagcctgttccaccttgcccctcccatgattccaacactgagttcagacttgtcacatggaacttatctttgcatgtttgtggcacagacagatggacccaaccatggattagtggatggatggatggatggatggatggatggatggatggatggatggatagatggatggatggatggctgagtaggtgtgtggatggaagagtgaaaagatagatggatgcatgtatgggtggatgggtaggttgatggatgcatggatgggtggatggatgggtgagtggatgaatgggtgggtaggtgggtggctacatgcatggatgagtacttggatagataagtgagtggatggatggatggatggatgaatgggtatgtgaagggatggatgtattagagtgggtagttaggcaggcatgagctgatagtcaagtgattgttaaactgcctctctaaaataataattggtctcggctggacgcggtggctcatgtctgtaatcccaacactttgggaggctgaggtgggcggatcacaaggtcaagagattgagaccatcctgaccaacatggtgaaaccctgtctttactaaaaatacaaaaattagctgggcgtggtggcgtgcatctatagttccagctactcgggaggctgaggcaggagaattgcttgaacctgggaggaagaggctgcagtgagctgagattgtgccactgcactccagcctggtgacagagcaaagctctgtctcaaataataataataataataaataataattgatctcagccagcgccaagaaaaggcagtctcccaatagatagaaaacacccgaaactggtcatcagcagcttcctgataagatctcaggcattgggtgagtgggctcaagcatatgcactaagaggcaaagtggcagagtttaactggcacataatcttcctctaggaacactctaatagtaagagaaggacacctcaaatgagcatgtgcacatttcattaaacccactgtgtatgcagcccctcccaagtgctggcaggccactgtacatgtgggcagcccactccaagggaagaatcaagggagaagaaatacaaatcccagaaccatgtcaatgtataaaaccccaagtcaagggccggacagagcacttagatctctcaagtcgcccacttagccctcttccaagtgtactttacttcctttagttcccactttaaaactttaataaacatttactcctgctctaaaacttgcttgggtctctcactcttctgtatgccccttggccaaattctttcctccaaggaggcgagaatcaagttgctgcagacctgtatggattcgctcctgctaacagatagctggatgggtggacagatgcatgaattagtggatggacgtttggatgtgtgggtgggtgggtggattgtgggatggctggatgaatgcatggctggatgggtggacagatgcatgaattagtggatggatgtttggatgtgtgagtgggtgggtggattgtgggatggctggatgaatgcatggctggatgggtggacagatgcatgaattcgtggatggacgtttggatgtgtgggtgggtgggtggattgtgggatggctggatgaatgcatggctggatgggtggacagatgcatgaattcgtggatggacgtttggatgtgtgggtgggtgggtggattgtgggatggctggatgaatgcatggctggatgggtggacagatgcatgaattcgtggatggacgtttggatgtgtgggtgggtgggtggattgtgggatggctggatgaatgcatggctgggtgggtggatggatgcatggataagtggtggacggatggacgggtgagtggatgggtggatgtgtgtgtggatgggtggataggaaagccctctaattgattacagggctcagtgtgtgcttcaacatcatgatggcatcatcacattggtccctgtatgaagcagtgggggaggagagtgtaccaggggagcaggaatgacttttctccagaatcgacctctcccaccctgcagcctgggctgtgcaggccacattggagaaggtgcggtcgactactcctaaatgttgttgtgtccaatggcttgttgacgttgatgtaggaatgagcctacatctccaccatagatggaactgtttgggtccccaaagcagaaagcctcttctgttgcaggtgctgaagtttccatcttcttctgcttatacggaagctcacgcatcccttggatggcaggcgtcaggttcctgtgcgcactgagttccccccttacatgctttggacagaagtgtgagacacacaagattgctgcaggaagtccacctgtggggatgctgcgacttctccagcaagaacacgagtctgctcattgaccatcaccacacataacaaattaagtgtcccttttttgataacacgtcattgtttcacagagtattcttttaaagtgtataagttgactgcagttattattttttacttctgttactaatttactcataattaggcacaatttacacttaagaaatttcttaatagttttttcctccttaaggtgaactacagtcagataacatacttatcaattgtctctagctcttgtcagaaaaacatatagatgtgtgtgtgcgtgtgtcttggcctttccaatgatgaattaagatgtgcattgagaaggcattcactttatttgacgttaaggaagtaccaagaagacgctctccacagaccctgggaaagccagcagctgcaccccgaggctgtgccaggcagggaacaaggaggcagcaccacctgctgggcagggaaaatgtcctcccagtccctgccgcttctctgcagaggcacaaagagctgccccttctcctgggccttctcctgggctgatgagattgctccccgatatgccaaatcagggttgtgcatctgaggctctgtctagactctcagctccttcctactcctgcaaagtgaagaaaacaatgccaaggggtcctggaggcgtctctacccctggagagttttgactctcttcaatagtctccactaccctgccctcactccatgtcctccgtttctccctaaagcggtgcccagtctgattgcactgtggcagggataacgaggggccaggacatcaggggagagaagtttctacctgagtcacagcagcggctgccctgcagactcctgaagacacaagacacatttccatcccagagacccagcgaaatgcaacctcaggctagagacagccagttattttttcttgttctgtcctggagaggccactgagaaagtcgagccccttgttgaggaaaacatgagatctctgtgtgtcgtcctctgcctgatggctgtacctccatgtgagtgtctcagagatttcagaacgggggctgtgggctgtggtgtccgcttgtgactcatctctttgcttcttgtccctgagtgtcctgcatcagatgcagctactggagtcatgcccagggctggtgaggtcctcacagacctctgggcctggacccagcagccctctgggaaggcgctggggcacctcagctccaggggcagcacacacttcagcccagcctttctgggccaactctccatctgtagagacacatccaaggcccagttatccctgcagctgagctccgtgatggccaagggcagggccgcacattcccgtgggagacagaatggggacctcagcgtgagcccagacacaaacctccctgcagggaagcacaagaccaccaggcggcgctccagaccacacagcggccccagaagcaggttttagggggcggggcagacgtgtccgcgttgagtcaggtcattggttttactttccctgagcaaacggcctctgccaaggactcactgcacctctcaccttcacagttgttttttttttttttttaatcaccctgtagagttttgctagctaatttagatattgaggagtgcttcatacttccttgggcctctgcttgcagaaacatagcaattgtaaggaggcacgtgggaaagccccggctcggtgacccgggggatgctgctgtggccctggcaagagggcgtcgggccgcagtaacaaaggtgcagacggctctcagcctgcgcccgcggagtacaacacataagggctgtaacctaacgaaaaaagaatcgcagtgcaactgtcctgcatttgagtttgtgatcagttttgccctttgtctttaacaggttctaacataaaattttgaatgttggttcaagccctgtgggtaaaatgcacttacccacattccttaaacaaatagaacactgaggtggaaatgttttgaaaaagtagttttcagacatttggaaacaagcatcacaggatcataacccctgagaaaagaaaaacaaatgaacgaatcctgctattgcctgaaagcagctgccaggacacacggaaaggcttagtgagctgagcggacagagagcagagttcaaggcagcagcagcccgaggggaggagcaccggggagcaggctgctgtgcagccaggatgggccggggtggggcggggggagaacagctggagacttgccgcagggagggggatccctcaggtttggggctgagaactgacttatgcctgacttatgcctgcatgaaaagaaactactcgatatcagggggaaatcaccagaaacctgtggacccaaaactacacagagcctacacaaggaaagcattgtttgtgttctcccagccagggtggaaagaccttgagatatgtaaagcttcaagcaatcttccgaagtaatctcgtgagtagtggtgccacattaattcaggactaaaggctgctctgaactgaacctaagaaatgcttcaagtgtagcctggagcccgggtgcagtggctcacacctgtaatcccagcactgtgggaggccgaggcaggcggatcacttgaggtcaggactttgagaccagcctggccaacatggcaaaacctgtctctactaaaaacacaaaaattagctgggcgtggtggcagatgcctgtaatcacctcccacctggacccttccttgatacatcagaattacaactagagatgagattggggtggggacacagagccaaaccgtatcacataggaacctaaaaggataataaagtaggaaaacttcccacatcagtaaccctttatccgatagtaatcccaatctgcaaagtaaaactgtgtgattttactaagataacggaatcttctctacagaaggactttccagtgcaaaagctccccaccctcaccatgaaatgcacgtgaccatttccaatttgtgtaaagtcctcagttagtactgagacttcggaaggttagaaatccctttgctcatgctgcatggtccggatgagatgtaagaatcattagctaatagacatgcaacagcttttgtgtgaaagatgttatgagacatttaaggtatttgcttgtgattactaagcattcattgtatcattggagcacatgtgcttttataccctggagaaattccagtaattgaattgctgggttgaatgggattttgatttggattaaatttaaactatagattttatttagggaaaactggcatcttaattatgttattggggggcccttgctcccagagctcccaagatggtggcaggccgcttccaaaatgaccgcaggccacttccaagatggtggcaagcctcatgttctctgacctggggttcttggcctcacggattccaaggaatggaagcttgggccatgcagtgagtgttatagctctattagaagccgtgggtcacggaagagaaccgtggaacccagtgactagtgttcagctcgattaggacgaacccaggcacttagccgtgcaggaacaatggcgagcatttggcccgatcgagagtggcaatgggcgcctcgctggatcaggagcacagcggataccctgatggatccggagggatggaagccagcggtgggtctcccacgggggcaaacagcagtggtggacggtgagcgaaagcgaagctcgagccgtaacaaacatggaccagaagagtgcagttgcaagatttagtagagtgaagacagagctcccatacaaagggaggggacccaaagagggtagctgttaccggctcgaatgcctgggtttatatcccgatcattgtccctcccgctgtgctctcaggtgatagatgattggctatttctttacctcctgcttttgcctaattagcattttagtgagctctctttactatctgattggtcgggtgtgagctgagttgcaagccccgtgtttaaaggtggaagtggtcaccttcccagctgggcttagggattcttagtcggcctaggaaatccagctagtcctgtctctcaattacactgagttttccaatccatgcatccaatatgtggtgtatctcttcatatgttcatagcctctgagcaatgttttacaattttctgtgtaaagaactccacatcgttttatgtttcttctaaggtatatcctgattgctttttatgtcttcacaagttttttcctttcaaaattaattttccaattgtttggtgctaatatgctcaaatgtccttgattttcttagtttgaacagtccgtttttgttttggggatttatttttttttcagattctttaagattttctatgtctataaccatataatctctgaacagagacagttttgctttttcctttcaacttgaggtaggttttctgggtagttcaggacgcgcaggcactgggtgggtggtgttagcagctgcacgatgccttggagaggacactctcgggggactgtggccgctgctcagctgtgaccgttcttatagcaccagcagctgcggccaccattcttatccaatttccaaagccacaccacaggccctctcaagaacgaggcgtggaggctatgccctctcctggacacatcatcattcccaagccccacgatgtgggccccatgggacgcacacctttgtctgtccagacctcagccccacctcctcatcctgcaccagaactcttcagagcccagtgcatgaaatgggctaccaaggaaatgagggtaggttcctgagaggaaactggccctgcatttgggagctaggagtctgctaattcgcctggcagccctgtgcagccctccgtggctacagtccaccccgtgcccatcagtgcctccttcctgtgcaagcctggacctcgccctgggctcaggatgggctgtagaccgagaatgcaggcgggaaagtctttgtctatcggggccatagtcaggttctacagtgagtcagggaaagacctgtggaggtgtggatgaggacaatgggtccaccatcaacaggaggacacgggttcgaccccttgcagaggcacagtcccacatcactgggaggcagccacactcactgcctcgccctctcctcacacagtgcagtttccacgttcacagccccagccagtcaccaggaatgccctgggggcggcctttccccagtgcactccgagccctcccttggctgtgcggtgagctccatgcccaggagatatccacccatagtcctccggaaagcagctgacctgccatgccctggaaccacaaatccccacagatcagccagcctgcagtgggccttggatgtggtgaggagtggtggcacccccgttcccaccccacagatgcaacgcctgtgggtgacgcatgtgagtactgaggagtagagggtagaactgtaggccccgagaaccacagaaactcgggtgttacactctggggccatgtaaggagaaagtgtcactggacagaaacaggcccctcctagacactgtgtgcgccatagtcacctgtcattagctctcactcttgcagattcatgattgaggtggttaaaaaaaaaaaagctcctactcacccatccaaccccatcctggggtgtttccaccacccttggggtttgggatgagctgcccttgcccactgtgctctgtggacctccctttagaagctcacagctccctgcactcggctccatcctgccccaccacacagaagcaaaacccctctcctttccactgcaggcttttcctggaccagaatgctgacctgctgcccttcactcccgaagtggtgggactgcctggggtggtgtgggtgttgagccttcttactctagggacctggcacctggccccaggggcacagggatggtgcatctgcctagggatgcctcctcatgccagggggtgggggttagtaccatcggccctcaggatttgttgcatgaatgagtgaatgggtgaataaatgaaggggatctgatctatgaataagggtatatagactttggttgatgtaggacgccaaatgctggaatttcagagtcatcacacccaggggccctgcctctgagctcctctttgcatccaatctgctgaagaacatggctctagggaaacccagttgtagacctgagggccccggctcttcaatgagccatctccgtcccggggccttatatcagcaagtgacgcacacaggcaaatgccagggtgtggtttcctgtttaaatgtagcctcccccgctgcagaactgcagagcctgctgaattctggctgaccagggcagtcaccagagctccagacaatgtctgtctccttcctcatcttcctgcccgtgctgggcctcccatggggtcagtgtcagggagatgccgtattcacagcagcattcacagactgaggggtgtttcactttgctgtttccttttgtctccaggtgtcctgtcacaggtacagctgcagcagtcaggtccaggactggtgaagccctcgcagaccctctcactcacctgtgccatctccggggacagtgtctctagcaacagtgctgcttggaactggatcaggcagtccccatcgagaggccttgagtggctgggaaggacatactacaggtccaagtggtataatgattatgcagtatctgtgaaaagtcgaataaccatcaacccagacacatccaagaaccagttctccctgcagctgaactctgtgactcccgaggacacggctgtgtattactgtgcaagagacacagtgaggggaagtcagtgtgagcccagacacaaacctccctgcagggatgctcaggaccccagaaggcacccagcactaccagcgcagggcccagaccaggagcaggtgtggagttaagcaaaaatggaacttcttgctgtgtcttaaactgttgttgttttttttttttttttggctcagcaacagagatcatagaaaaccctttttcatatttttgaaatctgttcttagtctaatggagattctctaatatgtgacaatgtttttctcttgctgtttttggaattctttgtctttgacttttgacaacttgacttttgacagtgtgcctcaaagaagttctattttgggttctgtgaacctcctggatctgggaagttttcagctatgatttcattaaacgtgttttctacaccatttccctactcttttggaatacccataatgcaaatatttgttcacttaattgtgtcccataaatgctggggattttcttcattcctttttactctttttttctttttattcatctgcctgaattatttcaaaagatctgtcttcaacttcagaaactcttttgcttggcctagtctaatcttgaaggtctcaattgtacttttaatttcattcattgaattcttcaactctggaatttctgttggttcttttttatgatacttatctctttgttgaattcctcattcaaatgataaattgttttcctgatttcactgaattttctatctgtacactattgtatctccctgagtttcttagagattatccttttgaattatttttctgacattctgtatatttccttatgattggggtctgctactggagaatgactgttgtctttttcaggtgtcgtgtttcctggccttttcatgttttatgtgttcctacgttgatttctacacatctggcggaccagtcatcccttgcaatttaatggagtaggttttgcaggaaaagacttcctagtacagacgggtctcagggtgtcagtgtggcggggcgtgctggctttagttctaggttgacgcagtagcgtagtctccatgtcgtttcttcagctgccgtccacattggtgacgtttgcgagtgtctcagtggcctgggctgagaggtttgtggcagtggaagtgcaacgttgctagaggtggactcaccaggctgtttctgaggtcgaggcacatgcatgcacatggtggattgaccaacttggtgccaggctcactagggttggggacatggggctgtttctcaggcccaggatgcaaacacaagtctctttggctggcctgggggtgtggcttctgagggcaatccacagggctgtttctcaggttcaggacacaagtgcatggccgctcaactggcctgggcatgtgtctcccagggccaccccatgggctctttctcagacccaggacatggccacatggcttcctcagctggcctgggtgtgtgtctgctggggggctgcaggggcacagggttatttctcaggccggggtcatgggcgcacagctgcttgctggcttataggagtgcctgccaggggtggcccatgatgctgtttctcaggcctaatttcaggtgcagagcctttgggcaggtcaacggcatacctgtggaaattggagtggatgccacagggctatttctcaggtgcctgagtgtgggcacatatccactctgccagcctggagttagtatcaggtgctcggtggctcaggggcctctcctgctcaggggagggccctcagcagcttggccaaatcaatggtggattcaccctgggcaggcctggcaggctcttcctccagctggatgtgcagcagcaggggttgggttttttgctgtgcagggccagagtcacggccaatcctcagcctaggctctgcacagccagggttgtggcattcagccacccagatatgggcatcctgaagatggagccccaatgctagaaaggggcagtggctaccagcctcagggcaggatgcactccagaggcggctccggtctcaaggtggcgctgggctgcagcagctaggctcacagtggatgaatgggggcagggagtacacaccttgtgctcctaatctgggatcattcctggcagctcccaaccgcggatcctctccctatagtgagtcgtattagcggccggccgcctcccatgattccaacactgagttcagacttgtcacatggaacttatctttgcatgtttgtggcacagacagatggacccaaccatggattagtggatggatggatggatggatggatggatggatggatggatggatggatagatggatggatggatggctgagtaggtgtgtggatggaagagtgaaaagatagatggatgcatgtatgggtggatgggtaggttgatggatgcatggatgggtggatggatgggtgagtggatgaatgggtgggtaggtgggtggctacatgcatggatgagtacttggatagataagtgagtggatggatggatggatggatgaatgggtatgtgaagggatggatgtattagagtgggtagttaggcaggcatgagctgatagtcaagtgattgttaaactgcctctctaaaataataattggtctcggctggacgcggtggctcatgtctgtaatcccaacactttgggaggctgaggtgggcggatcacaaggtcaagagattgagaccatcctgaccaacatggtgaaaccctgtctttactaaaaatacaaaaattagctgggcgtggtggcgtgcatctatagttccagctactcgggaggctgaggcaggagaattgcttgaacctgggaggaagaggctgcagtgagctgagattgtgccactgcactccagcctggtgacagagcaaagctctgtctcaaataataataataataataaataataattgatctcagccagcgccaagaaaaggcagtctcccaatagatagaaaacacccgaaactggtcatcagcagcttcctgataagatctcaggcattgggtgagtgggctcaagcatatgcactaagaggcaaagtggcagagtttaactggcacataatcttcctctaggaacactctaatagtaagagaaggacacctcaaatgagcatgtgcacatttcattaaacccactgtgtatgcagcccctcccaagtgctggcaggccactgtacatgtgggcagcccactccaagggaagaatcaagggagaagaaatacaaatcccagaaccatgtcaatgtataaaaccccaagtcaagggccggacagagcacttagatctctcaagtcgcccacttagccctcttccaagtgtactttacttcctttagttcccactttaaaactttaataaacatttactcctgctctaaaacttgcttgggtctctcactcttctgtatgccccttggccaaattctttcctccaaggaggcgagaatcaagttgctgcagacctgtatggattcgctcctgctaacagatagctggatgggtggacagatgcatgaattagtggatggacgtttggatgtgtgggtgggtgggtggattgtgggatggctggatgaatgcatggctggatgggtggacagatgcatgaattagtggatggatgtttggatgtgtgagtgggtgggtggattgtgggatggctggatgaatgcatggctggatgggtggacagatgcatgaattcgtggatggacgtttggatgtgtgggtgggtgggtggattgtgggatggctggatgaatgcatggctggatgggtggacagatgcatgaattcgtggatggacgtttggatgtgtgggtgggtgggtggattgtgggatggctggatgaatgcatggctggatgggtggacagatgcatgaattcgtggatggacgtttggatgtgtgggtgggtgggtggattgtgggatggctggatgaatgcatggctgggtgggtggatggatgcatggataagtggtggacggatggacgggtgagtggatgggtggatgtgtgtgtggatgggtggataggaaagccctctaattgattacagggctcagtgtgtgcttcaacatcatgatggcatcatcacattggtccctgtatgaagcagtgggggaggagagtgtaccaggggagcaggaatgacttttctccagaatcgacctctcccaccctgcagcctgggctgtgcaggccacattggagaaggtgcggtcgactactcctaaatgttgttgtgtccaatggcttgttgacgttgatgtaggaatgagcctacatctccaccatagatggaactgtttgggtccccaaagcagaaagcctcttctgttgcaggtgctgaagtttccatcttcttctgcttatacggaagctcacgcatcccttggatggcaggcgtcaggttcctgtgcgcactgagttccccccttacatgctttggacagaagtgtgagacacacaagattgctgcaggaagtccacctgtggggatgctgcgacttctccagcaagaacacgagtctgctcattgaccatcaccacacataacaaattaagtgtcccttttttgataacacgtcattgtttcacagagtattcttttaaagtgtataagttgactgcagttattattttttacttctgttactaatttactcataattaggcacaatttacacttaagaaatttcttaatagttttttcctccttaaggtgaactacagtcagataacatacttatcaattgtctctagctcttgtcagaaaaacatatagatgtgtgtgtgcgtgtgtcttggcctttccaatgatgaattaagatgtgcattgagaaggcattcactttatttgacgttaaggaagtaccaagaagacgctctccacagaccctgggaaagccagcagctgcaccccgaggctgtgccaggcagggaacaaggaggcagcaccacctgctgggcagggaaaatgtcctcccagtccctgccgcttctctgcagaggcacaaagagctgccccttctcctgggccttctcctgggctgatgagattgctccccgatatgccaaatcagggttgtgcatctgaggctctgtctagactctcagctccttcctactcctgcaaagtgaagaaaacaatgccaaggggtcctggaggcgtctctacccctggagagttttgactctcttcaatagtctccactaccctgccctcactccatgtcctccgtttctccctaaagcggtgcccagtctgattgcactgtggcagggataacgaggggccaggacatcaggggagagaagtttctacctgagtcacagcagcggctgccctgcagactcctgaagacacaagacacatttccatcccagagacccagcgaaatgcaacctcaggctagagacagccagttattttttcttgttctgtcctggagaggccactgagaaagtcgagccccttgttgaggaaaacatgagatctctgtgtgtcgtcctctgcctgatggctgtacctccatgtgagtgtctcagagatttcagaacgggggctgtgggctgtggtgtccgcttgtgactcatctctttgcttcttgtccctgagtgtcctgcatcagatgcagctactggagtcatgcccagggctggtgaggtcctcacagacctctgggcctggacccagcagccctctgggaaggcgctggggcacctcagctccaggggcagcacacacttcagcccagcctttctgggccaactctccatctgtagagacacatccaaggcccagttatccctgcagctgagctccgtgatggccaagggcagggccgcacattcccgtgggagacagaatggggacctcagcgtgagcccagacacaaacctccctgcagggaagcacaagaccaccaggcggcgctccagaccacacagcggccccagaagcaggttttagggggcggggcagacgtgtccgcgttgagtcaggtcattggttttactttccctgagcaaacggcctctgccaaggactcactgcacctctcaccttcacagttgttttttttttttttttaatcaccctgtagagttttgctagctaatttagatattgaggagtgcttcatacttccttgggcctctgcttgcagaaacatagcaattgtaaggaggcacgtgggaaagccccggctcggtgacccgggggatgctgctgtggccctggcaagagggcgtcgggccgcagtaacaaaggtgcagacggctctcagcctgcgcccgcggagtacaacacataagggctgtaacctaacgaaaaaagaatcgcagtgcaactgtcctgcatttgagtttgtgatcagttttgccctttgtctttaacaggttctaacataaaattttgaatgttggttcaagccctgtgggtaaaatgcacttacccacattccttaaacaaatagaacactgaggtggaaatgttttgaaaaagtagttttcagacatttggaaacaagcatcacaggatcataacccctgagaaaagaaaaacaaatgaacgaatcctgctattgcctgaaagcagctgccaggacacacggaaaggcttagtgagctgagcggacagagagcagagttcaaggcagcagcagcccgaggggaggagcaccggggagcaggctgctgtgcagccaggatgggccggggtggggcggggggagaacagctggagacttgccgcagggagggggatccctcaggtttggggctgagaactgacttatgcctgacttatgcctgcatgaaaagaaactactcgatatcagggggaaatcaccagaaacctgtggacccaaaactacacagagcctacacaaggaaagcattgtttgtgttctcccagccagggtggaaagaccttgagatatgtaaagcttcaagcaatcttccgaagtaatctcgtgagtagtggtgccacattaattcaggactaaaggctgctctgaactgaacctaagaaatgcttcaagtgtagcctggagcccgggtgcagtggctcacacctgtaatcccagcactgtgggaggccgaggcaggcggatcacttgaggtcaggactttgagaccagcctggccaacatggcaaaacctgtctctactaaaaacacaaaaattagctgggcgtggtggcagatgcctgtaatcacctcccacctggacccttccttgatacatcagaattacaactagagatgagattggggtggggacacagagccaaaccgtatcacataggaacctaaaaggataataaagtaggaaaacttcccacatcagtaaccctttatccgatagtaatcccaatctgcaaagtaaaactgtgtgattttactaagataacggaatcttctctacagaaggactttccagtgcaaaagctccccaccctcaccatgaaatgcacgtgaccatttccaatttgtgtaaagtcctcagttagtactgagacttcggaaggttagaaatccctttgctcatgctgcatggtccggatgagatgtaagaatcattagctaatagacatgcaacagcttttgtgtgaaagatgttatgagacatttaaggtatttgcttgtgattactaagcattcattgtatcattggagcacatgtgcttttataccctggagaaattccagtaattgaattgctgggttgaatgggattttgatttggattaaatttaaactatagattttatttagggaaaactggcatcttaattatgttattggggggcccttgctcccagagctcccaagatggtggcaggccgcttccaaaatgaccgcaggccacttccaagatggtggcaagcctcatgttctctgacctggggttcttggcctcacggattccaaggaatggaagcttgggccatgcagtgagtgttatagctctattagaagccgtgggtcacggaagagaaccgtggaacccagtgactagtgttcagctcgattaggacgaacccaggcacttagccgtgcaggaacaatggcgagcatttggcccgatcgagagtggcaatgggcgcctcgctggatcaggagcacagcggataccctgatggatccggagggatggaagccagcggtgggtctcccacgggggcaaacagcagtggtggacggtgagcgaaagcgaagctcgagccgtaacaaacatggaccagaagagtgcagttgcaagatttagtagagtgaagacagagctcccatacaaagggaggggacccaaagagggtagctgttaccggctcgaatgcctgggtttatatcccgatcattgtccctcccgctgtgctctcaggtgatagatgattggctatttctttacctcctgcttttgcctaattagcattttagtgagctctctttactatctgattggtcgggtgtgagctgagttgcaagccccgtgtttaaaggtggaagtggtcaccttcccagctgggcttagggattcttagtcggcctaggaaatccagctagtcctgtctctcaattacactgagttttccaatccatgcatccaatatgtggtgtatctcttcatatgttcatagcctctgagcaatgttttacaattttctgtgtaaagaactccacatcgttttatgtttcttctaaggtatatcctgattgctttttatgtcttcacaagttttttcctttcaaaattaattttccaattgtttggtgctaatatgctcaaatgtccttgattttcttagtttgaacagtccgtttttgttttggggatttatttttttttcagattctttaagattttctatgtctataaccatataatctctgaacagagacagttttgctttttcctttcaacttgaggtaggttttctgggtagttcaggacgcgcaggcactgggtgggtggtgttagcagctgcacgatgccttggagaggacactctcgggggactgtggccgctgctcagctgtgaccgttcttatagcaccagcagctgcggccaccattcttatccaatttccaaagccacaccacaggccctctcaagaacgaggcgtggaggctatgccctctcctggacacatcatcattcccaagccccacgatgtgggccccatgggacgcacacctttgtctgtccagacctcagccccacctcctcatcctgcaccagaactcttcagagcccagtgcatgaaatgggctaccaaggaaatgagggtaggttcctgagaggaaactggccctgcatttgggagctaggagtctgctaattcgcctggcagccctgtgcagccctccgtggctacagtccaccccgtgcccatcagtgcctccttcctgtgcaagcctggacctcgccctgggctcaggatgggctgtagaccgagaatgcaggcgggaaagtctttgtctatcggggccatagtcaggttctacagtgagtcagggaaagacctgtggaggtgtggatgaggacaatgggtccaccatcaacaggaggacacgggttcgaccccttgcagaggcacagtcccacatcactgggaggcagccacactcactgcctcgccctctcctcacacagtgcagtttccacgttcacagccccagccagtcaccaggaatgccctgggggcggcctttccccagtgcactccgagccctcccttggctgtgcggtgagctccatgcccaggagatatccacccatagtcctccggaaagcagctgacctgccatgccctggaaccacaaatccccacagatcagccagcctgcagtgggccttggatgtggtgaggagtggtggcacccccgttcccaccccacagatgcaacgcctgtgggtgacgcatgtgagtactgaggagtagagggtagaactgtaggccccgagaaccacagaaactcgggtgttacactctggggccatgtaaggagaaagtgtcactggacagaaacaggcccctcctagacactgtgtgcgccatagtcacctgtcattagctctcactcttgcagattcatgattgaggtggttaaaaaaaaaaaagctcctactcacccatccaaccccatcctggggtgtttccaccacccttggggtttgggatgagctgcccttgcccactgtgctctgtggacctccctttagaagctcacagctccctgcactcggctccatcctgccccaccacacagaagcaaaacccctctcctttccactgcaggcttttcctggaccagaatgctgacctgctgcccttcactcccgaagtggtgggactgcctggggtggtgtgggtgttgagccttcttactctagggacctggcacctggccccaggggcacagggatggtgcatctgcctagggatgcctcctcatgccagggggtgggggttagtaccatcggccctcaggatttgttgcatgaatgagtgaatgggtgaataaatgaaggggatctgatctatgaataagggtatatagactttggttgatgtaggacgccaaatgctggaatttcagagtcatcacacccaggggccctgcctctgagctcctctttgcatccaatctgctgaagaacatggctctagggaaacccagttgtagacctgagggccccggctcttcaatgagccatctccgtcccggggccttatatcagcaagtgacgcacacaggcaaatgccagggtgtggtttcctgtttaaatgtagcctcccccgctgcagaactgcagagcctgctgaattctggctgaccagggcagtcaccagagctccagacaatgtctgtctccttcctcatcttcctgcccgtgctgggcctcccatggggtcagtgtcagggagatgccgtattcacagcagcattcacagactgaggggtgtttcactttgctgtttccttttgtctccaggtgtcctgtcacaggtacagctgcagcagtcaggtccaggactggtgaagccctcgcagaccctctcactcacctgtgccatctccggggacagtgtctctagcaacagtgctgcttggaactggatcaggcagtccccatcgagaggccttgagtggctgggaaggacatactacaggtccaagtggtataatgattatgcagtatctgtgaaaagtcgaataaccatcaacccagacacatccaagaaccagttctccctgcagctgaactctgtgactcccgaggacacggctgtgtattactgtgcaagagacacagtgaggggaagtcagtgtgagcccagacacaaacctccctgcagggatgctcaggaccccagaaggcacccagcactaccagcgcagggcccagaccaggagcaggtgtggagttaagcaaaaatggaacttcttgctgtgtcttaaactgttgttgttttttttttttttttggctcagcaacagagatcatagaaaaccctttttcatatttttgaaatctgttcttagtctaatggagattctctaatatgtgacaatgtttttctcttgctgtttttggaattctttgtctttgacttttgacaacttgacttttgacagtgtgcctcaaagaagttctattttgggttctgtgaacctcctggatctgggaagttttcagctatgatttcattaaacgtgttttctacaccatttccctactcttttggaatacccataatgcaaatatttgttcacttaattgtgtcccataaatgctggggattttcttcattcctttttactctttttttctttttattcatctgcctgaattatttcaaaagatctgtcttcaacttcagaaactcttttgcttggcctagtctaatcttgaaggtctcaattgtacttttaatttcattcattgaattcttcaactctggaatttctgttggttcttttttatgatacttatctctttgttgaattcctcattcaaatgataaattgttttcctgatttcactgaattttctatctgtacactattgtatctccctgagtttcttagagattatccttttgaattatttttctgacattctgtatatttccttatgattggggtctgctactggagaatgactgttgtctttttcaggtgtcgtgtttcctggccttttcatgttttatgtgttcctacgttgatttctacacatctggcggaccagtcatcccttgcaatttaatggagtaggttttgcaggaaaagacttcctagtacagacgggtctcagggtgtcagtgtggcggggcgtgctggctttagttctaggttgacgcagtagcgtagtctccatgtcgtttcttcagctgccgtccacattggtgacgtttgcgagtgtctcagtggcctgggctgagaggtttgtggcagtggaagtgcaacgttgctagaggtggactcaccaggctgtttctgaggtcgaggcacatgcatgcacatggtggattgaccaacttggtgccaggctcactagggttggggacatggggctgtttctcaggcccaggatgcaaacacaagtctctttggctggcctgggggtgtggcttctgagggcaatccacagggctgtttctcaggttcaggacacaagtgcatggccgctcaactggcctgggcatgtgtctcccagggccaccccatgggctctttctcagacccaggacatggccacatggcttcctcagctggcctgggtgtgtgtctgctggggggctgcaggggcacagggttatttctcaggccggggtcatgggcgcacagctgcttgctggcttataggagtgcctgccaggggtggcccatgatgctgtttctcaggcctaatttcaggtgcagagcctttgggcaggtcaacggcatacctgtggaaattggagtggatgccacagggctatttctcaggtgcctgagtgtgggcacatatccactctgccagcctggagttagtatcaggtgctcggtggctcaggggcctctcctgctcaggggagggccctcagcagcttggccaaatcaatggtggattcaccctgggcaggcctggcaggctcttcctccagctggatgtgcagcagcaggggttgggttttttgctgtgcagggccagagtcacggccaatcctcagcctaggctctgcacagccagggttgtggcattcagccacccagatatgggcatcctgaagatggagccccaatgctagaaaggggcagtggctaccagcctcagggcaggatgcactccagaggcggctccggtctcaaggtggcgctgggctgcagcagctaggctcacagtggatgaatgggggcagggagtacacaccttgtgctcctaatctgggatcattcctggcagctcccaaacttggctgagggcttgcaaaacctgtggaattctcctgttgcaagggctgtagatgtttgcagtggcagtgggtgctggcgggaaatctgcttaccttttccctacatgggaagtccctcctgtgtccagaccaatccgatctgggtggggaagacaaggctgcaaaggccaggtgcctccatgctgccctccgatcaccacgggtgcgtttccacacctccactgcactccgtcagtctcccttcaacactccagtcaaaccttagctgtttcttctttgccttattccttcctcatggggagggtgtgggtgaacaccaggcttctctaagttcttcatccatcttgctgatgtcattctccatccaggcatgggtttttaagaagtagtgaatactgaaatttcagcagaggacacctctataaaaattctgcaactggaaaacctccttaaattggctgattgtcattacaattggaggaaaactgccaataatttcaaatttagaaggctgagactctataaacaaagactaacaatatgttttctgatatttttccccaaaataatacttttccaagacgaaaatttttccagggtatataagcacatgtgctccaatgatacaacaaatacttactaatcataagcaaataccttaaatgtcttataacatctttcacacaaaagctgttgcatgtctattagctaaaaattcttatgtctcgtccagatcatgcagcatgagcaaagggatttttgaccttcaaaagtctcagtactaactgaggactttacacaaattggaaatggtcacctgcatttcatggtggtggtggggagcttttgcactggaaaatccttctgtagagaagattccattatcttggtaaaattacatagttttattttgcagattgggattaccaactgataaagggttactgatgtggaagttttcctactttattctcctattaggttcctatgtgatatggtttggctctgtgtccccaccccaatctcatctccaattgtaattcccatgtgtccagggagggtccaggtgggagtgattagatcaagggtggtttttcccaggctgttttcatgatagggtgttatcatgagatatgatggtttaaaagtggcaggttcccctgctctctctctcgcctgctgccacataagacgtgccttgctttcccttcaccttctgccatgattgtaagtttcctgaggcctccccagccatgcggaactatgagtcaattaaacctcctctctttataaattacccagtctcaggtagtatctttatagcggtgtgaaaatggactaatacactatggctttgaattaataatttaaaatttgtcagcttggcaataaaacatcctgttgacatttattttttaggtaatattttaaattggcagtttcattcatgtttttacaaattcttattttcagggtgtttaaggcctttgctttgaacttggtggttccttacactccatgctgttagtgaagagggaccaggttgggaggcattggtttgggtggtggtcaggaagggcagagtgatttgagtagggtctgagtggataatagctcatcagtttggaatttataaatgaccagggatgatttaaggagattcctgccagacacctatgccatggccatgccctatctggatctccagccgtgagatgagaacccagccatgcgggggagtctgttcgttctgctcaatgttgtaagtggcacatgctattggataatgtagaattgaatggatatcattttattattataatttacaaacttcctacaataaacttatcacctttatacatagaaacaaatataagtacattttccctcccctatgtcattttgagccctctctccaaaccatcctcccactctgcgactcactgtcctgcatttggctatgctctggcaagtcctgcttagacaagcactcaccagaccacctactcagcctcccttcagcgcccacctggcccacctgctcaaatacatgttgagtggtcacacacatggactgaacaccatctattccatgcactgccccagtgaccgcactgagcagcaagagagaaatgatcgcattagctatcaattatgccaattcaaatgctggagtctttctcagatacttttcaatgttcaagaattgttgattgtgaattctatacccaatgaaactatccttcagaaatgagcagaaaatggataccttctcaaataaacaaaaactaaaagaattcttgctacaagatgtactcttaaagactggctaaaggaagttcttcaaacagcaaggaaattgaattgatcttatgtcctgcacacttgctaaatttcctctcaattttagcagcactgtttagattccataggattttccatacaaacagtcatgtggtctatatatagagacagattttcctcttttccagtggggataaatttatgtctttttctttctgtgttacagcaggtaggacctccagtacaatgttaaacagaagtggtgaaaacagacattcttgcctgtttcctaacgttggagtttggtcttttactatggtgtcagatgttagctgtagggtttttataaatgcccttcatcacattgaggaagtttgctcctatgcctaattttctgagagtcttttaatgtgacactcatgctagaatttattaaatgctttctgtctactaagatgattatgcagttcttatattaacatgaataattacatttatttattctttaatatcaaggcaattttgcattcctgagacaaaccccatttagtcatcatgtgttgttattgttacatattgttggattcaatttcctcaaaatttgttaagaattgttacatctatgtttacaaggaagattagtctgtagggtattttttcttataataactttgcctagttttgcaatcagggtaatgctggactcacagaatgagttgggaagctatttcctcctcttcatttttctgaaagaatttgtataaaattggaattatatcttccttaaaggtttgcaagatttcataatgaagtcattggcctagagttttctttgtgggaaagtctttgtttgtttgttttgtggtttgggtttttttttaagagacacagtctcactctgttgcccaggctggaatgcagtggtgtaatcatagctcacagcagcctcaacctcctgggctcaagcaatcctcctacctcagccttcagagtagctgggactacgggcatgtaccaccacacccagctgtttgtttgtttgtttatcgctttgtcttgtttttgaggtcttattatgttgcccaggctggtcttgaactcctggcctcaagtaatcctcatgcctcagcctcccacagtgctggaattacaggcatgagccactgcacacagactgtgggaaagtttttaactaaaaattcaattttctcttccttttccagtgagctttccagtgtctttcaattaatgtatctattttatctaagttgttgaatttattgtcaaaatttttttaaacaatattcctctcttagaggttgaacatctgtagaatctgtagtgatggcacctcttaaatccctgatcttgctcatctgtgtcgtctctctttctctaatcagtatgcctaaagtttaatttcattgattttcttaaaaaactggttttggttttattgatttttttccctagttttttgtgttacatttcattgacttctgctctgatatttactatttcctttctactgcctacagtaagtttaatttgctattttcttagtttcctaaagtggaagctaagtttattgacttgaggcctttcctctgtctggatgcggatatttgctgctaaacatttccctccaacaccatgctgtgagttttagttacagcgggcttggagttggcctgagaaattctacttaaacagctgcacctatcatgtaagtgataaatgatgtacctgcctggccctcacccctggtcaaagaatgggatgtactaatgagcaatgttgctgcgtagctgtggatttcaaggtattttctgtgtggttttatcatcagcattgtttgttgatgactgcaagactgatgatttgcacctggcctcggtgagatccccgaaagaccctgcagatgggctggttacttagcagaaaatatgacaacgtggccagcaggaaacaggaaggtacaatcggctgcaggtgagctgttggaagtaagttccaattttcctattttgtatttgcattttaatagtgagactgcgcttatgttatttgtgtgaaacagctttattcatagcactgtaatttaaagagaaaacccattcatgggaacaacaaacgacctagacaccaaggtagctcatgccatccaaggctatactgtgcagtgattgggaaaatgggcactggtcccagaagtctgatcgacactctgccactggctagtcccgtgctggggggcgaggatccacactctgccactggttagtcccatgctggggacaagtatccacactctgccactggctagtcccgtgctggggggcgaggatccacactctgccactggttagtcccatgctggggacaagtatccacactctgccactggctagtcccgtgctggggggcaaggatccacactctgccactgattagtgttgtgaagatttaaataaagaacccacaccatattctttgacttgtgctttccgtatactgagagatagtaagagtacattattattatttataaagtaaactagaaagcacatgggaagacaagaagaaaacctgaataaacatgaattaccccattttcctcaggagaaaactttcacactctgaaggtacacaaattagcctacaaatttaatgtaaagcaaatagactgttgtaggtaccaattctcaatgtcacagtgttacatggaaagtaaaatacacaagaacagcccaaaagatggaaacaatggacgtggtcaaatgacatcagtacaacatccatatggtcctaagtagccatctttaaaatgggttagaaatgccttcaatcattcacacagacacatgcattgaacaaactctaagaagtgttcttacacgggaaaagcaagttacagatgcatgggcatgatatggatgtagatgtgtgtatgtgcatcccactcatacacaaaatacccagcatcgcccacatgcctgctgtgtgcgtaagtgtgagcgagtgcacagacaacagcgtgcagaaattcaaaccaagctgtgggtacttgttaccactgggaagggagtcggtcacagagggaaagagaaacaggacatcagcctttgacttcagaactgttcctgccttttcacatcctgtgctgttttcagcatcatcggagcccttaacacacatcacgggagtaagagtgtgttagagggagcattcggtgggacagatattgccatggcttgtggatagagttcacagtccttaataatccccgagatggcagccaagagctacgttctcaatcacgcagcttcaccccagaaactgacagaaacccaacaaccaaaaggtgtccattctgacagcctcagcctgtgctggctcagatgagcaaaaatgtacagatattaataatgatgttgatttgaagagcacagaggggggtatgcatgataagggtccaaatttttaccttaaaaaagaatacatttacttctcaatcacctacataacgatcattttttaaaaaactgatcaaatttggtgttacaagggcacgttgcaaattcttctggctacttttctctgactattctaattacgttaccgtgttttctcctgtatgtgcccgttcatgtgaatgtcatttctggctacttttctctgactattctaattacgttaccgtgttttctcctgtatgtgcccgttcatgtgaatgtcatttctggctacttttctctgactattctaattacattaccgtgttttcctgtatgtgcccgttcatgtgaatgtcatttctggctacttttctctgactattctaattacgttaccatggtttctcctatatgtgcccgttcatgtgaatgtcatttctggctacttttctctgactattctaattacgttaccgtgttttctcctgtatgtgcccgttcatgtgaatgtcatttctggctacttttctctgactattctaattacattaccgtgttttcctgtatgtgcccgttcatgtgaatgtcatccaggcagatttcccaaatccggcttcctgtaaccaagggctgaaagagggaacggtttcctgggaatcctttttgcagtttattttacccggaggcagaagcccacggttccgtgaagagtctattgctctcccctctctccttttgtgtctctatttttaattgacaaaaaagcaaatgtgaagattcctggggtacaatgcaaagtgacaatgcctgtctatattgtgggatgattaaaacaaggtaagtggcatatccatcacctcacacacttatcattttgtggtgagaacatttaaaatctcatcttttagcaattttgaaatagtcattattgttaactatagtcaccatgctgtgcaacagatcaaaagaactgactcctcccatcagcagaaacttcatgccctttgaccagcatctctcctttccccgtccacgactaacccccagcccaagagaacagccaacacccacctcgctgctgccacacgacatgtcgggctttgatgggatggaggtgagggtggggaagacaattccaaagctggagcactggcctcacagctcagacactcttctacttatcctgagagaatgatgtgctgagaccaactaaacctcccctgctcttcccacatggcagaaaagaggcaacccagggaagccattgccaggacatcatggtcacccaacccttgtgcagaaaggaagcacctgcccaggatgccatagcacccaaccctcatccccaaggaaacacagcccagggcaccatggacacccaaccgtcatccccaggggaggacacagcccagggcaccatggacacccaaccctcatccccaggggaggacacagcccagggtatcttggacacccagccctcattcctaggggagtacacagcccagggcatcttggacatccaaccctcatccccagggaaggacacagcccagggcatcttggacacccaaccctcattcccataagagcacacagcccagggcatcgtggaggcccgaccctcatccctaggggaggacacagcccagggcaccatggacacccaaccctcatccccaggggaagacacaacccaggccaccattaacacccaatcatgtgcagggagggtgtccttggagcctgggactcttgccagtgaagcggtggacaagaaactgaggatgcgatcagcacacagaaatctcaggcagcctaggatacatgaggcctctcacccctgggaacactgagcagccaccaggagcccacaccttgaggtacagcaggagccatgcgctcttgctcttgctcactcacactcctgcacacagccactgacacacgccctcgtgcacgttgcagattaactccactggccttgcacttgcaacgctggaggctgagaggtatccccaggttcttttctcgtgagaggggcaggctgactttcactctcctccatgtgctagaggcagctccaccaacactggctgccctgagtggatgcacctggctctggaattcctgtcatttgctttggatccaggagcccctgcctcatgtagctacttaacagaaaggaggaatccacccaggacatgcccagacgggagcctcacaggatggacagtggtgtctggggtcacgggcagccctgacccagcagcgccagcaccagcacacccagtggggaaggcggggaggcccaaacgccacccacagtttgttactccactgggtgggacccggcacccctgccttcctgacaccctggagtccctgcctcctcctagagcccccaagcccatctgcctcagagcatccagagacagacctggggagccatttcctcaggccctggacaaggaaacagggaattccaggttatgggtgcctggggcaggtctcaggcaggtgctgggaaccagagagaggggtcaccgcgaggcctcaggcctggcaccagcactttgagcctcagtttaccagcccacgaggtgctgagtctggactggatgaccttcccacccccagtgacctctgccctttcccgagcatgtcagctctgctccagcatcctggtgtgagcgcaatgccactttttttctcaacaaatacgaaaggaggaaggtgcccccagggccctgtgccctgaggatgcctgtgtggaggggtccatttcatcactggtgtcactcacaggaagggacgaagccacctgccttgacggagcttactccacctccgccgaaggccggggaggtccctcacagagaacctgaggcccagcaggctgcagaggtgctggcatggaatgactgctcagacgcccggggccggcagagaggacggatgtgggggaggtgcacactgaggagcctctccttggaggtggagacacgtgcaccacatggaccaggacacagtccacgaagcctcgcatccccctgagctgcagctcaagggcctctctctgagcccagagtcccacccctgggaggcagctgccccagctctgagggaggagggcatccaccaggccctccatctcctgggggcaccagcccagcccagaggctctgcaggactctgcacctccaattcatggccaggactttctggatgtatcttaaggactgaggactccacatcagggaccacacaagaccggggtcccggacacgggggttgggggtgagcatgtcaccgggatgggctgtggcgtcactctggtacttcatccggacagccagggaccaaagccacgccctcagccccaccccacccctgcctcacatggcaacgcagggtctgcagatgcaggagagtgagaagcatggtagccaggcagactagaggacccgagctggggttgagcacctccctgtctacccagggcatggcctgtgagactgcaggtggcctagtgtgtgctgcaggctcaaggtcctgccccagggagcatgacattcaggcccagaaattgcatcgtgctgcacacagtccaaggggataaccctgtgaagttcaggtcaccagcaggcttggggtcaagaccgagctgcagaggacaggtttctggaaggcacagcatcatgggtggagggacttggagcaaggtccttagccccgggaccagtgaatgtgtgcccttatagggaaagggggtctgtgcagaagcaagttagctgaaaatcatgaagtggagaggctcccctggattaaaggggtgagccctaatgtaatcacaagtgtccttctaggaggttggcagagggagactgacatagacagaagccaggtgaggtgggaagcggaggcagaggccgagagagcagacgctacgccctggccctgaagacggaggaggagccgagagctcagggatggagagactggaggaggcagggaagttctccccgcaagcctggagggagcatggcctccagcacccccagaccttggccctgcaggattcatctggacctgtggtataaatggtgtttaagccactgggctgtgcaaattgtcatagcagccatggcgcattcctagagggagccctggtggggacccagcaggcagcgacggggccctcacaagcctgtgagccactcagagccgcgagagtggctaggcttggtgaggtgcaggccacgcgcacctccactaaggcagccttagggcccacacatcctctctctctctctctctctctctctctatctctctccctccctccttccctccctcccgctctcttggttggacagctctccatcatccccctggacacgaccacctcccaaggccgagctggggcgctttgctcgaggtgagcactgacatcctgggggtgtgaggggcacctgcccagcggccccgtgtgcaggatgggcggtgggccctagctggcactgggcatatggcccggctggtgcctgcaggctgcagcttttctggggtggctgggatcagtgaaggcctccagagtctgggcctgggatccctgcagtgctggctgaggacaggcggggctgggcagtgagggcactgggtcactatcaccacccacggtttattacttcactaggtgggacctggcacccctgccttcctgacaccctggaatccctgcctcctcctacagcccccaagcccatctccctcagagcctccagagacagacctggggaggcatttcttctgcccccagcagaagcccgggaggccgggaaggcacagtgggtctaaaggagaggatcccaggactgcctgaggggtgactccgacgaggcaagcatagagcccactgagaagcggggtgggagccccaccagggatgggctagttcctcatgaaggaccaggacccaggaaggacaagggggcctgctggggcagggtctgctatgccggagtccctgtgagcctggcccagacctgcctctctctttcctcattggtccccacaggtccgtggtggttgccgtatcgggaggccccatggtggcaggggtgggacacctggtatacgtcgccaggtgtgtccaataggctcatgctcacaccttctcctggcacctgggcaaagcctgagcacccaggcactgaagtgagggcaaggcctcggggccccacaggatggccgaggagacagctgcagggcgcctgggacccctgggctcaggaggtagaaggatacagcctgaaaacccacaccacaagctcaccggccagtgcaggcccacagagctcgaggaggcagccctgagcctcccagggagagatgctctgtgcacgccggcacaggccctgggttacaaaccctaggcacagcccaggagaggcccaggccccagtccagcaaggggttgcaggaagcaagaggtccccggccacagcatgagataagcccatcaagccagggccaggtgggcaatgggaggcaggcagggcttgggggtgagtccctgctgcagcgccgtccactgtcgaccggaggagtttcttccctgtgcggagtccacgggcctcctgtgagtgtgtgcatgggcacaagtgtgtgtgtggctctgctgtgtgtctgtacacacgtatgttttgggtttttttgtgtctcagaccacagagtctgcccctcccaccaaagcccaggcagaaggatgaacccacgcccctggggcccaggcctcagcagcctctgcaggatcattgttcccagttgtcacttgcctttgccacagccctatttctccacaattccttaaagtcctcaacatgcatttaaggcacaaaggtgaaactgcccagaaacatctgactccgccgtggaacccaggagcaagctgggttagctaaggagcggggccgttggcagaggctggggatccaggctgaactttggaggaggcatgtgccagcatgggctcctgactatgtcctcctgggacaaacccaaacccactctttgaatatgggagggactttgctggccccggccctgaccgcagcacttggaaactgaggagtggtcgcctcctccgtgtcacagctgcccgttcaccatcatagaagcaactctgtcacctccatgggcccctctgtggctgctgcctgggtccaagctgagcccagctgcccaggcccagaaggaaagcccaggccaggtgcccagcacagaggcagtcacataccccggggagagccacagcaagcagccaatgttgcccaggagaggagtagctgacaaggtagaacgtgagctgccatcggctcgagaggctttgctggtcctcctggggctctggacatgaccaggaggagcgagggaagaagtcgcatggtggtcccatcctgggtggggcctgatggcagctggccacccgtcccagagtggcagccagatgccagcgccattcccacagtcacatcattggtcacagaatgcaggacatagagtgtcttctttccatcacagtgctgtccagacccatagcctagggtagacctggaagattcaatgtccacacccggggctggagcgtagccatgagccacgccccctgcccgtgcatggaaagccagcccaagctctgctccatccctagccaaagtcagtgtcctttccccttctcccaagtgagctctagccacctgcctaccctgccatctgaggatgacagccttcattccattggaacctggctctgccaccagcaggcttgcagtcctgggcagactccgtcacctctctatgcctcagcctttccatctgcacaggaggaagatgatgatggtggtgatgatgatggcgatggtttccttttgcatctgaggcaaggactaattgagatgatacacatcaggcactgggtatggtgctggtccttcctgagcactcaatctatgtgagctgtccttgtgaaatgggtgtcaccacatttccccacgcagaacatcctttgtctgccatacttgaaacatctgccccaatattaacagttccttcatggaagatgtgcacacccacccaccctcatactcccaaaggtgcccgtgctttatcaagccaaagtccagccaggaactttacagcagcatccctttccctctccaagcaccaaggagcaaggcaaagcactacatcttccatctggaggcaatgccaccctcttctcccattttcactgccatccctaagaggcagtgcttccccaaaaggttccatagcagcctgcctacagcaactctgttcacacgagtttcagcatccttgcagtggctcccctgccatgctgtggctcttcattcaccctcttctcctgctccccgtgacaggcatagattctgagtgatctggatacattgctttgtttaataacattacagcttctgtgctgaaaaagatacagcagatagagaaggcaattgttgaacacaaaatagtgacagcagagatgacggcaagttggcatttttcttttctagcaataaaacttaaagctgactcaaggagaaatggaaatcataattggaacagtaatcctcaagaaagcattaagattattaaataattgccctcacagatgacttcaggccaagatggctttatgggtgaagtttagactttcacaaaactaatcagttcccataagaactgctccaggatttggaggaacatgggaaagtctattaaagggatcacaattcacagtccccagagtaaaacatgggctaacttgcattttggcaaagagccaaatgttataaatgacatcctagaaggccaaattctgtccatctcgttgaacaaggacttacaccaggaatttagaactatttatagctcatcccaccactcaggccaatgatgacccatgatcatctcaccagaaatggaaagactcagatgattaatagagtctcaatttctctgagacatctaagagcccagcccaagcccagacccaggagggcacccaggcctggacagagaacactgatatcacaccagccctccagagggaagcagagactccttcaagctctggaaacacaggcccagacagctgcctaaagttgggcaggcttcactgcaaacccaaatcatgaagctaggtaacacctttacagattctttacatttaaaaatcatcaaaacaagagtaaataataaactcaaataatattaatctaatatgtaaaggtcttgtaccattattatgcaaacaacatacataagctaataagaaaaagaacaaatcccttaagaaatcggcaaaaaggatataacacaatttctaaaagaaaacaaatggctagcacacataaggaaaacactttgtgaacagacattcttcagaacattatttataattataaaatagttgaaagcaagatagtgcctgaagaaattatggtgcatacattagtgggactattctgcaaacattcccaattatacttgtcacatatctgtgataacgtgacagccagcattcatggggtgacctcatttggtaaaagggtgcaaagctcaacacgcattgtgagatgactgtggtgtaaaattagtgggattattccgcaaacattcccaattatacttaccgcatatctgtgataacatgacagcattcatggggtgacctcatttggtaaaagggtgcaaagctcaacacgcattgtgagatgactggtgtaaatacaaagaccaaactgtgaaaaggagtccatcaattaatcgatgcttaccttcagttttgggctaatttttaaagtatgctataagcatatgctcctgttataacagaatggagggattatgagagatgatgcaggtgtgtcctgggcctcccctggcccactgggccctagagatgccttcccaggcatcgctgtcagggcttccctcagagggagtcctgtattgacctcaccaccaaggtctggagcaggggatccttagatattggttggggttatctcaccttaggtctgaatttggggttgtcttagactgttttgtgctgttagaatagaatacccaagactgggaaatttatactgaacggaaatttatttctcacagttctagaggctgtgaagtccaagagcacaggtgccagagcaagtccaagagcaagggaaagtccaaagcaagtccaggagcatctggcgaggaccttcttgctgtgtcatcacatggcggaaggcaagaaagagagcaagagggggccgaactcacccttttataacagcaccaatcccacccatgaggtggggaccttatgacctaatcactcttcatactgttacaatggcaatgaaatttcaacatgagttttggaggagagaagcattcaaaccacagcaagggtgctcctacctcctctctcagggcatctgcagaaagagctgcaactgcacgtccttcctccgtccatcctccatcccttcccaatgtccgtgcatatcctgtgacccaggaggtctggcatagggggtgctcctgccttaggtctgaggccctgtctgaagaggggtaggtgaggaggccatctgatggtctgggccaagacagtcacaggacgcatcatttatcatcaaggaggctgagggttgagtctccaggtccagggaactccccacaaagtgggaaccctgcccagctccacacagcctctgctgggggaccctgctctggtgcagagcctggggacaggtcttgagctcagccagagtctgcctccctgtcatttaggaactaaaccaagcggcaggatgctggagcccagcccccatctgaccttacagggccaaggctggggccctgggttcccctcaaggcgcagcaggactggagccccaggcagtgcaggagtggccaaagctggggcttcctccagagcccccaagcatcacggcaccaagaagggtaggaccctggcctgaggaattggcaccaaagccccagaaactaccctggacaccatggagagaggcctggaggggaagcaccaggcactgcctccccttctgatcccacctgaggtggctgccaagcccagagagccgctctgatgtcccccagccctgcagcccagggatacctgtactgtgcccctgggggacccctggccagtctgtgcaaagaagtcaccaccctacactcagagacagtgggggtcctcgtcccacatcctcagagcatggcccggctgctgcagggatggtctcctggtcctcagagcatggcccggctgctgcagggatggtctcctggtcctcagagcatggcccagctgctgcagggatggtctcctggaggccccccagtgctctattgtcagggctccctccaccccccgcaccaagagagagccagaccccagcaaggcttccagtggcttcaggtcacacccctaggctgaccccagccccattaacacctgcctgagaaagctccacgcaccagaactgaccgtctgctccaactcttgacctcccgttctcagggcgtctgctgaaaaggctgcaactgcacatccttcctccgtccgttcccgatgtccgtgtgtctcctgtggccaggaaggtctttctcgggacctgagagccgctccctgaagtgtccccattgggaaggatggggcctgtgtctccaggctctgggaggacagaatcctgacctcaacagtggccggcacggacacaactggccccatcccggggacgctgaccagcgctgggcaacttttcccttccccgacgactgagccccgagcaccctccctgctcccctaccacctccctttacaaggctgtggcctctgcacagatgataatggagcttggctcattcccctagagtcggtagggagttaaggacaaaactcagtttcctccacctgaactcaagtctgcctatgtttacctaatcacacctggtggacagtttggacaaacttgcacactcagagacacagacacttctagaaatcattatctccctgccccggggaccccactccagcagaagtctgctaggcactggcctgggccctcctgctgtcctaggaggctgctgacctcctgcctggctcctgtccccaggtccagagtcagagcagactccagggacgctgcaggctaggaagccgccccctccaggcgagggtctagtgcaggtgcccaggacaagaaagattgtgaatgcaggaatgactgggccacacccctcccgtgcacgccccctcctgccctgcaccccacagcccagccccccgtgctggatgcccccccacagcagaggtgctgttctgtgatcccctgggaaagacgccctcaacctccaccctgtcccacggcccaaggaagacaagacacaggccctctcctcacagtctccccacctggctcctgctgggaccctcaaggtgtgaacagggaggatggttgtctgggtggcccctaggagcccagatcttcactccacagaccccaacccaagcacccccttctgcagggcccagctcatccccctcctcctccctctgctctcctctcgtcgcctctacgggaaatccgggactcagcagtaaccctcaggaagcagggcccaggcgccgtttaataggaggcttcctcacaatgaaacttttagaaagccttgactacaatgatgaccttggtgtggctgtgaacactgtcagctcccacagctgctgcagcaaaaaatgtccatagacagggtgggggcccggggtcgtctgctgtcctgctcagcccacagcacgcatggaggatctgaggtgccacacctgacgcccaggccagaacatgcctccctccagggtgacctgccatgtcctgcattgctggagggacaggggcagcctatgaggatctggggccaggagatgaatcctattaacccagaggaaaactaacaggacccaagcaccctccccgttgaagctgacctgcccagaggggcctgggcccaccccacacaccggggcggaatgtgtacaggccccggtctctgtgggtgttccgctaactggggctcccagtgctcaccccacaactaaagcgagccccagcctccagagcccccgaaggagatgccgcccacaagcccagcccccatccaggaggccccagagctcagggcgccggggcagattctgaacagccccgagtcacggtgggtacaactggaacgaccaccgtgagaaaaactgtgtccaaaactctctcctggcccctgctggaggccgcgccagagaggggagcagccgccccgaacctaggtcctgctcagctcacacgacccccagcagccagagcacagtggagtccccactgaaccccactgaatggtgaggacggggaccagggctccagggggtcatggaaggggctggaccccatcctactgctatggtcccagtgctcctggccagaactgaccctaccaccgacaagagtccctcagggaaacgggggtcactggcacctcccagcatcaaccccaggcagcacaggcataaaccccacatccagagccgactccaggagcagagacaccccagtaccctgggggacaccgaccctgatgactccccactggaatccaccccagagtccaccaggaccaaagaccccgccccggtctctgtccctcactcaggacctgctgcggggcgggccatgagaccagactcgggcttagggaacaccactgtggccccaacctcgaccaggccacaggcccttccttcctgccctgcggcagcacagactttggggtctgtgcagagaggaatcacagaggccccaggctgaggtggtgggggtggaagacccccaggaggtggcccacttcccttcctcccagctggaacccaccatgaccttcttaagataggggtgtcatccgaggcaggtcctccatggagctcccttcaggctcctccctggtcctcactaggcctcagtcccggctgtgggaatgcagccaccacaggcacaccaggcagcccagacccagccagcctgcagtgcccaagcccacattctggagcagagcaggctgtgtctgggagagtctgggctccccaccgcccccggcacaccccacccacccctgtccaggccctatgcaggagggtcagagccccccatggggtatggacttagggtctcactcacgcggctcccctcctgggtgaaggggtctcatgcccagatccccacagcagagctggtcaaaggtggaggcagtggccccagggccaccctgacctggaccctcaggctcctctagccctggctgccctgctgtccctgggaggcctggactccaccagaccacaggtccagggcaccgcccataggtgctgcccacactcagttcacaggaagaagataagctccagacccccaagactgggacctgccttcctgccaccgcttgtagctccagacctccgtgcctcccccgaccacttacacacgggccagggagctgttccacaaagatcaaccccaaaccgggaccgcctggcactcgggccgctgccacttccctctccatttgctcccagcacctctgtgctccctccctcctccctccttcaggggaacagcctgtgcagcccctccctgcaccccacaccctggggaggcccaaccctgcctccagccctttctcccccgctgctcttcctgcccatccagacaaccctggggtcccatccctgcagcctacaccctggtctccacccagacccctgtctctccctccagacacccctcccaggccaaccctgcacatgcaggccctccccttttctgctgccagagcctcagtttctaccctctgtgcctaccccctgcctcctcctgcccacaactcgagctcttcctctcctggggcccctgagccatggcactgaccgtgcactcccacccccacactgcccatgccctcaccttcctcctggacactctgaccctgctcccctcttggacccagccctggtatttccaggacaaaggctcacccaagtcttccccatgcaggcccttgccctcactgcccggttacacggcagcctcctgtgcacagaagcagggagctcagcccttccacaggcagaaggcactgaaagaaatcggcctccagcaccctgatgcacgtccgcctgtgtctctcactgcccgcacctgcagggaggctcggcactccctgtaaagacgagggatccaggcagcaacatcatgggagaatgcagggctcccagacagcccagccctctcgcaggcctctcctgggaagagacctgcagccaccactgaacagccacggagcccgctggatagtaactgagtcagtgaccgacctggagggcaggggagcagtgaaccggagcccagaccatagggacagagaccagccgctgacatcccgagcccctcactggcggccccagaacaccgcgtggaaacagaacagacccacattcccacctggaacagggcagacactgctgagcccccagcaccagccctgagaaacaccaggcaacggcatcagagggggctcctgagaaagaaaggaggggaggtctccttcaccagcaagtacttcccttgaccaaaaacagggtccacgcaactcccccaggacaaaggaggagccccctgtacagcactgggctcagagtcctctccaacacaccctgagtttcagacaaaaaccccctggaaatcatagtatcagcaggagaactagccagagacagcaagaggggactcagtgactcccgcggggacaggaggattttgtgggggctcgtgtcactgtgaggatattgtagtagtaccagctgctatgcccacagtgacacagccccattcccaaagccctgctgtaaacgcttccacttctggagctgaggggctggggggagcgtctgggaagtagggcctaggggtggccatcaatgcccaaaacgcaccagactcccccccagacatcaccccactggccagtgagcagagtaaacagaaaatgagaagcagctgggaagcttgcacaggccccaaggaaagagctttggcgggtgtgcaagaggggatgcgggcagagcctgagcagggccttttgctgtttctgctttcctgtgcagatagttccataaactggtgttcaagatcgatggctgggagtgagcccaggaggacagtgtgggaagggcacagggaaggagaagcagccgctatcctacactgtcatctttcaagagtttgccctgtgcccacaatgctgcatcatgggatgcttaacagctgatgtagacacagctaaagagagaatcagtgaaatggatttgcagcacagatctgaataaattctccagaatgtggagccacacagaagcaagcacaaggaaagtgcctgatgcaagggcaaagtacagtgtgtaccttcaggctgggcacagacactctgaaaagccttggcaggaactccctgcaacaaagcagagccctgcaggcaatgccagctccagagccctccctgagagcctcatgggcaaagatgtgcagaacatatgtttgtcatagccccaaactgagaatgaagcaaacagccatctgaaggaaaacaggcaaataaacgatggcaggttcatgaaatgcaaacccagacagccagaaggacaacagtgagggttacaggtgactctgtggttgagttcatgacaatgctgagtaattggagtaacaaaggaaagtccaaaaaatactttcaatgtgatttcttctaaataaaatttacagccggcaaaatgaactatcttcttaagggataaactttccactaggaaaactataaggaaaatcaagaaaaggatgatcacataaacacagtggtcgttacttctactggggaaggaagagggtatgaactgagacacacagggttggcaagtctcctaacaagaagagaacaaatacattacagtaccttgaaaacagcagttaaaattctaaattgcaagaagaggaaaatgcacacagctgtgtttagaaaattctcagtccagcactgttcataatagcaaagacattaacccaggttggataaataaacgatgacacaggcaattgcacaatgatacagacatacattcagtatatgagacattgatgatgtatccccaaagaaatgactttaaagagaaaaggcctgatatgtggtggcactcacctccctgggcatccccggacaggctgcaggcacactgtgtggcagggcaggctggtacctgctggcagctcctggggcctgatgtggagcaggcacagagccgtatccccccgaggacatatacccccaaggacggcacagttggtacattccggagacaagcaactcagccacactcccaggccagagcccgagagggacgcccatgcacagggaggcagagcccagctcctccacagccagcagcacctgtgcaggggccgccatctggcaggcacagagcatgggctgggaggaggggcagggacaccaggcagggttggcaccaactgaaaattacagaagtctcatacatctacctcagccttgcctgacctgggcctcacctgacctggacctcacctggcctggacctcacctggcctagacctcacctctgggcttcacctgagctcggcctcacctgacttggaccttgcctgtcctgagctcacatgatctgggcctcacctgacctgggtttcacctgacctgggcttcacctgacctgggcctcatctgacctgggcctcactggcctggacctcacctggcctgggcttcacctggcctcaggcctcatctgcacctgctccaggtcttgctggaacctcagtagcactgaggctgcaggggctcatccagggttgcagaatgactctagaacctcccacatctcagctttctgggtggaggcacctggtggcccagggaatataaaaagcctgaatgatgcctgcgtgatttgggggcaatttataaacccaaaaggacatggccatgcagcgggtagggacaatacagacagatatcagcctgaaatggagcctcagggcacaggtgggcacggacactgtccacctaagccaggggcagacccgagtgtccccgcagtagacctgagagcgctgggcccacagcctcccctcggtgccctgctacctcctcaggtcagccctggacatcccgggtttccccaggcctggcggtaggtttggggtgaggtctgtgtcactgtggtattacgatttttggagtggttattatacccacagtgtcacagagtccatcaaaaacccatccctgggaacctgctgccacagccctccctgtggggcaccgccgcgtgccatgttaggattttgactgaggacacagcaccatgggtatggtggctaccgcagcagtgcagcctgtgacccaaacacacagggcagcaggcacaacagacaagcccacaagtgaccaccctgagctcctgcctgccagccctggagaccatgaaacagatggccaggattatcccataggtcagccagacctcagtccaacaggtctgcatcgctgctgccctccaataccagtccggatggggacagggccggcccacattaccatttgctgccatccggccaacagtcccagaagcccctccctcaaggctgggccacatgtgtggaccctgagagccccccatgtctgagtaggggcaccaggaaggtggggctggccctgtgcactgtcactgcccctgtggtccctggcctgcctggccctgacacctgggcctctcctgggtcatttccaagacagaagacattcccaggacagctggagctgggagtccatcatcctgcctggccatcctgagtcctgcgcctttccaaacctcacccgggaagccaacagaggaatcacctcccacaggcagagacaaagaccttccagaaatctctgtctctctccccagtgggcaccctcttccagggcagtcctcagtgatatcacagtgggaacccacatctggatcgggactgcccccagaacacaagatggcccacagggacagccccacagcccagcccttcccagacccctaaaaggcgtcccaccccctgcatctgccccagggctcaaactccaggaggactgactcctgcacaccctcctgccagacatcacctcagcccctcctggaagggacaggagcgcgcaagggtgagtcagaccctcctgccctcgatggcaggcggagaagattcagaaaggtctgagatccccaggacgcagcaccactgtcaatgggggccccagacgcctggaccagggcctgcgtgggaaaggcctctgggcacactcaggggctttttgtgaagggtcctcctactgtgtgactacagtaactaccacagtgatgaacccagcagcaaaaactgaccggactcccaaggtttatgcacacttctccgctcagagctctccaggatcagaagagccgggcccaagggtttctgcccagaccctcggcctctagggacatcttggccatgacagcccatgggctggtgccccacacatcgtctgccttcaaacaagggcttcagagggctctgaggtgacctcactgatgaccacaggtgccctggccccttccccgccagctgcaccagaccccgtcctgacagatgccccgattccaacagccaattcctggggccaggaatcgctgtagacaccagcctccttccaacacctcttgccaattgcctggattcccatcccggttggaatcaagaggacagcatcccccaggctcccaacaggcaggactcccacaccctcctctgagaggccgctgtgttccgtagggccaggctgcagacagtccccctcacctgccactagacaaatgcctgctgtagatgtccccacctggaaaagaccactcatggagcccccagccccaggtacagccatagagagagtctctgaggcccctaagaagtagccatgcccagttctgccgggaccctcggccaggctgacaggagtggacgctggagctgggcccacactgggccacataggagctcaccagtgagggcaggagagcacatgccggggagcacccagcctcctgctgaccagaggcccgtcccagagcccaggaggctgcagaggcctctccagggggacactgtgcatgtctggtccctgagcagccccccatgtccccagtcctgggggcccctggcacagctgtctggaccctctctattccctgggaagctcctcctgacagccccgcctccagttccaggtgtggttattgtcagggggtgtcagactgtggtggatacagctatggttaccacagtggtgctgcccatagcagcaaccaggccaagtagacaggcccctgctgtgcagccccaggcctccagctcacctgcttctcctggggctctcaaggctgctgttttctgcactctcccctctgtggggagggttccctcagtgggagatctgttctcaacatcccagggcctcattcctgcaaggaaggccaatggatgggcaacctcacatgccgcggctaagatagggtgggcagcctggcggggacaggacatcctgctggggtatctgtcactgtgcctagtggggcactggctcccaaacaacgcagtcctcgccaaaatccccacggcctcccccgctaggggctggcctgatctcctgcagtcctaggaggctgctgacctccagaatggctccgtccccagttccagggcgagagcagatcccaggccggctgcagactgggaggccaccccctccttcccagggttcactgcaggtgaccagggcaggaaatggcctgaacacagggataaccgggccatcccccaacagagtccaccccctcctgctctgtaccccgcacccccaaggccagcccatgacatccgacaaccccacaccagagtcactgcccggtgctgccctagggaggacccctcagcccccaccctgtctagaggactggggaggacaggacacgccctctccttatggttcccccacctggctctggctgggacccttggggtgtggacagaaaggacgcttgcctgattggcccccaggagcccagaacttctctccagggaccccagcccgagcacccccttacccaggacccagccctgcccctcctcccatctgctctcctctcatcaccccatgggaatccagaatccccaggaagccatcaggaagggctgagggaggaagtggggccactgcaccaccaggcaggaggctccgtctttgtgaacccagggaggtgccagcctcctagagggtatggtccaccctgcctatggctcccacagtggcaggctgcagggaaggaccagggacggtgtgggggagggctcagggccccgcgggtgctccatcttggatgagcccatctctctcacccacggactcacccacctcctctccaccctggccacacgtcgtccacaccatcctaagtcccacctacaccagagccggcacagccagtgcagacagaggctggggtgcaggggggccgccagggcagctttggggagggaaggatggaggaaggggagttcagtgaagaggcccccctcccctgggtccaggatcctcctctgggacccccggatcccatcccctccaggctctgggaggagaagcaggatgggagaatctgtgcgggaccctctcacagtggaatacctccacagcggctcaggcaagacccaaaagcccctcagtgagccctccactgcagtcctgggcctgggtagcagcccctcccacagaggatgaacccagcaccccgaggatgtcctgccagggggagctcagagccatgaaggagcaggatatgggacccccgatacaggcacagacctcagctccattcaggactgccacgtcctgccctgggaggaacccctttctctagtccctgcaggccaggaggcagctgactcctgacttggacgcctattccagacaccagacagaggggcaggccccccagaaccagggatgaggacgccccgtcaaggccagaaaagaccaagttgtgctgagcccagcaagggaaggtccccaaacaaaccaggaagtttctgaaggtgtctgtgtcacagtggagtatagcagctcgtcccacagtgacactcgccaggccagaaaccccatcccaagtcagcggaatgcagagagagcagggaggacatgtttaggatctgaggccgcacctgacacccaggccagcagacgtctcctgtccatggcaccctgccatgtcctgcatttctggaagaacaagggcaggctgaagggggtccaggaccaggagatgggtcccctctacccagagaaggagccaggcaggacacaagccccctccccattgaggctgacctgcccagagggtcctgggcccaccccacacaccggggcggaatgtgtgcaggcctcggtctctgtgggtgttccgctagctggggctcacagtgctcaccccacacctaaaacgagccacagcctcagagcccctgaaggagaccccgcccacaagcccagcccccacccaggaggccccagagcacagggcgccccgtcggattctgaacagccccgagtcacagtgggtataactggaactaccactgtgagaaaagcttcgtccaaaacggtctcctggccacagtcggaggccccgccagagaggggagcagccaccccaaacccatgttctgccggctcccatgaccccgtgcacctggagccccacagtgtccccactggatgggaggacaagggccgggggctccggcgggtcggggcaggggcttgatggcttccttctgccgtggctccagtgcccctggctggagttgacccttctgacaagtgtcctcagagagtcagggatcagtggcacctccctaacatcaaccccacgcagcgcaggcacaaaccccacatccagggccaactccaggaacagagacaccccaataccctgggggaccccaaccctgatgactcccgtcccatctctgtccctcacttggggcctgctgcggggcgagcacctgggagcaaactcaggattaggggacaccactgtgggcctgacctcgagcaggccacagacccttccctcctgccctggtgcagcacagactttggggtctgggcagggaggaacttctggcaggtcaccaagcacagagcccccaggctgaggtggccccagggggaaccccagcaggtggcccactacccttcctcccagctggaccccatgtcttccccaagataggggtgccatccaaggcaggtcctccatggagcccccttcaggctcctctccagaccccactgggcctcagtccccactctaggaatgcagccaccacgggcacaccaggcagcccaggcccagccaccctgcagtgcccaagcccacaccctggaggagagcagggtgcgtctgggaggggctgggctccccacccccacccccacctgcacaccccacccacccttgcccgggccccctgcaggagggtcagagcccccatgggatatggacttagggtctcactcacgcacctcccctcctgggagaaggggtctcatgcccagatccccccagcagcgctggtcacaggtagaggcagtggccccagggccaccctgacctggcccctcaggctcctctagccctggctgccctgctgtccctgggaggcctgggctccaccagaccacaggtctagggcaccgcccacactggggccgcccacacacagctcacaggaagaagataagctccagacccccaggcccgggacctgccttgctgctacgacttcctgccccagacctcgttgccctcccccgtccacttacacacaggccaggaagctgttcccacacagaccaaccccagacggggaccacctggcactcaggtcactgccatttccttctccattcacttccaatgcctctgtgcttcctccctcctccttccttcgggggagcaccctgtgcagctcctccctgcagtccacaccctggggagacccgaccctgcagcccacaccctggggagacctgaccctcctccagccctttctcccccgctgctcttgccacccaccaagacagccctggggtcctgtccctacagcccccacccagttctctacctagacccgtcttcctccctctaaacacctctcccaggccaaccctacacctgcaggccctcccctccactgccaaagaccctcagtttctcctgcctgtgcccacccccgtgctcctcctgcccacagctcgagctcttcctctcctagggcccctgagggatggcattgaccgtgccctcgcacccacacactgcccatgccctcacattcctcctggccactccagccccactcccctctcaggcctggctctggtatttctgggacaaagccttacccaagtctttcccatgcaggcctgggcccttaccctcactgcccggttacagggcagcctcctgtgcacagaagcagggagctcagcccttccacaggcagaaggcactgaaagaaatcggcctccagcgccttgacacacgtctgcctgtgtctctcactgcccgcacctgcagggaggctcggcactccctctaaagacgagggatccaggcagcagcatcacaggagaatgcagggctaccagacatcccagtcctctcacaggcctctcctgggaagagacctgaagacgcccagtcaacggagtctaacaccaaacctccctggaggccgatgggtagtaacggagtcattgccagacctggaggcaggggagcagtgagcccgagcccacaccatagggccagaggacagccactgacatcccaagccactcactggtggtcccacaacaccccatggaaagaggacagacccacagtcccacctggaccagggcagagactgctgagacccagcaccagaaccaaccaagaaacaccaggcaacagcatcagagggggctctggcagaacagaggaggggaggtctccttcaccagcaggcgcttcccttgaccgaagacaggatccatgcaactcccccaggacaaaggaggagccccttgttcagcactgggctcagagtcctctccaagacacccagagtttcagacaaaaaccccctggaatgcacagtctcagcaggagagccagccagagccagcaagatggggctcagtgacacccgcagggacaggaggattttgtgggggctcgtgtcactgtgaggatattgtactaatggtgtatgctatacccacagtgacacagccccattcccaaagccctactgcaaacgcattccacttctggggctgaggggctgggggagcgtctgggaaatagggctcaggggtgtccatcaatgcccaaaacgcaccagactcccctccatacatcacacccaccagccagcgagcagagtaaacagaaaatgagaagcaagctggggaagcttgcacaggccccaaggaaagagctttggcgggtgtgtaagaggggatgcgggcagagcctgagcagggccttttgctgtttctgctttcctgtgcagagagttccataaactggtgttcgagatcaatggctgggagtgagcccaggaggacagcgtgggaagagcacagggaaggaggagcagccgctatcctacactgtcatctttcgaaagtttgccttgtgcccacactgctgcatcatgggatgcttaacagctgatgtagacacagctaaagagagaatcagtgagatggatttgcagcacagatctgaataaattctccagaatgtggagcagcacagaagcaagcacacagaaagtgcctgatgcaaggacaaagttcagtgggcaccttcaggcattgctgctgggcacagacactctgaaaagccctggcaggaactccctgtgacaaagcagaaccctcaggcaatgccagccccagagccctccctgagagcctcatgggcaaagatgtgcacaacaggtgtttctcatagccccaaactgagagcaaagcaaacgtccatctgaaggagaacaggcaaataaacgatggcaggttcatgaaatgcaaacccagacagccacaagcacaaaagtacagggttataagcgactctggttgagttcatgacaatgctgagtaattggagtaacaaagtaaactccaaaaaatactttcaatgtgatttcttctaaataaaatttacaccctgcaaaatgaactgtcttcttaagggatacatttcccagttagaaaaccataaagaaaaccaagaaaaggatgatcacataaacacagtggtggttacttctgctggggaaggaagagggtatgaactgagatacacagggtgggcaagtctcctaacaagaacagaacgaatacattacagtaccttgaaaacagcagttaaacttctaaattgcaagaagaggaaaatggacacagttgtgtttagaaaattctcagtccagcactgttcataatagcaaagacattaacccaggtcggataaataagcgatgacacaggcaattgcacaatgatacagacatatatttagtatatgagacatcgatgatgtatccccaaataaacgactttaaagagataaagggctgatgtgtggtggcattcacctccctgggatccccggacaggttgcaggctcactgtgcagcagggcaggcgggtacctgctggcagttcctggggcctgatgtggagcaagcgcagggccatatatcccggaggacggcacagtcagtgaattccagagagaagcaactcagccacactccccaggcagagcccgagagggacgcccacgcacagggaggcagagcccagcacctccgcagccagcaccacctgtgcacgggccaccaccttgcaggcacagagtgggtgctgagaggaggggcagggacaccaggcagggtgagcacccagagaaaactgcagacgcctcacacatccacctcagcctcccctgacctggacctcactggcctgggcctcacttaacctgggcttcacctgaccttggcctcacctgacttggacctcgcctgtcccaagctttacctgacctgggcctcaactcacctgaacgtctcctgacctgggtttaacctgtcctggaactcacctggccttggcttcccctgacctggacctcatctggcctgggcttcacctggcctgggcctcacctgacctggacctcatctggcctggacctcacctggcctggacttcacctggcctgggcttcacctgacctggacctcacctggcctcgggcctcacctgcacctgctccaggtcttgctggagcctgagtagcactgagggtgcagaagctcatccagggttggggaatgactctagaagtctcccacatctgacctttctgggtggaggcagctggtggccctgggaatataaaaatctccagaatgatgactctgtgatttgtgggcaacttatgaacccgaaaggacatggccatggggtgggtagggacatagggacagatgccagcctgaggtggagcctcaggacacaggtgggcacggacactatccacataagcgagggatagacccgagtgtccccacagcagacctgagagcgctgggcccacagcctcccctcagagccctgctgcctcctccggtcagccctggacatcccaggtttccccaggcctgccggtaggtttagaatgaggtctgtgtcactgtggtattacgatattttgactggttattataaccacagtgtcacagagtccatcaaaaacccatgcctggaagcttcccgccacagccctccccatggggccctgctgcctcctcaggtcagccccggacatcccgggtttccccaggctgggcggtaggtttggggtgaggtctgtgtcactgtggtattactatggttcggggagttattataaccacagtgtcacagagtccatcaaaaacccatccctgggagcctcccgccacagccctccctgcaggggaccggtacgtgccatgttaggattttgatcgaggagacagcaccatgggtatggtggctaccacagcagtgcagcctgtgacccaaacccgcagggcagcaggcacgatggacaggcccgtgactgaccacgctgggctccagcctgccagccctggagatcatgaaacagatggccaaggtcaccctacaggtcatccagatctggctccgaggggtctgcatcgctgctgccctcccaacgccagtccaaatgggacagggacggcctcacagcaccatctgctgccatcaggccagcgatcccagaagcccctccctcaaggctgggccacatgtgtggacactgagagccctcatgtctgagtaggggcaccaggagggaggggctggccctgtgcactgtccctgcccctgtggtccctggcctgcctggccctgacacctgagcctctcctgggtcatttccaagacagaagacattcctggggacagccggagctgggcgtcgctcatcctgcccggccgtcctgagtcctgctcatttccagacctcaccggggaagccaacagaggactcgcctcccacattcagagacaaagaaccttccagaaatccctgcctctctccccagtggacaccctcttccaggacagtcctcagtggcatcacagcggcctgagatccccaggacgcagcaccgctgtcaataggggccccaaatgcctggaccagggcctgcgtgggaaaggtctctggccacactcgggctttttgtgaagggccctcctgctgtgtgactacagtaactaccatagtgatgaacccagtggcaaaaactggctggaaacccaggggctgtgtgcacgcctcagcttggagctctccaggagcacaagagccgggcccaaggatttgtgcccagaccctcagcctctagggacacctgggccatctcagcctgggctggtgccctgcacaccatcttcctccaaataggggcttcagagggctctgaggtgacctcactcatgaccacaggtgacctggcccttccctgccagctataccagaccctgtcttgacagatgccccgattccaacagccaattcctgggaccctgaatagctgtagacaccagcctcattccagtacctcctgccaattgcctggattcccatcctggctggaatcaagaaggcagcatccgccaggctcccaacaggcaggactcccgcacaccctcctctgagaggccgctgtgttccgcagggccaggccctggacagttcccctcacctgccactagagaaacacctgccattgtcgtccccacctggaaaagaccactcgtggagcccccagccccaggtacagctgtagagagagtcctcgaggcccctaagaaggagccatgcccagttctgccgggaccctcggccaggccgacaggagtggacgctggagctgggcccacactgggccacataggagctcaccagtgagggcaggagagcacatgccggggagcacccagcctcctgctgaccagaggcctgccccagagcccaggaggctgcagaggcctctccagggagacactgtgcatgtctggtacctaagcagccccccacgtccccagtcctgggggcccctggctcagctgtctggaccctccctgttccctgggaagctcctcctgacagccccgcctccagttccaggtgtggttattgtcaggcgatgtcagactgtggtggatatagtggctacgattaccacagtggtgccgcccatagcagcaaccaggccaagtagacaggcccctgctgcgcagccccaggcatccacttcacctgcttctcctggggctctcaaggctgctgtctgtcctctggccctctgtggggagggttccctcagtgggaggtctgtgctccagggcagggatgattgagatagaaatcaaaggctggcagggaaaggcagcttcccgccctgagaggtgcaggcagcaccacggagccacggagtcacagagccacggagcccccattgtgggcatttgagagtgctgtgcccccggcaggcccagccctgatggggaagcctgtcccatcccacagcccgggtcccacgggcagcgggcacagaagctgccaggttgtcctctatgatcctcatccctccagcagcatcccctccacagtggggaaactgaggcttggagcaccacccggccccctggaaatgaggctgtgagcccagacagtgggcccagagcactgtgagtaccccggcagtacctggctgcagggatcagccagagatgccaaaccctgagtgaccagcctacaggaggatccggccccacccaggccactcgattaatgctcaaccccctgccctggagacctcttccagtaccaccagcagctcagcttctcagggcctcatccctgcaaggaaggtcaagggctgggcctgccagaaacacagcaccctccctagccctggctaagacagggtgggcagacggctgtggacgggacatattgctggggcatttctcactgtcacttctgggtggtagctctgacaaaaacgcagaccctgccaaaatccccactgcctcccgctaggggctggcctggaatcctgctgtcctaggaggctgctgacctccaggatggctccgtccccagttccagggcgagagcagatcccaggcaggctgtaggctgggaggccacccctgcccttgccggggttgaatgcaggtgcccaaggcaggaaatggcatgagcacagggatgaccgggacatgccccaccagagtgcgccccttcctgctctgcaccctgcaccccccaggccagcccacgacgtccaacaactgggcctgggtggcagccccacccagacaggacagacccagcaccctgaggaggtcctgccagggggagctaagagccatgaaggagcaagatatggggcccccgatacaggcacagatgtcagctccatccaggaccacccagcccacaccctgagaggaacgtctgtctccagcctctgcaggtcgggaggcagctgacccctgacttggacccctattccagacaccagacagaggcgcaggccccccagaaccagggttgagggacgccccgtcaaagccagacaaaaccaaggggtgttgagcccagcaagggaaggcccccaaacagaccaggaggtttctgaaggtgtctgtgtcacagtggggtatagcagcagctggtaccacagtgacactcacccagccagaaaccccattccaagtcagcggaagcagagagagcagggaggacacgtttaggatctgagactgcacctgacacccaggccagcagacgtctcccctccagggcaccccaccctgtcctgcatttctgcaagatcaggggcggcctgagggggggtctagggtgaggagatgggtcccctgtacaccaaggaggagttaggcaggtcccgagcactctccccattgaggctgacctgcccagagagtcctgggcccaccccacacaccggggcggaatgtgtgcaggcctcggtctctgtgggtgttccgctagctggggctcacagtgctcaccccacacctaaaatgagccacagcctccggagcccccgcaggagaccccgcccacaagcccagcccccacccaggaggccccagagctcagggcgccccgtcggattccgaacagccccgagtcacagcgggtataaccggaaccaccactgtcagaatagctacgtcaaaaactgtccagtggccactgccggaggccccgccagagagggcagcagccactctgatcccatgtcctgccggctcccatgacccccagcacgcggagccccacagtgtccccactggatgggaggacaagagctggggattccggcgggtcggggcaggggcttgatcgcatccttctgccgtggctccagtgcccctggctggagttgacccttctgacaagtgtcctcagagagacaggcatcaccggcgcctcccaacatcaaccccaggcagcacaggcacaaaccccacatccagagccaactccaggagcagagacaccccaataccctgggggaccccgaccctgatgacttcccactggaattcgccgtagagtccaccaggaccaaagaccctgcctctgcctctgtccctcactcaggacctgctgccgggcgaggccttgggagcagacttgggcttaggggacaccagtgtgaccccgaccttgaccaggacgcagacctttccttcctttcctggggcagcacagactttggggtctgggccaggaggaacttctggcaggtcgccaagcacagaggccacaggctgaggtggccctggaaagacctccaggaggtggccactccccttcctcccagctggaccccatgtcctccccaagataagggtgccatccaaggcaggtgctccttggagccccattcagactcctccctggaccccactgggcctcagtcccagctctggggatgaagccaccacaagcacaccaggcagcccaggcccagccaccctgcagtgcccaagcacacactctggagcagagcagggtgcctctgggaggggctgagctccccaccccacccccacctgcacaccccacccacccctgcccagcggctctgcaggagggtcagagccccacatggggtatggacttagggtctcactcacgtggctcccatcatgagtgaaggggcctcaagcccaggttcccacagcagcgcctgtcgcaagtggaggcagaggcccgagggccaccctgacctggtccctgaggttcctgcagcccaggctgccctgctgtccctgggaggcctgggctccaccagaccacaggtccagggcaccgggtgcaggagccacccacacacagctcacaggaagaagataagctccagacccccagggccagaacctgccttcctgctactgcttcctgccccagacctgggcgccctcccccgtccacttacacacaggccaggaagctgttcccacacagaacaaccccaaaccaggaccgcctggcactcaggtggctgccatttccttctccatttgctcccagcgcctctgtcctccctggttcctccttcgggggaacagcctgtgcagccagtccctgcagcccacaccctggggagacccaaccctgcctggggcccttccaaccctgctgctcttactgcccacccagaaaactctggggtcctgtccctgcagtccctaccctggtctccacccagacccctgtgtatcactccagacacccctcccaggccaaccctgcacctgcaggccctgtcctcttctgtcgctagagcctcagtttctcccccctgtgcccacaccctacctcctcctgcccacaactctaactcttcttctcctggagcccctgagccatggcattgaccctgccctcccaccacccacagcccatgccctcaccttcctcctggccactccgaccccgccccctctcaggccaagccctggtatttccaggacaaaggctcacccaagtctttcccaggcaggcctgggctcttgccctcacttcccggttacacgggagcctcctgtgcacagaagcagggagctcagcccttccacaggcagaaggcactgaaagaaatcggcctccagcaccttgacacacgtccgcccgtgtctctcactgcccgcacctgcagggaggctccgcactccctctaaagacaagggatccaggcagcagcatcacgggagaatgcagggctcccagacatcccagtcctctcacaggcctctcctgggaagagacctgcagccaccaccaaacagccacagaggctgctggatagtaactgagtcaatgaccgacctggagggcaggggagcagtgagccggagcccataccatagggacagagaccagccgctgacatcccgagctcctcaatggtggccccataacacacctaggaaacataacacacccacagccccacctggaacagggcagagactgctgagcccccagcaccagccccaagaaacaccaggcaacagtatcagagggggctcccgagaaagagaggaggggagatctccttcaccatcaaatgcttcccttgaccaaaaacagggtccacgcaactcccccaggacaaaggaggagccccctatacagcactgggctcagagtcctctctgagacaccctgagtttcagacaacaacccgctggaatgcacagtctcagcaggagaacagaccaaagccagcaaaagggacctcggtgacaccagtagggacaggaggattttgtgggggctcgtgtcactgtgaggatattgtagtggtggtagctgctactcccacagtgacacagacccattcccaaagccctactgcaaacacacccactcctggggctgaggggctgggggagcgtctgggaagtagggtccaggggtgtctatcaatgtccaaaatgcaccagactccccgccaaacaccaccccaccagccagcgagcagggtaaacagaaaatgagaggctctgggaagcttgcacaggccccaaggaaagagctttggcaggtgtgcaagaggggatgcaggcagagcctgagcagggccttttgctgtttctgctttcctgtgcagagagttccataaactggtgttcaagatcagtggctgggaatgagcccaggagggcagtctgtgggaagagcacagggaaggaggagcagccgctatcctacactgtcatctttcaaaagtttgccttgtgaccacactattgcatcatgggatgcttaagagctgatgtagacacagctaaagagagaatcagtgagatgaatttgcagcatagatctgaataaactctccagaatgtggagcagtacagaagcaaacacacagaaagtgcctgatgcaaggacaaagttcagtgggcaccttcaggcattgctgctgggcacagacactctgaaaagccctggcaggatctccctgcgacaaagcagaaccctcaggcaatgccagccccagagccctccctgagagcgtcatggggaaagatgtgcagaacagctgattatcatagactcaaactgagaacagagcaaacgtccatctgaagaacagtcaaataagcaatggtaggttcatgcaatgcaaacccagacagccaggggacaacagtagagggctacaggcggctttgcggttgagttcatgacaatgctgagtaattggagtaacagaggaaagcccaaaaaatacttttaatgtgatttcttctaaataaaatttacaccaggcaaaatgaactgtcttcttaagggataaactttcccctggaaaaactacaaggaaaattaagaaaacgatgatcacataaacacagttgtggttacttctactggggaaggaagagggtatgagctgagacacacagagtcggcaagtctccaagcaagcacagaacgaatacattacagtaccttgaatacagcagttaaacttctaaatcgcaagaagaggaaaatgcacacagctgtgtttagaaaattctcagtccagcactattcataatagcaaagacattaacccaggttggataaataaatgatgacacaggcaattgcacaatgatacagacatacatttagtacatgagacatcgatgatgtatccccaaagaaatgactttaaagagaaaaggcctgatgtgtggtggcactcacctccctgggatccccggacaggttgcaggcacactgtgtggcagggcaggctggtacatgctggcagctcctggggcctgatgtggagcaagcgcagggctgtatacccccaaggatggcacagtcagtgaattccagagagaagcagctcagccacactgcccaggcagagcccgagagggacgcccacgcacagggaggcagagcccagctcctccacagccaccaccacctgtgcacgggccaccaccttgcaggcacagagtgggtgctgagaggaggggcagggacaccaggcagggtgagcacccagagaaaactgcagaagcctcacacatccacctcagcctcccctgacctggacctcacctggtctggacctcacctggcctgggcctcacctgacctggacctcacctggcctgggcttcacctgacctggacctcacctggcctccggcctcacctgcacctgctccaggtcttgctggaacctgagtagcactgaggctgcagaagctcatccagggttggggaatgactctggaactctcccacatctgacctttctgggtggaggcatctggtggccctgggaatataaaaagccccagaatggtgcctgcgtgatttgggggcaatttatgaacccgaaaggacatggccatggggtgggtagggacatagggacagatgccagcctgaggtggagcctcaggacacagttggacgcggacactatccacataagcgagggacagacccgagtgttcctgcagtagacctgagagcgctgggcccacagcctcccctcggtgccctgctgcctcctcaggtcagccctggacatcccgggtttccccaggcctggcggtaggtttgaagtgaggtctgtgtcactgtggtattatgattacgtttgggggagttatcgttatacccacagcatcacacggtccatcagaaacccatgccacagccctccccgcaggggaccgccgcgtgccatgttacaattttgatcgaggacacagcgccatgggtatggtggctaccacagcagtgcagcccatgacccaaacacacagggcagcaggcacaatggacaggcctgtgagtgaccatgctgggctccagcccgccagccccggagaccatgaaacagatggccaaggtcaccccacagttcagccagacatggctccgtggggtctgcatcgctgctgccctctaacaccagcccagatggggacaaggccaaccccacattaccatctcctgctgtccacccagtggtcccagaagcccctccctcatggctgagccacatgtgtgaaccctgagagcaccccatgtcagagtaggggcagcagaagggcggggctggccctgtgcactgtccctgcacccatggtccctcgcctgcctggccctgacacctgagcctcttctgagtcatttctaagatagaagacattcccggggacagccggagctgggcgtcgctcatcctgcccggccgtcctgagtcctgcttgtttccagacctcaccagggaagccaacagaggactcacctcacacagtcagagacaaagaaccttccagaaatccctgtctcactccccagtgggcaccttcttccaggacattcctcggtcgcatcacagcaggcacccacatctggatcaggacggcccccagaacacaagatggcccatggggacagccccacaacccaggccttcccagacccctaaaaggcgtcccaccccctgcacctgccccagggctaaaaatccaggaggcttgactcccgcataccctccagccagacatcacctcagccccctcctggaggggacaggagcccgggagggtgagtcagacccacctgccctcgatggcaggcggggaagattcagaaaggcctgagatccccaggacgcagcaccactgtcaatgggggccccagacgcctggaccagggcctgcgtgggaaaggccgctgggcacactcaggggctttttgtgaaggcccctcctactgtgtgactacggtgactaccacagtgatgaaactagcagcaaaaactggccggacacccagggaccatgcacacttctcagcttggagctctccaggaccagaagagtcaggtctgagggtttgtagccagaccctcggcctctagggacaccctggccatcacagcggatgggctggtgccccacatgccatctgctccaaacaggggcttcagagggctctgaggtgacttcactcatgaccacaggtgccctggccccttccccgccagctacaccgaaccctgtcccaacagctgccccagttccaacagccaattcctggggcccagaattgctgtagacaccagcctcgttccagcacctcctgccaattgcctggattcacatcctggctggaatcaagagggcagcatccgccaggctcccaacaggcaggactcccgcacaccctcctctgagaggccgctgtgttccgcagggccaggccctggacagttcccctcacctgccactagagaaacacctgccattgtcgtccccacctggaaaagaccactcgtggagcccccagccccaggtacagctgtagagagactccccgagggatctaagaaggagccatgcgcagttctgccgggaccctcggccaggccgacaggagtggacactggagctgggcccacactgggccacataggagctcaccagtgagggcaggagagcacatgccggggagcacccagcctcctgctgaccagaggcctgccccagagcccaggaggctgcagaggcctctccagggggacactgtgcatgtctggtccctgagcagccccccatgtccccagtcctgggggcccctggcacagctgtctggaccctccctgttccctgggaagctcctcctgacagccccgcctccagttccaggtgtggttattgtcagggggtgtcagactgtggtggatacagctatggttaccacagtggtgctgcccatagcagcaaccaggccaagtagacaggcccctgctgtgcagccccaggcctccagctcacctgcttctcctggggctctcaaggtcactgttgtctgtactctgccctctgtggggagggttctctcagtgggaggtctgttctcaacatcccagggcctcatgtctgcacggaaggccaatggatgggcaacctcacatgccgcggctaagatagggtgggcagcctggcgggggacagtacatactgctggggtgtctgtcactgtgcctagtggggcactggctcccaaacaacgcagtcctcaccaaaatccccacagcctcccctgctaggggctggcctgatctcctgcagtcctaggaggctgctgacctccagaatgtctccgtccccagttccagggcgagagcagatcccaggccggctgcagactgggaggccaccccctccttcccagggttcactggaggtgaccaaggtaggaaatggccttaacacagggatgactgcgccatcccccaacagagtcagccccctcctgctctgtaccccgcaccccccaggccagtccacgaaaaccagggccccacatcagagtcactgcctggcccggccctggggcggacccctcagcccccaccctgtctagaggacttggggggacaggacacaggccctctccttatggttcccccacctgcctccggccgggacccttggggtgtggacagaaaggacacctgcctaattggcccccaggaacacagaacttctctccagggaccccagcccgagcacccccttacccaggacccagccctgcccctcctcccctctgctctcctctcatcaccccatgggaatccggtatccccaggaagccatcaggaagggctgaaggaggaagcggggccgtgcaccaccgggcagcaggctccgtcttcgtgaacccagggaagtgccagcctcctagagggtatggtccaccctgcctggggctcccaccgtggcaggctgcggggaaggaccagggacggtgtgggggagggctcagggccctgcgggtgctcctccatcttcggtgagcctcccccttcacccaccgtcccgcccacctcctctccaccctggctgcacgtcttccacaccatcctgagtcctacctacaccagagccagcaaagccagtgcagacaaaggctggggtgcaggggggctgccagggcagcttcggggagggaaggatggagggaggggaggtcagtgaagaggcccccttcccctgggtccaggatcctcctctgggacccccggctcccatcccctcctggctctgggaggagaagcaggatgggagaatctgtgcgggaccctctcacagtggaatatccccacagcggctcaggccagacccaaaagcccctcagtgagccctccactgcagtcctgggcctgggtagcagcccctcccacagaggacagacccagcaccccgaagaagtcctgccagggggagctcagagccatgaaagagcaggatatggggtccccgatacaggcacagacctcagctccatccaggcccaccgggacccaccatgggaggaacacctgtctccgggttgtgaggtggctggcctctgtctcggaccccactccagacaccagacagaggggcaggccccccaaaaccagggttgagggatgatccgtcaaggcagacaagaccaaggggcactgaccccagcaagggaaggctcccaaacagacgaggaggtttctgaagctgtctgtatcacagtggggtatagcagtggctggtaccacagtgacactcgccaggccagaaaccccgtcccaagtcagcggaagcagagagagcagggaggacacgtttaggatctgaggccgcacctgacacccagggcagcagacgtctcccctccagggcaccctccaccgtcctgcgtttcttcaagaataggggcggcctgagggggtccagggccaggcgataggtcccctctaccccaaggaggagccaggcaggacccgagcaccgtccccattgaggctgacctgcccagacgggcctgggcccaccccacacaccggggcggaatgtgtgcaggccccagtctctgtgggtgttccgctagctggggcccccagtgctcaccccacacctaaagcgagccccagcctccagagccccctaagcattccccgcccagcagcccagcccctgcccccacccaggaggccccagagctcagggcgcctggtcggattctgaacagccccgagtcacagtgggtataactggaacgaccaccgtgagaaaaactgtgtccaaaactgactcctggcagcagtcggaggccccgccagagaggggagcagccgccctgaacccatgtcctgccggttcccatgacccccagcacccagagccccacggtgtccccgttggataatgaggacaagggctgggggctccggtggtttgcggcagggacttgatcacatccttctgctgtggccccattgcctctggctggagttgacccttctgacaagtgtcctcagaaagacagggatcaccggcacctcccaatatcaaccccaggcagcacagacacaaaccccacatccagagccaactccaggagcagagacaccccaacactctgggggaccccaaccgtgataactccccactggaatccgccccagagtctaccaggaccaaaggccctgccctgtctctgtccctcactcagggcctcctgcagggcgagcgcttgggagcagactcggtcttaggggacaccactgtgggccccaactttgatgaggccactgacccttccttcctttcctggggcagcacagactttggggtctgggcagggaagaactactggctggtggccaatcacagagcccccaggccgaggtggccccaagaaggccctcaggaggtggccactccacttcctcccagctggaccccaggtcctccccaagataggggtgccatccaaggcaggtcctccatggagcccccttcagactcctcccgggaccccactggacctcagtccctgctctgggaatgcagccaccacaagcacaccaggaagcccaggcccagccaccctgcagtgggcaagcccacactctggagcagagcagggtgcgtctgggaggggctaacctccccaccccccaccccccatctgcacacagccacctaccactgcccagaccctctgcaggagggccaagccaccatggggtatggacttagggtctcactcacgtgcctcccctcctgggagaaggggcctcatgccgagatccctgcagcactagacacagctggaggcagtggccccagggccaccctgacctggcatctaaggctgctccagcccagacagcactgccgttcctgggaagcctgggctccaccagaccacaggtccagggcacagcccacaggagccacccacacacagctcacaggaagaagataagctccagaccccagggcgggacctgccttcctgccaccacttacacacaggccagggagctgttcccacacagatcaaccccaaaccgggactgcctggcactagggtcactgccatttccctctccattccctcccagtgcctctgtgctccctccttctggggaacaccctgtgcagcccctccctgcagcccacacgctggggagaccccaccctgcctcgggccttttctacctgctgcacttgccgcccacccaaacaaccctgggtacgtgaccctgcagtcctcaccctgatctgcaaccagacccctgtccctccctctaaacacccctcccaggccaactctgcacctgcaggccctccgctcttctgccacaagagcctcaggttttcctacctgtgcccaccccctaacccctcctgcccacaacttgagttcttcctctcctggagcccttgagccatggcactgaccctacactcccacccacacactgcccatgccatcaccttcctcctggacactctgaccacgctcccctccctctcagacccggccctggtatttccaggacaaaggctcacccaagtcttccccatgcaggcccttgccctcactgcctggttacacgggagcctcctgtgcgcagaagcagggagctcagctcttccacaggcagaaggcactgaaagaaatcggcctccagtgccttgacacacgtccgcctgtgtctctcactgcctgcacctgcagggaggctccgcactccctctaaagatgagggatccaggcagcaacatcacgggagaatgcagggctcccagacagcccagccctctcgcaggcctctcctgggaagagacctgcagccaccactgaacagccacggaggtcgctggatagtaaccgagtcagtgaccgacctggagggcaggggagcagtgaaccggagcccagaccatagggacagagaccagccgctaacatcccgagcccctcactggcggccccagaacaccccgtggaaacagaacagacccacagtcccacctggaacagggcagacactgctgagcccccagcaccagccccaagaaacactaggcaacagcatcagagggggctcctgagaaagagaggaggggaggtctccttcaccatcaaatgcttcccttgaccaaaaacagggtccacgcaactcccccaggacaaaggaggagccccctgtacagcactgggctcagagtcctctctgagacaggctcagtttcagacaacaacccgctggaatgcacagtctcagcaggagagccaggccagagccagcaagaggagactcggtgacaccagtctcctgtagggacaggaggattttgtgggggttcgtgtcactgtgagcatattgtggtggtgactgctattcccacagtgacacaaccccattcctaaagccctactgcaaacgcacccactcctggggctgaggggctgggggagcatctgggaagtatggcctaggggtgtccatcaatgcccaaaatgcaccagactctccccaagacatcaccccaccagccagtgagcagagtaaacagaaaatgagaagcagctgggaagcttgcacaggccccaaggaaagagctttggcaggtgtgcaagaggggatgtgggcagagcctgagcagggccttttgctgtttctgctttcctgtgcagagagttccataaactggtattcaggatcaatggctgggagtgagcccaggaggacagtgtgggaagagcacagggaaggaggagcagccgctatcctacactgtcatcttttgaaagtttgccctgtgcccacaatgctgcatcatgggatgcttaacagctgatgtagacacagctaaagagagaatcagtgaaatgcatttgcagcacagatctgaataaatcctccagaatgtggagcagcacagaagcaagcacacagaaagtgcctgatgccaaggcaaagttcagtgggcaccttcaggcattgctgctgggcacagacactctgaaaagcactggcaggaactgcctgtgacaaagcagaaccctcaggcaatgccagccctagagcccttcctgagaacctcatgggcaaagatgtgcagaacagctgtttgtcatagccccaaactatggggctggacaaagcaaacgtccatctgaaggacaacagacaaataaacgatggcaggttcatgaaatgcaaactaggacagccagaggacaacagtagagagctacaggcggctttgcggttgagttcatgacaatgctgagtaattggagtaacagaggaaagcccaaaaaatacttttaatgtgatttcttctaaataaaatttacacccggcaaaatgaactatcttcttaagggataaactttcccctggaaaaactataaggaaaatcaagaaaacgatgatcacataaacacagtggtggttacttctactggggaaggaagagggtatgagctgagacacacagagtcggcaagtctcctaacaagaacagaacaaatacattacagtaccttgaaaacagcagttaaacttctaaatcgcaagaagaggaaaatgcacacacctgtgtttagaaaattctcagtccagcactgttcataatagcaaagacattaacccaggttggataaataagcgatgacacaggcaattgcacaatgatacagacatacattcagtatatgagacatcgatgatgtatccccaaagaaatgactttaaagagaaaaggcctgatgtgtggtggcaatcacctccctgggcatccccggacaggctgcaggctcactgtgtggcagggcaggcaggcacctgctggcagctcctggggcctgatgtggagcaggcacagagctgtatatccccaaggaaggtacagtcagtgcattccagagagaagcaactcagccacactccctggccagaacccaagatgcacacccatgcacagggaggcagagcccagcacctccgcagccaccaccacctgcgcacgggccaccaccttgcaggcacagagtgggtgctgagaggaggggcagggacaccaggcagggtgagcacccagagaaaactgcagaagcctcacacatccacctcagcctcccctgacctggacctcacctggcctgggcctcacctgacctggacctcacctggcctgggcttcacctggcctgggcttcacctgacctggacctcacctggcctcgggcctcacctggcctgggcttcacctggcctgggcttcacctgacctggacctcacctggcctgggcctcacctgacctggacctcacctggcctgggcttcacctggcctgggcttcacctggcctgggcttcacctgacctggacctcacctggcctgggcttcacctgacctggacctcacctggcctcgggcctcacctgcacctgctccaggtcttgctggagcctgagtagcactgaggctgtagggactcatccagggttggggaatgactctgcaactctcccacatctgacctttctgggtggaggcacctggtggcccagggaatataaaaagccccagaatgatgcctgtgtgatttgggggcaatttatgaacccgaaaggacatggccatggggtgggtagggacagtagggacagatgtcagcctgaggtgaagcctcaggacacaggtgggcatggacagtgtccacctaagcgagggacagacccgagtgtccctgcagtagacctgagagcgctgggcccacagcctcccctcggggccctgctgcctcctcaggtcagccctggacatcccgggtttccccaggcctggcggtaggtttgaagtgaggtctgtgtcactgtggtattactatgatagtagtggttattactaccacagtgtcacagagtccatcaaaaactcatgcctgggagcctcccaccacagccctccctgcgggggaccgctgcatgccgtgttaggattttgatcgaggacacggcgccatgggtatggtggctaccacagcagtgcagcccatgacccaaacacacggggcagcagaaacaatggacaggcccacaagtgaccatgatgggctccagcccaccagccccagagaccatgaaacagatggccaaggtcaccctacaggtcatccagatctggctccaaggggtctgcatcgctgctgccctcccaacgccaaaccagatggagacagggccggccccatagcaccatctgctgccgtccacccagcagtcccggaagcccctccctgaacgctgggccacgtgtgtgaaccctgcgagccccccatgtcagagtaggggcagcaggagggcggggctggccctgtgcactgtcactgcccctgtggtccctggcctgcctggccctgacacctgagcctctcctgggtcatttccaagacattcccagggacagccggagctgggagtcgctcatcctgcctggctgtcctgagtcctgctcatttccagacctcaccagggaagccaacagaggactcacctcacacagtcagagacaacgaaccttccagaaatccctgtttctctccccagtgagagaaaccctcttccagggtttctcttctctcccaccctcttccaggacagtcctcagcagcatcacagcgggaacgcacatctggatcaggacggcccccagaacacgcgatggcccatggggacagcccagcccttcccagacccctaaaaggtatccccaccttgcacctgccccagggctcaaactccaggaggcctgactcctgcacaccctcctgccagatatcacctcagccccctcctggaggggacaggagcccgggagggtgagtcagacccacctgccctcaatggcaggcggggaagattcagaaaggcctgagatccccaggacgcagcaccactgtcaatgggggccccagacgcctggaccagggcctgtgtgggaaaggcctctggccacactcaggggctttttgtgaagggccctcctgctgtgtgactacggtggtaactcccacagtgatgaaaccagcagcaaaaactgactggactcgcagggtttatgcacacttctcggctcggagctctccaggagcacaagagccaggcccgagggtttctgcccagaccctcggcctctagggacacccgggccatcttagccgatgggctggtgccctgcacaccgtgtgctgccaaacaggggcttcagagggctctgaggtgacttcactcatgaccacaggtgccctggtcccttcactgccagctgcaccagaccctgttccgagagatgccccagttccaaaagccaattcctggggccgggaattactgtagacaccagcctcattccagtacctcctgccaattgcctggattcccatcctggctggaatcaagagggcagcatccgccaggctcccaacaggcaggactcccacacaccctcctctgagaggccgctgtgttccgcagggccaggccgcagacagttcccctcacctgcccatgtagaaacacctgccattgtcgtccccacctggcaaagaccacttgtggagcccccagccccaggtacagctgtagagagagtcctcgaggcccctaagaaggagccatgcccagttctgccgggaccctcggccaggccgacaggagtggacgctggagctgggcccacactgggccacataggagctcaccagtgagggcaggagagcacatgccggggagcacccagcctcctgctgaccagagacccgtcccagagcccaggaggctgcagaggcctctccagggggacacagtgcatgtctggtccctgagcagcccccaggctctctagcactgggggcccctggcacagctgtctggaccctccctgttccctgggaagctcctcctgacagccccgcctccagttccaggtgtggttattgtcagggggtgccaggccgtggtagagatggctacaattaccacagtggtgccgcccatagcagcaaccaggccaagtagacagacccctgccacgcagccccaggcctccagctcacctgcttctcctggggctctcaaggctgctgtctgccctctggccctctgtggggagggttccctcagtgggaggtctgtgctccagggcagggatgactgagatagaaatcaaaggctggcagggaaaggcagcttcccgccctgagaggtgcaggcagcaccacagagccatggagtcacagagccacggagcccccagtgtgggcgtgtgagggtgctgggctcccggcaggcccagccctgatggggaagcctgccccgtcccacagcccaggtccccaggggcagcaggcacagaagctgccaagctgtgctctacgatcctcatccctccagcagcatccactccacagtggggaaactgagccttggagaaccacccagccccctggaaacaaggcggggagcccagacagtgggcccagagcactgtgtgtatcctggcactaggtgcagggaccacccggagatccccatcactgagtggccagcctgcagaaggacccaaccccaaccaggccgcttgattaagctccatccccctgtcctgggaacctcttcccagcgccaccaacagctcggcttcccaggccctcatccctccaaggaaggccaaaggctgggcctgccaggggcacagtaccctctcttgccctggctaagacagggtgggcagacggctgcagataggacatattgctggggcatcttgctctgtgactactgggtactggctctcaacgcagaccctaccaaaatccccactgcctcccctgctaggggctggcctggtctcctcctgctgtcctaggaggctgctgacctccaggatggcttctgtccccagttctagggccagagcagatcccaggcaggctgtaggctgggaggccacccctgtccttgccgaggttcagtgcaggcacccaggacaggaaatggcctgaacacagggatgactgtgccatgccctacctaagtccgcccctttctactctgcaacccccactccccaggtcagcccatgacgaccaacaacccaacaccagagtcactgcctggccctgccctggggaggacccctcagcccccaccctgtctagaggagttggggggacaggacacaggccctctccttatggttcccccacctggctcctgccgggacccttggggtgtggacagaaaggacgcctgcctaattgtcccccaggaacccagaacttctctccagggaccccagcccgagcacccccttacccaggacccagccctgcccctcctcccctctgctctcctctcatcactccatgggaatccagaatccccaggaagccatcaggaagggctgaaggaggaagcggggccactgcaccaccgggcaggaggctccgtcttcgtgaacccagggaagtgccagcctcctagagggtatggtccaccctgcctggggctcccaccgtggcaggctgcggggaaggaccagggacggtgtgggggagggctcagggccctgcaggtgctccatcttggatgagcccatccctctcatccaccgacccgcccacctcctctccaccctggccacacgtcgtccacaccatcctgagtcccacctacaccagagccggcagagccagtgcagacagaggctggggtgcaggggggccgccagggcagctttggggagggaggaatggaggaaggggaggtcagtgaagaggcccccctcccctgggtctaggatccacctttgggacccccggatcccatcccctccaggctctgggaggagaagcaggatgggagaatctgtgcgggaccctctcacagtggaatacctccacagcggctcaggccagatacaaaagcccctcagtgagccctccactgcagtgctgggcctgggggcagcccctcccacagaggacagacccagcaccccgaagaagtcctgccagggggagctcagagccatgaaggagcaagatatggggaccccaatactggcacagacctcagctccatccaggcccaccaggacccaccatgggtggaacacctgtctccggcccctgctggctgtgaggcagctggcctctgtctcggacccccattccagacaccagacagagggacaggccccccagaaccagtgttgagggacacccctgtccagggcagccaagtccaagaggcgcgctgagcccagcaatggaaggcccccaaacaaaccaggaggtttctgaagctgtctgtgtcacagtcgggtatagcagcggctaccacaatgacactgggcaggacagaaaccccatcccaagtcagccgaaggcagagagagcaggcaggacacatttaggatctgaggccacacctgacactcaagccaacagatgtctcccctccagggcgccctgccctgttcagtgttcctgagaaaacaggggcagcctgaggggatccagggccaggagatgggtcccctctaccccgaggaggagccaggcgggaatcccagccccctccccattgaggccatcctgcccagaggggcccggacccaccccacacacccaggcagaatgtgtgcaggcttcaggctctgtgggtgccgctagctggggctgccagtcctcaccccacacctaaggtgagccacagccgccagagcctccacaggagaccccacccagcagcccagcccctacccaggaggccccagagctcagggcgcctgggtggattctgaacagccccgagtcacggtgggtatagtgggagctactaccactgtgagaaaagctatgtccaaaactgtctcccggccactgctggaggcccagccagagaagggaccagccgcccgaacatacgaccttcccagccctcatgacccccagcacttggagctccacagtgtccccattggatggtgaggatgggggccggggccatctgcacctcccaacatcacccccaggcagcacaggcacaaaccccaaatccagagccgacaccaggaacacagacaccccaataccctgggggaccctggccctggtgacttcccactgggatccacccccgtgtccacctggatcaaagaccccaccgctgtctctgtccctcactcagggcctgctgaggggcgggtgctttggagcagactcaggtttaggggccaccattgtggggcccaacctcgaccaggacacagatttttctttcctgccctggggcaacacagactttggggtctgtgcagggaggaccttctggaaagtcaccaagcacagagccctgactgaggtggtctcaggaagacccccaggagggggcttgtgccccttcctctcatgtggaccccatgccccccaagataggggcatcatgcagggcaggtcctccatgcagccaccactaggcaactccctggcgccggtccccactgcgcctccatcccggctctggggatgcagccaccatggccacaccaggcagcccgggtccagcaaccctgcagtgcccaagcccttggcaggattcccagaggctggagcccacccctcctcatccccccacacctgcacacacacacctaccccctgcccagtccccctccaggagggttggagccgcccatagggtgggggctccaggtctcactcactcgcttcccttcctgggcaaaggagcctcgtgccccggtcccccctgacggcgctgggcacaggtgtgggtactgggccccagggctcctccagccccagctgccctgctctccctgggaggcctgggcaccaccagaccaccagtccagggcacagccccagggagccgcccactgccagctcacaggaagaagataagcttcagaccctcagggccgggagctgccttcctgccaccccttcctgccccagacctccatgccctcccccaaccacttacacacaagccagggagctgtttccacacagttcaaccccaaaccaggacggcctggcactcgggtcactgccatttctgtctgcattcgctcccagcgcccctgtgttccctccctcctccctccttcctttcttcctgcattgggttcatgccgcagagtgccaggtgcaggtcagccctgagcttggggtcacctcctcactgaaggcagcctcagggtgcccaggggcaggcagggtgggggtgaggcttccagctccaaccgctccactagccgagactaaggaagtgagaggcagccagaaatccagaccattccatagcaaatggatttcattaaagttaccagacttcagtgtaagtaacatgagccccatgcacaacaatcccttatgaaggggaagtcagtgtcgcctcggatttcttgaaaaacacaaaaacttatcaatgcctgtaaaagtctgttggaaagaaaatatgattcaagaatgttatgcccaacaaagctggcatattttctacccggacacactcagggaatgtggtcgcttgagtgcttctctcactgcgtaaatcctacgtggtgtttaagcatattcataaatgtgtatgtctatttttatgtgtaagatggttcatttttattttatttattcaatatgtacaataaagaatattgacaaataggctggacatggtggctcccacctgtaatcccagccctttgggaggccgaggcgggcagatcacctgaggtctggagttcgagaccagcctggccaacatgatgaaaacccatctctactaaaaatacaaagattagccaggcatggtggtgcatgcctgtaatcccagccactcaggaggctgagacaggagaaatgcgtgaacccggaaggcggaggttgcagtgagccgagatcacaccactgcactccagcctggcgacagagcaagattccatctcaaaaaaaaaagacaaagaaatttgtttttttgaataaagacaaatttcatcacacgaagataaagatgcaaagctccagacaggaaggcacggacagcacagtgaagcctggagcgggcgctggggggccaggggcatggcgggggtgccagcgtctctcagtgcctaccatggccactccagcctgtgttctcacgaggatggctgtgcaatgctaggagcgtgttcgaagctctagggcaaccactggaagtgaggctgaggagcagagcccagaggcccgtggagctgatgaaaagaaagctggagaaagtgtttgctgcctcccaacatggtaagaaaagatagaaagagagagcacacggcaaagggagcttgctgagggactctttacaatggcttgcacagagctcagggggtctgggaggctagggccctgcgcagggcagtcaccccagcctgctgaccaaggtttgctgcaggcagctctgggggtggttgaggcgcggtccctggagccacccctcaagggaacgaggcagcagagtgggccaaggcccaggtcggctgcaaggctgcccaggacttggggtccttacatcagcagccactgatgcagctggcccagagagaggcgccgagcaggttgcctccaggggacaaaccaggtcggagagggtgaggcagtggatggagccacaacaaccccgggcacgggtgacacgcacgttcatgcacatctgacccttcctccctcaccaaacaggtccccctgccttccccatggttgcgaaaaagcaaaatgtagacgttttttcttttttaattcatgttttaattgacaaatgaagccgtatatatttattgtgtacaacatgatgctttaaaatatgtatacatcgtggaacagcaacgtcgagctaatttaacacgcattacttcacatacttgtcatcttttgtggcgagaatgcttaaaatccactctcttagtattttttaagaatgcaatacattgttgtcaactgtggtcaccgtcatgcatagccaagctcccgacctcaccctcctgccagctcaggctgtgcatcctttcaccagcatcccccaccccggcccctggccctggtaactaccactctatactctacgtatgagttcagctttttaagattccacagatgaatgagatcatacagtatttgctttctatgcctggcttattttagttaacacactgtcctccagatccatccgttgttgcaaatgacagggtttcattctttttaaagtctaaagagtattccattgtgtcaatggacctcatttgctttatccatgcatcaactatggacatttaggttgattccatttcttagctgttgtggatggtgctgcagtaaacatggggctgcagatgtctcttcaacatactgacatcatgtcctttggataaatacccagtagtgggatcgctggatcacaatgtacagttttttttttaatggaaactttcattttttggtgaaattaggaaaacagataaaacccacagaatccaaaatatatgtgaagatgccaaaaacagttgacattgggcagaggtcacatggaaggaagtgaatacatgacggggtgtgagggcccagaggcagctgaaatacgctttctaaacacaaggacctcttctgagagggcagaagttttatcctgcacatgcaatgaccagcacagctaaaatacactttctaaacatgaggacctcttctgagagggcagctttatcctgcaaatgcaatgaccagcacaggacccagaataaagagagttgccagcggacgcctggtgtccatgtgtccaggtgagttcgagatgcggacggcgctggccagccagtcacaccctaagtcaatctgctgcatgcatttgtccttgccacagcagaaaacgagaaagcctttgggctgcaaagcttcacaggctcctcttctcccgactccatggaaacagctacaaagagcaggcccagtagagcttaattcatgaaaatgagtaataaacttgaactggaacagtatcgactttttagaaacggcagcaaagtgtataaaaaatattcaccagaacaatatttccaaacgatgagatgagaatttcagccaagtaatcctccatggatagaaaataatgaagggattggatttatgaaggaaaatcatggagctcaaatacaagagaagagaatcaaaaatgaacaggaggagataaaatatggtttggccaaagttacaaaataaattttttaaaaacccttcatcatggcaagtagaaagagcgagaggaaaaacagatcccgtggaagacacaaataggacatggggagaaaaatgaatgagatgaaacagagcagaaataaaattttacggaactaaagacaagtgatctgaacctgcctggggcctgggggacctcgccaccctgaagggaaagaacatgcctggctggctttgccacctgctcattgcagagccccacagcttgcaacaaacataggcggtagccagggagtggttacagcaggccttgagcaagacccagtgttgtgctgacttcaggtctgacccagcactgtcatagtggtggtgtccatagtggtagtgggggtgcttgtgtcactccacccccatctccaggaggctcagaacagacagagagagactccatttgtttgggagaaagtaagggatgagaacaagagtctctgcctggtaatccagagaattattctagatcttggccaagattatcaaagcagtacctctatgagtcttttgggcttggagtccccctaaagcagatatagctaagatcacaacacccaagtccttttgaatatgtgggaagacttcccaaggacaggagcaaacaaacaagcccagactgcaaaaaaacaagcccagactgcaataaacacctcactcttcaatgcccaggcactgaagaacatctcctagcagcaacaccatccaggaaaacatggcctcaaccagtgaactaaataaggcaccagggaccagtctcggagaaatagaggtatgttatctttcagagaattcaaagtagctttgttgaggaaactcaaagaaattcaagataacacagtgaaggaattcagaatcctatccgataaatttaacagagattgaagcaattaaaaagaattaagcagaaattatggagctgaaaaatgcaattggcatactgaaaaatgcatcagagtattttcatagcctcatatatcaagtagaagaaagaattagtgagcttgaaaacaggctatttggaaaagcacgataaaaggagacaaaagagaaaagaataaataacaatgaagcatatctacaggatctagaaaatagcctcaaaaggccaaatctaagaattattagccttaaagaggaggtagagaaagagggatggagagtttattcaaagggataataacagaaaacttcccaaacctagagaaagatatcaatatccaaatgcaagaaggatgtagtacaccaaggagatttaatgcaaagaagactacctcaaggcattcaatactcaaactcccatatgacaaggactttaaaaagatcctaaaagcagcaaaagaaaagaaatgaataaaatactatggagctccaatatgtctggcagcagacttttcagtgaagactttatatgccaggagagagtgtcataatggatttaaagtgctgaaggaaaaaacttttaccctcgaacagtatagctggtgaaattatccttcaaacatgaaggagaaataatttgtttccagacaaatgttgagggatttcatgaacaccagacctgtcttttaagaaatgctaaagggagtacttcaatcagaaagaaacacgttagtgaacaataagaaatcatctgaaggcacaaaactcaccggtaatagtaagtacacagaaaaacacagaatattataacactgtaactgtggtgtgtaaactccttttgtttgtttgtttgtttgtttgtttgtttgtttttgtttttagacggagttttgctccagcccaggctggagtgcaatggcacaatctcagctcactgcaacttccacctcctgggttcaagcaattctcctgcctcagcctcccaagtagctgggattacaggcatgtgctaccatgtccagctaattttgtattttagtagagacggtgtttcaccatgttggtcaggctagccttatcttgagtagaaaaactaaatgatgaagcaatgaaaaataataactacaacttttcaagacatagtacaataagatataaatcataacaaaaagttaaaaggtggagggatgaagttaaggcatagagtctttattagttttctttttacttgtctgtttatgcaaacagtgttaagttgtcatcagtttaaaataatgggtcataagatactatttgcaagcctcatggtaacgtcaaaccaaaagcaatacaacagatacacaaaaaacaaaaagcaagaagctaaattacgtcatcagagaaaatcaccttcactaaaaggaagacggagaaaagaatgaagagagagaagaccaaaagcaaatagcaatatggcaggagtaagtccttacttatcaataataccattgaatgtaaatggactaaactctccaatcaaaagacatagagtggctgaatcaattaaagaaaaaacaagacccattgatctgttgtccacaagaaacacactttatctataaagacacacatagactgaaaacaaagggatggaaaaagatactccacgccaatggaaaccaaagaaagagcaggagtagctacacttatatcaggcaaaatagatttcaagacaaaaactataagaagagacaaggtcactaatgataaacaggtcaattcagcaagaggatataacaattgtaaatatatatgcacccaatgctggagcacccagatatataaagcaagtatttactagagctaaagagagaaatagactccaatgcaataatagctggagatttcaacatcccactttcaacattgaacagatcctccagatagaaaatcaacaaagaaatattggacttaatctgcactatcgaccaaatggatctaacagatatttacagaacatttcatccaacagctgcagaacacacattcttttcctcagcacatagatcattctcaaggatagaccatatgttgggtcacaaaacaagttttaaaatattcaaatacattgaaataatatcaagcatcttctgtgaccacaatggactaaaactagaaatcaataacaagaggaattttggaaactatataaatatatggaaattaatgaatgctgagtgggtcaatgaagcaattaagaaggaaactgaaatttttcttggaacgaatgatcatggaaacagaaaataccaaaacctatgggatacagcaaaagcagtactaagagggaagtttacagctacaaatgcttacattaaaaaagaagaaaaacttcaataaaaaaacctaacaatgcatcttaaagaactagaaaagcaagaggaaatcaaatccaaaattagtagaagaaaacagtaaaggtcagagcagaaataagtaaaattgaaatgaagaaaacaatacaaaagatcaataaaacaacaggttgttttcttgaaaagttaaacaaaattgacaaacctttagccagactaagaaaaaaagacagaagatccaaataaataaaatcagagatgaaaaaggtgacattacaacttacaccacagaaattcaaaggatcattagtggctactataagcaactatatgccaataaattggaaaatctagaagaaatgcagaaattcctagacacatacaacctcccaagattaaaccaagaagaaattcaaaacctgaacagactgataacaagtaatgagatcaaagccgtaataaaaagcctcccagtaaagagaagcccaggacccgacggcttcactgctgaattctaccaaacatttaaagtagaactaataccaatcctactcaaactattccaaaaaatagaggtggaaggaatacttcaaaactcattatacgaggccagtattaacctgacaccaaaactagacaaagacacatgaaaaaaagaaaactacaggccaatatgtctgatgaatattgacacaaaaatcctcaacaaaatactagcaaaccaaattcaactacacattagaaagttcactcatcatgaccaagtggaatttatctaacttgggatgcaaagatggttcaacatatgcaaatcaatcaatgtgatacatcatatcaacagaatgaacaacaaaaaccatttgatcatttaattgatactgaaaaagcatttgataaaattcaacattccttcataataaaaattctcttctatactaggtacaaaagaaacttacctcaacataataaagccatatatgacagtcccacagtatgatactaaatgaggaaaaactgagagcctttcctctacgatctggaacatgacaaagatgcccactttcatcactgttattcaacatagtactggaagtcctagctggagcgatcagacaagagaaagatataaaaggcatccaaattggaaaggaataagtcaaattatcctcatttgcatatggtatgatcttctatttagagctaactaaagactccaccaaaaaaagttattagaactgacgaacaaattcagtaaagctgcaggatacaaaatcaacatacaaaaatcagtagcatttctatatgccaacaatgaccaatgtgaaaaagaaattaaaaagtaaccctatttacaataaccacaaataaacacctaggaattaaccaaagaggtaaaagatttctgtaatgaaaactataaaacactgatgaaagaaattgaagagtacaccaaaaaatggaaagcaattgcatgttcatggattagaagaatcagtgttgttataatgtccatactatccaaagcaatctacagattcaatgcaatccttatcaaaataccaatgacatcattcacagaaatagaaaaaaaaaatcctaaaatttacgtggaaccacaaagacccagaatagccaaagctctcctaagcaaaaagaacgaaactgtaggaatgacattgcctgtcttcaaattctactacagagctatagatagtaaccaaaacagcgtggtactagcataaaaacagacacagagacaaacagaacaaaatttaaaaacccagaaataaatccacacacctacagcaaattcatttttgacaaagttgccaagaacatactctggggaatagataatgatatctcttcaataaataatgtggggaaaactggatatccatatacataacagtgaaactagacccctctctctctcactatatacaaaaatcaaatcaaaattgtttaaggacttaaatctaagacctcatactatgaaaccactgcaagacaaccttggcggaaactctccaagacatcagtccaggcaaagatttcttgagtaatatcccacaagcacagacaaccaaagcaaaaatggacaaatgggatcacatcaagttaaaaagcttctgcacagtaagggaaacaaccaacaaaatgaagagacaacccacagaatgggagaaaatatttgaaaaatacccatctggcaagggattaaaaaccagaatatatgcagaatatataaggagctcaaacagtgctatagaaaaaaaaatctaataatctgatttaaaaatgggaaaaatgttagaatagacatttcttaaaataagacatacagatggcaaaccgacatggaacggtgctcaacatcatggattatcacagaaacacaatcaatcaaaactaaaactaaaatgtgctatcatctcaccccagttaaaatggctgatatccagaagacaggcaataacaaatgctggcaaggatgtggggaaaagggagcccccatacactgttgctgggattgtaaattagtacaaccactgtggagagcagcatgaaagttcctcaaaaaactgaaagaaagctaccataggatccagcaatcccactgctgtgtatatactacaaaagaaaggaagtcagtatatgaagaggtatctgcactcccatgtttgttgcagccctgttcacaacagccaagatttggaagcaacctaagtgtccatcagcagttgaatgtataaagaaaatgtggtgcatatacacaatggagtattattcaataataaaaaggaatgagattgagtcatttgcaacaacatggatggaactggagatcattatgtgaagtgaaataagccaggcacagaaagacaaacattacaatgttcttacttattaatgagatctaaaaatcaaaacaattgcacccatgttcataaagagtaaaaggatggttaccagatgctgagaacggtggtggggggatagggaaaggtggcagtggttaacgggtacaaaaaaatagaaagaatgaataagacttactacttgatagcacagcaaggtggctatagtcagtaatttagttgtatatttttaataatgaaaggtgtataattggattgtttctaacacaaaggataatgcttaagaggatggataccccattttccatgatgtgattatttcacattgcacgcctagatcaaaacatccaatgtaccccataaatatatacatcttctatgtacccataaaaattctgtaaaataaaatatataaaaagaggtgacagatatggaagacaggcaaagaagagacgacatccacataatccgagtacctaagaaagaatggagtccagtgcatctcaggagccaccattctaagccaattttctctggttctctcagtcaccctaccaatacgtgggcaatcttgttttatttcaggatagagtttttgaaattatagatttaagtatgctttctgttctattacttttggtaattaattttagaaagaactaatttgggcacaaatttgaaaaaattctaaatccaaaaaaaaaaagaaaaaaacacacacacaatcatctataagggggatgatgaccagtcctagatttctcaccagccacattcaagatcagtaaatggtaggacaaaacctgtagggtccttaagggggaaagaagtagtggatagtccagagtctatatacagccaactgttcttgaagaaaaaaggctgctgaaaaggagttccaaacattctataatccataatctcatgatgaaactactagaggaagaccaccagccatcaaaaggtgcttggagaacccagggccaagaaccaaaagtaaatattaagtgtccttaactgcgagactaagatagaaatgactgtgggggaccatgtggcctcaacagaggtgaaatggtgtctgcctgacaaagtggacattttacaatgatcaaaacacagaatatgagatagagagcacttctgaattactgcctcactccaaataactctcagccaaaggacttcagtaaaaccaaattgggcatattagacagtacaaacaaattctaagaaaataatattactgattacaatcacatgatgctagagatggaggggaaaaggaagaggaaaccaggtaatttcatactcgtatatagtaaagaactaaagtacattgtccaaagaagaacaaagaatattttggaaagttataaaggtagccactacacatagaagatagcaaagaacaagaaaacttaagatggaaaactttttggaagcataaaaatagaaaatataaactactaagataagattgaagccaaacagatctatgaaaacaacaaacatcaatggccttaacttgcctattaaaaggaagagactttcaaattggaccacaagataaaacccaactctatatagcatatgagtattacacacaaaatgggaaaagctgaaaaaacttgggcaaaattcaccccaagcaaattccactgtttcctttgggacaaaatgccaagctccatgccagggaagatgattctcctcagaccttctcctcactctcccagtcctcttagggaaggaattgggtgttagaggagggagactctgtcgattatcagctgaagcagtggtgtgctcctgcgttgcttctgacctgggaaatgaagcagcaagactctttctgctgtgtctttgcccagaagggccatccccccagagcagagtacccaggccggcaggagcagtggtggaagcgtggaaaccacgtctcctacagcagagaccatcagaagcggagcctcgggtataagggaaacaacgcgttctccctaacctgggagtgacagacagcgtcattcctcacagtgataccctgtgttctagccatctggcccatgacagagccagcccagagccagcccagagccagcccctcaccaacctggagcctggccagctcgccaagctgcaccataggcctggaaggcgtggagacctgcggcagtgccctgtcctcccgtgaggcctgccatccctgccaggggtcgcctctggcttctccttctccaggaccgcacggtccagaggctcagtgcctggagtaggtgttgcccccctgcttctaggcccagaccctcccttgttcctgaccccgggcctttccctctggcttggacatccagggccctgtctcagctggggagctgctcctgctcaaggactgtcttccgcgggatcgaaaggccgcgtcctgaacaatgcgtgggccacgtgagcggagcaggctctaaaggccgcgtcctaaacagtgcgtgggccacgtgagcggagcaggctctaaaggccgcgtcctaaacagtgcgtgggccacgtgagcggagcaggctctaaaggccgcgtcctaaacagtgcgtgggccacgtgagcggagcaggctctaaaggccgcgtcctaaacagtgcgtgggccacgtgagcggagcaggctctaaaggccgcgtcctaaacagcgcgtgggccacgtgagcggagcaggctctaaaggccgcgtcctaaacagtgcgtgggccacgggagcggagcagactctaaaggccgcgtcctaaacagtgtgtgggccacgtgagcggagcgccctctccactgccctcggggccgcagctcccagctcagctcccagccctgctcagggcagccaggccaggaggtaccatccaggctaagtgaccctcaggggggacaggtgccccaggagatgccagctgttgggagaggctgggggaccaactcgacctggcctgtgggccctgccctggccacccattgtaggatccagccgccacgcctgtgacactcgtgtgctttccctggtgtgtgcttgtggcaggtgggggcagagggtcctcaggccagagagccactcccccagcgccagaccaccctcttcctcactcccccacctcaccccctcacaggtgcctcccaggccatcagggcccaaccacccctaaacaaatgggttctcggcccctcgtggctggaggtgggttctctcaccattcccagcctaagactccatccccatgctggcagctgttcaaccatgtctagagagatccactgtcccagacagcacctcagggtcccccgtcctgcctggaaccctgtaggaaactccacaaaccgccgccattctgtccacacccctacaggagccccaaccctctccccacatccaggcttccctcccagacccctcatccctgcccgcacggtgcctgagggggccttcttgggcagcgcctaagcaagcccccagcacccttcggccccttcaaggcacacaggccccctttccacccagcctcaggaaaccacctgtgtcctccaacgacaggtcccagcctcccagcctttgccttgcctgttcctctccctggaactctgccccgacacagaccctccccagcaagcccgcagggcacctcccctgcccccagacaccctgtgcccatcagttcatccccagcagaggccctcaccaggcacacccccatgctcacacctggccgcaggcctcagcctccctgagggccccacccagcccgcgtctggccagtggtgcgtgcaaagcccctcacccagactcggcggaaggcagccagtgcaggcctggggaggggctctccttagaccaccttgcaccttccctggcacccaccatgggaagagctgagactcactgaggaccagctgaggctcagagaagggacccagcactggtggacacgcagggagcccacgccagggcgccgtggtgagtgaggcccagtgccacccactgaggcctcccgttcagtgggacgacggtgaacaggtggaaccaaccaggcaacccccgccgggccccacagacgggatcagagcaggaaaggcttcctgcccctgcaggccagcgaggagccctggcgggggccgtggccctccaggcgaggaggctcccctggccaccgccacccgggcctctctgctgctgggaaaacaagtcagaaagcaagtggatgagaggtggcgtgacagacccagcttcagatctgctctaatttacaaaagaaaaggaaaaacacacttggcagccttcagcactctaatgattcttaacagcagcaaattattggcacaagactccagagtgactggcagggttgagggctggggtctcccacgtgttttggggctaacagcggaagggagagcactggcaaaggtgctgggggcccctggacccgacccgccctggagaccgcagccacatcagcccccagccccacaggccccctaccagccgcagggttttggctgagctgagaaccactgtgctaactggggacacagtgattggcagctctacaaaaaccatgctcccccgggaccccgggctgtgggtttctgtagcccctggctcagggctgactcaccgtggctgaatacttccagcactggggccagggcaccctggtcaccgtctcctcaggtgagtctgctgtctggggatagcggggagccaggtgtactgggccaggcaagggctttggcttcagacttggggacaggtgctcagcaaaggaggtcggcaggagggcggagggtgtgtttttgtatgggagaagcaggagggcagaggctgtgctactggtacttcgatctctggggccgtggcaccctggtcactgtctcctcaggtgagtcccactgcagccccctcccagtcttctctgtccaggcaccaggccaggtatctggggtctgcagccggcctgggtctggcctgaggccacaccagctgccatccctggggtctccgccatgggctgcatgccagagccctgctgtcacttagccctggggccagctggagcccccaaggacaggcagggaccccgctgggcttcagccccgtcagggaccctccacaggtagcaagcaggccgagggcagggacgggaaggagaagttgtgggcagagcctgggctggggctgggcgctggctgttcatgtgccggggaccaggcctgcgctttagtgtggctacaagtgcttggagcactggggccagggcagcccggccaccgtctccctgggaacgtcacccctccctgcctgggtctcagcccgggggtctgtgtggctggggacagggacgccggctgcctctgctctgtgcttgggccatgtgacccattcgagtgtcctgcacgggcacaggtttgtgtctgggcaggaacagggactgtgtccctgtgtgatgcttttgatatctggggccaagggacaatggtcaccgtctcttcaggtaagatggctttccttctgcctcctttctctgggcccagcgtcctctgtcctggagctgggagataatgtccgggggctccttggtctgcgctgggccatgtggggccctccggggctccttctccggctgtttgggaccacgttcagcagaaggcctttctttgggaactgggactctgctgctggggcaaagggtgggcagagtcatgcttgtgctggggacaaaatgaccttgggacacggggctggctgccacggccggcccgggacagtcggagagtcaggtttttgtgcaccccttaatggggcctcccacaatgtgactactttgactactggggccagggaaccctggtcaccgtctcctcaggtgagtcctcacaacctctctcctgctttaactctgaagggttttgctgcatttctggggggaaataagggtgctgggtctcctgccaagagagccccggagcatcctggggggctcaggaggatgccctgaggcaacagcggccacacagacgaggggcaagggctccagatgctccttcctcctgagcccagcagcacgggtctctctgtggccagggccaccctaggcctctggggtccaatgcccaacaacccccgggccctccccgggctcagtctgagagggtcccagggacgtagcggggcgccagttcttgcctggggtcctggcattgttgtcacaatgtgacaactggttcgacccctggggccagggaaccctggtcaccgtctcctcaggtgagtcctcaccaccccctctctgagtccacttagggagactcagcttgccagggtctcagggtcagagtcttggaggcattttggaggtcaggaaagaaagccggggagagggacccttcgaatgggaacccagcctgtcctccccaagtccggccacagatgtcggcagctggggggctccttcggctggtctggggtgacctctctccgcttcacctggagcattctcaggggctgtcgtgatgattgcgtggtgggactctgtcccgctccaaggcacccgctctctgggacgggtgccccccggggtttttggactcctgggggtgacttagcagccgtctgcttgcagttggacttcccaggccgacagtggtctggcttctgaggggtcaggccagaatgtggggtacgtgggaggccagcagagggttccatgagaagggcaggacagggccacggacagtcagcttccatgtgacgcccggagacagaaggtctctgggtggctgggtttttgtggggtgaggatggacattctgccattgtgattactactactactactacatggacgtctggggcaaagggaccacggtcaccgtctcctcaggtaagaatggcctctccaggtctttatttttaatctttgcctatggagttttcagagtattgcatactaaccccggagatgtgtcaagctggccgggagaagctagggactaaactgcctaggggatctcagagccttggggataaactaagaatctctttgatggtgttggtagagtccctaaatgatggagcagggattttggagcctcatttgagggagatgctaaaaagattccatggctaaagggatagtttgggctgtggttggagattttcagtatttagagtaatagtgttagctgagaaatataattcaggaccctctgagacagcatctgtacagtatctgatgcacagggacaaagagtggagtgggacactttcttcagatttgtgaggaatgttctgagtagattgtttaaaacatcatttgttgaaaagagaacttttagtgaatcaatcaaggaaggaaggaaggctcagtctcaaaagggtagctgatatccagaggaatctggataagcctgcaaaagtctagctttcaaaggaatgcagaagtatgcatgtggaaaattagaagatttttttttacccttaaagtggttcctatgatagttagaatactgtgactttactatgtgagagagttttcaagtattcacttttttttttaaatgtccaagtacgaaaaaattttgtcagtttgaagtcaggtttgtacagaattgatattgttgaaagtttaaccaaagaatgggaatgaggctctttcacaccctattcagaactgacttttgacaataataaattaagtttaaaatgtttttaaacaaattgagcaatgttgagttgcagtcaagatggccgatcaggaccaggacacctgcagcagctggcaggaagcaggtcatgtggcaaggctattttgggaagggaaaataaaaccactaggtaaacttctagttgtggtttgaagaagtggttttgaaatgctctgtccagccacgcagaactgaaagtccaggctgagaaaaacaacacctggataatttgcatttctaaaataagttgaggattcagtcgaaactggaaaggtcctcttttaacttagtgagttcaatcttttaattttagcttgagaagttctagtttccctcaaacttaagtttatcgacttctaaaatatattcattttcaaaattaagttatgtaaaaaaattgaaggacttcagtgtctttaatttctaatgtatttagaaaactttttaaagttactttattattcttccctctgattattggtctctgttcaattcttttcccagtacccaaagcatttacagtgactttgttcataattttttttaagttagttgttttctgccttactattaagactttagcattctggtcgaagtggcttcataaatctttttcaaggccactttttaggagaaagacatcttttttttaatgaatgcaattatctagaattatttcagttaaacatgttagttggtggttgagaggacactcagtcagtgcagaaggtctgtaagccagtccacagagacattcctgggtgaactccctctggccctgcttcttgttggagaactggccagaggtctgagaccaggctgctgctgggaaggcctggactttggtctcccagtaccgcccagacctggggatgtatggttgtggcttctgccacccatccacctggctgctcatgaaccagccagtcttgatggctttgaaggaatgattccacacaaagactctggacctccctgaaaccaggcactgcaaacggtaagccagcggcagccacagctgtggccgctgtccttaaaccttgtaattgtttctgcttgattgagtcttaagtcattgctttaggaggagaaagagacatttgtgtcttttgagtaccattgtctgggtcactcgcatttaactttccttgaaaaacttataagagaaaaacgttgcctgttaaccattaactacagggctcgtgatactttgagaaaatcttagaaaaaaatgtatacagttgtctggaattatttcaatgaagtgtattagttggggtactggcgctgtctctacttcagttatacatgtggttttgaattttgaatctattttgtctcttcttaagcaccaagtatagatacagtggatacactcactggtttttaacggtggttttaatctagaaggaatttaaactggaggctaatttagaatcagtaaggagggacccaggctaagaaggcaatcctaggattctgaaagaaaagatggttttagtttttatagaaaacactactaccattcttgatctacaactcaagacggtctaatgaattttgaagttactggtaaatatacttcctggttgttaaggaatgattatcaaatggatcagtgcttggatctgaggtcagtgtgagaggacagggcctgggctgtggatatacagaaggaaggccacagctggatagaattgaaaaagaatggagacctgctgctgaggcaagcagatcagccggactctttccagccatagcaaagaaccagattaataaagagaaggccagattaataaagcttgctgagcaaaatttagtgaacaaggttgacagcctggctaggaagctaggctctagttaagcacagttggactgagatgtgtaggcttccctgagcccttcaaaaatgtgctaagctgagatgattactctgaggtagccaaagctggacttgagcaggaacgaggtagactgcaatgagctgaattgagctaggccggctaagctaaactaggctgacttaaccaagatagccaaattggaatgaattgtcttgatctgggctgattggagctaaactctactggactgctctgaactgagctgtgttgggctgtgttgtgctggggtgagctgagctagcatgagctactctgtggtagctggggtgagctgggatgagctgagctgggtgagctgagctgggtgagctgagctgggttagctgagctggggtgagctggggtaagctggggtgagctgagctgggtgagctgagctgggtgagctgagctgagctgggtgagctggggtaagctggggtgagctgggctgacctgaggtggttgagctgagctgggtgagcagagctgaggtgagctgagctgagctgggtgagcagagctggggtgagctgagctgagctgggctggggtgagctgagctgagctgggtgagctgagctgggtgagttgagctgagctgggtaagctgagctgagctgggtgagcagagctgggggtgagctgagctggatgagctgggctgaactggggtgagctggggtggggtgagctgggtgagctgagctgggctgagctgggctgagctggggtgagctgagctgggatgagctgggctgagctgggctgagctgagctgggctgggctgagctgagctgggctgagctgggctgggctgggctgggctgggctgggctgagctgggctgagctgggctgaactggggtgagctggggtggggtgagctgggtgagctgagctgggctgagctgggctgagctggggtgagctgggtgagctgagctgggctgagctgggctgagctgggctgagctgagctgggctgggctaagctgagctggactgagctgggctgagctgggctgagctgagctgggctgggctgggctgggctgagctgggctgagctgggctgagctgagctgggatgggctgggatgagctgaactgggtgagctgagctggggtgagatgagctgaacagggctgaactggggtgagctgagctgggatgagctggggtgagctgagctgggtgagatgagctgggtgagctgagctgagctgggctgagctgggtgagctgagctgggtgagatgagctggggtgagctgagctggggtgagctgagctgggtgagctgggctgagctgggctgggtgagctgagctgggttgagctgagctgggctgagctgggctgagctgggctgagctgggctgagctgggctgagctgagctgagctgggatgagcagggctgggatgagctgggctgagctgagctgggatgagctgggtgagctgagctggggtgagatgagctggggtgagctgagctggggtgagctgagctgggatgagctaggtgagctgagttggggtgagctgagctggggtgagctgggctgggtgaactaaactagggtgagctgggctgagctgatctggttgagctgggctgggtgagctgagctgggtgaactgagctggggtgagctgaactgagctgggtgagctggggtgagctgagctgagctgggtgaactgagctgagttgagttgggtgagctgagctgggtgagctgaactgagctggactgagctggggtgagctggggtgagctgggctggatgagctgagctgggtgagatgagctgaacagggctgaactggggtgagctgagctgggatgagctggggtgagctgagctgggtgagatgagttggggtgagctgaactgagctggactgagctggggtgagttgggctaggtgagctgaactggggtgagctgagctggggtgagatgagctgaacaggtctgaactgggatgagctgggatgagctggggtgagctggggtgagctgagttgggtgagctgagctgggtgagctgagctggggtgagctgagctgggattagctggctgagctgggatgagctgggtgagctgagttggggtgagctgagctggggtgagctgggctgggtgaactaaactagggtgagctgggctgagctgatctggttgagctgagctggggtgagctgggctgagctgggctgggtgagctgagctgggtgaactgagctggggtgagctgaactgagctgggtgagctggggtgagctggggtgagctgagctgagctgggtgaactgagctgagttgagttgggtgagctgagctgggtgagctgaactgagctggactgagctggggtgagctggggtgagctgggctgggtgagctgagctgggtgagctgagctgggctgagctggggtgagctgagctgagctgggctgggtgagctgagctgggtgagctgagctggggtgagctgagctgagctgggtgagctgggctgagctgagctgagctggggtgagctggggtgagctgggctgggtgagatgagctgtgctgggctgggtgagctgagctgggtgaactgagctgagctgagttgggtgagctgagctgggtgagctgagctgggctgagctggggtgagctgagctgagctggggtgagctggggtgagctgggctgggtgagctgagctgggtgagatgagctgtgctgggctgggtgagctgagctgggtgaactgagctgagctgagttgggtgagctgagttgagtgagctgagttgggtgagctgagctggggtgagctgaactgagctggactgagctggggtgagctgagctggctgagctgagctgggtgagctgagctgagctgagctgagctgagctgagctgggctgagctgggctgggtgagctgggctgagctgggctgggtgagctgggctgagctgggctgggtgagctaagctgggtgagctgggatgggtgagctggcctgagctgggtgagctgagctgaaaggatctgggttggagtcagctttgcttgggtgagctgagcagggtttagctgagctaggatgagttgagttggctgggctgagctgggatgaagtaggctaaataagctagcttgagctaaatagagctggggtgagctgtacttaaatgagctgtgattgaagtgggctgggatgagctcagctgaactgggctagctgatgtggatgatggtgaggctgagttaggatgagcatgactgagctggtttggacatgaatgagctggacccggctgacttgggctggttgagctttgcaagatgatgtggactaaactgggctagctggcaggatgagagaggttgaactaggctcagatgagctaggctgagcagggcttaggtgaggtggtttgggatgagctgggataagttgggctcagatgagctaccatgaactgggctgaggtggcctgggagaacatgaatcgagttgcactgagtacagccaggatgaactgggataaactgggctaaactgggttgggctaagaatggactgcctgagttatgctaagctgagctgggatgaattggggattgtcaagacttaaatgagccagactgaactggttggacttgggtgagctgaggggacctgctgcagggccggcatagctgagttgaatttagatgaggaagggtgagctagactgagcaaggctagactgcttatgctgagctacactaacctggcctgagttgggccaggctttgttggccatgtctaaactgagttaagatcaacagggagtctagaggggtaggggatgaactaagatgaattacactagctgagctgaattgagataaggtatggtaacctgagctgaactggaaagagatgtactggataaccttaactgggctgagatgagctaggtctacccaggcctggatcagcttaattagggtaggctagaccaaactgtagcagtatgtattagcctgtgccaagctgggctacattaaactaaactggacttagctaggctcagattagtttcgctactctagatggggtaagttgggccaaactgggatgaactaatttaactagcctgagatgggcagatctgaagtgtagcaaacacagccagggtgaactgaatgagtttgaccaggcctggaccagttaggctaaggaccttgtcctgggcagaccgtgtgctatggtggagtttcatgatgatgccataagagttcccccaccataacccacgtttctcctaccccatatacctgtctggtgtgtaaacctaatctttgtgtgctgatacagaagcctgagcccatcccccttccaccaccacctacctattgctttggaatgagcaaggttatctcagcgaatgtctcaaagggaagccgggacctaggcctgtccctgagagcagatgttcatgcccctggagtggctgccggtggctgaagggccagaaccacctactctagaggcatctctcgctgtctgtgaagtcttccaaagacattcctgtggttagaaggcagccctgctgtggctctgtcccatagaccaaacttacctactatctagtcctgccaaccttaagagcagcaacatggagacagcagagtgtagagagatctcctgactggcaggaggcaagaagatggattcttactcgtccatttctcttttatccctctctggtcctcagagagtcagtcctccccaactgtcttccccctcgtctcctgcgagagccccctgtctgatgagaatttggtggccatgggctgcctggcccgggacttcctgcccagctccatttccttctcctggaactaccagaacaacactgaagtcatgcagggtgtcagaaccttcccaacactgaggacaggggacaaatacacagctacctcgcaggtgttactgtccgccaaaaatgtccttgaaggttcagatgaatacttggtatgcaaaatccaccatggcaacaaaaacaaagatctgcatgtgccgattccaggtaagaaccaacccttcccgaggggatggggagagggggcaggcccaggcatggcccagagggagcagtggagtgggtcttaagccagcctgagctcacacctcaacctttcattccagctgtcgttgagatgaaccccaatgtgagtgtgttcattccaccacgtgatgccttctctggccctgcaccccgcaagtccagactcatctgcgaggccaccaacttcagtcccaaacagatcacagtatcctggctacaggatgggaagcctgtgaaatctggcttcaccacagagccagtgactgtcgaggccaaaggatccagaccccaaacctacaaggtcataagcacactgaccatcactgaaagcgactggctgaacctgaatgtgttcacctgccgcgtggatcacaggggtctcaccttctggaagaacgtgtcctccacatgcgctgccagtgagtagcctgtgctaagcccaatgcctagccctcccacattagagcagtcctcctacggttgtggccaatgccacccagacatggtcatttgcttcttgagccttggcttccaacagtggccaaggccaaggatgagcagtaggcagcagggggatgagagtcagatggagggaatcagcatcttcccttaagcagatttggaagatggagactgagcttttatccaacttcacaactagacacatcacaacctaacacagtgttctcttgactgcaggtccatctacagacatcctagccttccccatccccccctcctttgctgacatcttcctcaccaagtctgctaagctgtcctgtctggtcacaaacctggcaacctatgacaccctgaatatctcctggtcttccaaaagtggtgaaccactggagaccaacactaaaatcatggaaagtcaccccaatggcaccttcagtgctgtgggtgtggctagtgtttgtatggaagactgggataacaggaaggaatttgtatgcactgtgactcacagggacctgccttcaccacagaaaaaattcatctcaaaacccaatggtaggtatccccctttccttcccctccaattccagagcataccctgtacctcacagggagggcaggtccccttctaccctatcctcactattatctttgcttacagaggtggccaaacatccacctgctgtgtacctgctgccgccagcccgtgaacaactgatcctgagggagtcggccacagtcacctgcctggtgaagggtttctctcctgcagacatctttgtacagtggcttcagagagggcaacccttgtcctcagacaagtatgtgaccagtgccccaatgccagagcctggggctccaggcctgtacttcacccacagcatcctgactgtgacagaggaggaatggaactccggagagacctacacctgtgttgtaggccacgaggccctgccacacatggtgaccgagaggaccgtggacaagtccactggtaaacccacactgtacaatgtatcgctgatcatgtctgacacaggtggcacctgctattgaccatgctagcgctcaaccaggcaggccctgggggtcgagttgctctgtgtatgcaaactaaccatgtcagagtgagatgttgcattttataaaaattagaaataaaaaaaaatccattcaaatgtcactggttttgattgtccgatgctcatgcctgctggggcaactgttgtgttatgcttgtcctgcacacaccctgtatacttgcctccaccttggcccttcctctaccttgccagttacatccttgtgtgtgaactcagaaaggcttacaacagagtgtgagcatgccattcctccagctacttctagatatggctgaaagcttgcctaccttggtgcaggcagcattcaggcacatccacagacacacagagacagacatgcatttatacatagatctagagatggacatgtatagatacatgcacgaatatgtattcatagacacacagatagaggttccgcatgcgtgcatggacaaatacaaacaccttcagagacaaatatgcacagacacacaaccacacatggaaacaggcacaaacacacatgatcatgtgtgcaccaaaacagaatataggcaaatatagacaagtgaactacatagacatgaagacatgcatacacagacatgtaaagaaacatcttgaaatgtgtacactaacatgtggacagacatggcacacagttacacctggtctctgaccaggaccataatctccagggttcagggctcagagagtccatactaggctgggtggcactgatactcctcagggtcccactctatgattaggggaaatagcccgaggagcaaaatgtgcatttttggctcaacaccatggggcagaagataccccactaaccacccatgacagaaaattagccttggttgtgtctccattaatagaatacctcaggagatcaatgagagagcgcttgacccactcacttcccagtccagatgcagaagacacaatgcaattgtccaaaagaattgtacacacacacacacacacacacacacacacacacacacaccaacaaaggaacctctataaggagtcaccacccaataacattgcctctttggattcacatcctggacattcttcatattcatatccatttgggacctgggctttagaaatccccaagggctcatctttacagaggtcagagatcccaataaatgccctggtcccacagcctctctatctcttggtaccaagactcaacactgctggcaggggtagaacaatcaacacacaggaactctgatcaaagagaggcatgagatgcctgggtccttcaggaagtaaggagggataacctctgatatgcctactcttattcccaaagcccaggagaagggaaacctgctctgaattctcagtctaacagccccgatggtgccacctgctcagagaaagtccaaagaacacaaaaatcattatgccacatttcctgagtctgcctttacccatgtccgtatgttgcatctgccttgcttgctctgctgccccagagttcctgggacaaggccccaagttagtgcctcctccagtttgacctgtgctttgtctctgtctagcttgagctattaggggggccagtcaattctccagaaccagcagaacacccccaaccctgaggcaaatgttcaatcaccccaaggcttggcttgaccctccctctgtgtgtcccttcacagagggggaggtgaatgctgaggaggaaggctttgagaacctatggaccaccgcctctaccttcatcgtcctcttcctcttgagcctcttctacagcaccactgtcaccctgttcaaggtagtgtgtgtggtggggctgaggacacagggcagagacagggagtcaccactcctcactgcccctacctctactctgtaaaagggaacagcaattcacactgtctctgtcacctgcaggtgaaatgactctcagcatggaaggacatcagagagcaagagaccctcccacagggacactacctctgggcctggggttcctgcctgtatgactagtaaacttattcccacatctttcctgtgttgccctccagctttgatctctgagacgggcttctttctagactggccaaagactttgtccacttgtgcaacctggaacaatgtctggaaccacagacagctgtgctgtatacaaatgtcactttgaaataaatacttcaccttgcgaacccactctattgtgaaggaatttgttcttgttttcaaacttttcctgtggtgttgacatcccaaagactctctaaatagagcctgggaacttgaagtgaacagtctgatggggcttaagagtgaaagagggaaaggaggtgtggaagaagagagagagagagagagagagagagagagagagagagagagagagagagaaaccaccctgacagcaaagtatagcacaggcagccaatgggtagcagtctggtttatccaccctgatagaagaaagtagggcagagaaaactccaggcctgatctcacaaaagcaaccgaatctgaaaagtagcctctagcctggggtgtctgctccatccctcagcccaccctcttgggctggcgttgcttccagctagtgcaatactttggtgttagccaaacctttgtggtatgtggggtgtgccttgggagagttggctgagatctctaggatgtttgtatcccttctgcaacatgacaagccctaggggttagcccataacttgaggactcaaaccctctgtctataacaactgctgtggtcactggagaaggacagctaaaggcctgctcacacagcaggaaaggaaagggaggtaggtcatgtacttcagctcagaggaggaagcacagcagatacaaggtgagggcagtgctaggggttctgctgttcaccgtgtggatggctggaggaacctcacagaggtgggactagctggttacattgagagcaggacctgggagcagggcataagaaagaatatcagacagtgggagggaactgtgtagatgccagggtcctaaagagagtctttaaataagcatgtatggtagcaccttggtgatggcccctttctgagttgggtttctagtgggtagctgcaggagagcaacaagcatctattgagaaaacactgtaaagacgatagggcccaccaccaaattccagatatattttaggcattcacctcaataccctactttccataccagcatctgttttagtttccctgggctgcgggtgcaaagtgccacatgtggcagtttgagcaacagaactctgttctttcccagttctaaaggccaggattctgggcttcagcaggctggttcctctgtgcggcagggagaatgtgtcacagacttccagctctgaagccatagcatttgactaatacttgtctcctggcaccaacaccccagttactgtttcaaatgcatagcccatccccatgtgtgtttcctttgtacttactgccacgtttcacgaacccagttctgctgggtttgatgcccaccctcattcagcacaagttcatctcaggcagattccacccactacgacctcagagctagaagtctatgacacgttctccctgctgcacagaggacactagcctgctgtagcccagactcctggcctctagaactgtgaaagaacagagttctgttactcaaactgccacgtgttgcactttgccccagcagcccaagagagctacatagatgttagtatatgacgtaaggtgcagaggtgactttggaattgggcgatgaacctccaggcagtaaacagcctgctgacctttgcattagctgtgtgactgagatcacatcagttcccgacccccaagccccttcagacgtcacatcaatagagtcaaccgttagagtccatcgctataggaatgatgtcgcttgcactttagaaaggttttataaccaggactgtagttgtaccttaagctttgtgatatgtaaagaagtgagctaattatcaaaaggaaacattctgccaagtgatgttgtacttgaatgtgcccaaaacaaacatcccagcatcaaacgctagtatcttaaaccaacacaggtactgagtcatattaaactgaacgtacttcttgattcacacagacctacactgctgtctctgtttgcggagacccatgcagactaggtactggtgcacatagtcaacgagatgctgagggaggagagcacatactttaaggtagattaaaagggcactggacttggctattgacctccaggccacgctcaatgatgaggcaactaagagtctctgtacagccagaaatgtccccatatgctggccaggtataagatagatggtactagacacttggtgcaagagaaagagagtgtatatgacagacataggcacttgtagacttagtacacagcccactcagggccctaactgtctaaaaatgtgaaggagaatccataactcagtccatgagcattacatacacacctgtagctccacccacctcatcttcacaccttttaacatacagatcatcaggttatatcaggcctgtggcactctgaacccatctccatggctagtctatatccagaatgctgatggaccagcggtcaaggaagcctctctacctaccactctgatgccttttcctcctgagcttcatggtcaaagagaggatccatgagagcatccagggaccaaccacagccctatcagcacatggttctccagccatgtcgtcaactctgtctacccttggttattgctctttaataggtaccttgtctcactgtggcttataggttccatacgtgactatgatatgatagttcttcatctcaggtcctctgagtatcaacattctcacagacctagagcctgcctttgctctgaaagctgtatcttctcaacttggcactgacacagacagcaccctccattcctgtgtattgacccacatcctacccggagatattcctcaagaagcctcctccttaacctatgttcttccccggccagcacaagctcctaaatctgtgtcctgggtctgagccttggacctcataacgtggatcttctgtttacagaggttcaccccagcatcctacactacaattacccagcatgggcacctctgaccagacataaccttcctgattaacaatctgcttcttgttctccacattgcagtctttctgatgaggcccacataacctacaggctcctcacctctttctctgacacttcacaacacattcttccttcccttccattacatactgtcagtgtctctaaacccagagaaacacctggcttttcctagcagtcccaatcattcaagttaaggaccctcactttagtgaggatggccagtcccatgacccttcagaatttgttcccatctacatagttctgaggccctgaaggtcaccctctcccaatatctgtacctaactcctcctgcaaagacctgcaatgagctcctctactctgggggatccactaacctgtgtatcatgtgccagagcaggtttgattacttcattccgtattctcatgagcccctgagaccagaactggaatccctgattccacaatctaaaccatcaggttcccatggcagtccattttagagaccttctggtccgtgcctcttcttaatttatccaaggcattctcctgagtctcagcaatgcttctgtctgaagacataatttcctctacttggacactcaggcagagactcgagcctcttctttaaccgattcagtttggatggcacaccaggcttatcagtgttttcttgagatagcactagctagagacagggacagagaggtttagccaccaaagctggacttagatcacacatgaacaagaggcccagaggctatgaaccctctccaatgagctggtcaggaaagagtgggcataatcactcagcctcagccagctcagggacccagaaggcccaggtgcacagagtaggagcacatccaggcttcctaccttgtcccctgagtctcaagagtaccacatcaactactcccacacatccacatgaactaatctcagtcagctttggactccccctcatgtccagatacagaaacctccccagaataaaggggaacctcaggaaataccttatgccacccactgtcaatcatgttcttactcaatcatagggtggaaatagggtggcattcgcatctctggaacaaaggctgtgactctgggaaagacaagagaaagccaggaacaaatacatctgctttcacagcttccacatgtcaaaggggtcagcactaaatgaagctgcagaagaagaagacctcacagacagccagcatctgtagcccttccagatctttgagtcatcctatcacaggagattgagaaggagttgacggaccagcccaagcagaggaagcctgtgtgttcaacagtaaatgtgtttgccagcagcctgatgtcaactgagaagactgtggcgagtgcttgggagacaatcacgggcagctagagctgcacaaccccatagacaacaagcctgaaacacaaggagatgatgaaatatatccagaagactgcggaatcagtttggcctggaccacaggttgatagaaccaaggcagctgagccctgtggtaagtgaccaggagggcagagggagggagcttccaggagcatgcctgggaatgccttcaggccttctgagaagcagaaagtaggcaccctggggttccaggaaccatcccagcactcaagagttactaagggaatagaagcaaacctgagctgaaggagagaaagaaaagtggagggaagcccaagccactcaaagtaacaggcaggacaacttccagtgagctgagagaacaggagtgctggagaaggcagagcaagcccagcagatcaggagaacctgcataggagtctggatgactagagaaacccagaaggtgagagaacaggcttaacagctgtcatggacttagggatatgcaagcctggggcaccaagctgatctgcatagagggcaagggtaagtgggaatccaagagatctaagaatgaccagcgctgggcagagaggtggcctgggagaagatggctggtcttccccatgagtccaatagcaagattgtcggaataggttatcctatgacagatggcagtatcagtgaccaaatgaagacgctatggaagaattggaccatgtgggagttaagagttgaggacacaaggctgacctgcccatgggaactacagctgataaaagtgctgtgattcagggcatttctggaagctctgtgatccaggttgcagtacacaagtaaactgggacagacgggagttctgggggttcagttcagatactaggaacttaggaaactgggaaaagggaagttggggctgatggcagaactatgagaaggcactggaattctgaagaccagaccttctaatcaactatagaggaaatggagtgggtaggagtggtggatacagctgagcatcacaggggacctggggattggggacagctatactggggctagcagtgcaaacacagaaattgggggaccaaagggggaattgaggatgaccttgggtagatagaaatgctggatgcctaaggtacctccaggagcttagggaacctcgcagagcagctacaaagctggtggtgttagtgacactttcagaaccagatcgggcaggttggcatgtagaaatggggttaatggagacccaggacagtggcagattcagaataaaatacaaacaaccgaaagagttatgtgccctgtaagaagttgatctgacacccacagcagagacatctaaggtctcacagcccacatcaaacaggcttctgatctaaggacagcacaaaaggaaggaggcatcaaaccatcctggggaagacagtgcagtagtagccagaagtgtaagcccaacagcagtgggactggtgtagcagccagggacagggtccctgccaagatgagcctcaggggagctgagcagctgagaaactcaccagctgagaagctcaggggaatcagggtaagtggaggttccagagaatcaggggaagtcaagagctcagaacccaagaaggggcacctgcaaaagagctaaggcctatgagagtgtggggaacactttaagcagctttaggggagccaagacaggtagaagtgtggggacccaaacagggaagctccaggggagctaggaaaggtggaactgtgggaatccaggcagagcagcacctggggagcaaggaaagaagtgtggggatccaggcagagcaggtccaggggagccaaaaagtggaggtgtggagacacaagcagggcagcatctggggaaccaggacaggtggaagggtagggacccaggcagagcagcaccaggggagccaggacaggtggaactgtggggatccaggcagagtagcaccaggggaccaaggaaagaataagtgtggggatctaggcagaacaggtccagaggagtcaaaaagtagaagtgtggagagccaagcagggcagcatctggggagccaggacaggtggaagtgtggggatccaaccagagcagcaccaggggagccaggaaaggtggtagtgtagggtcacaggcagagtcgaaccagggaaccaaagaaagaagaagtggggggaccaggggagccaggacaggtagaagggtggggacccagacagagcagctccaggggagccaggacaggtggaagggtagggatccaggcagagcagcaccagggaagccaggacaggtggaagggtagggacccagacagagcagctccaggggagccaggacaggtggaagggtaggggcccaggcagagcagcaccagggaacgcgggacaggtagaagggtggaaacccaaacagggcagcaccaggggagcaaggaaaggttgtactgtggagatctaggcagagtaataccagggaagccaagacaggtagaagtgtggggacccagacagagcagctccaggggagccaggacaggtggaagtgtggggacaaaaatggggcggcttcagtgtgtctggggagcaaggaaaggtagaagtggagagacccaggcagagcaataccaggggctaacaaggtagaagtgtggggaccagaacagagcagcaccaggggagccaggacaggtggggatgtggggacccaggcagggcagctccaggggagccaggacaggtggaagggtagggagccagacagagcagctccaggggagccaggacaggtggaagggtggggaccaaggcagagcagctccaggggagccaggacaggtggaagtgtagggacccaggcagagcagcaccaggaaagccaggacaggtggaagggtagggatccaggcagagcagcaccaggggagccaggacaggtggaagggtagggacccagacagagcagctccaggggagccaggacaggtggaagggtaggggcccaggcagagcagcaccagggaacgcgggacaggtagaagggtggaaacccaaacagggcagcaccaggggagcaaggaaaggttgtactgtggagatctaggcagagtaatgccagggaagccaagacaggtagaagtgtggggacccagacagagcagctccaggggagctaggacaggtggaagtgtggggacaaaaatggggcggcttcagtgtgtctggggagcaaggaaaggtagaagtggagagacccaggcagagcaataccaggggctaacaaggtagaagtgtggggaccagaacagagcagcaccaggggagccaggacaggtggggatgtggggacccaggcagggcagctccaggggagccaggacaggtggaagggtagggagccagacagagcagctccaggggagccaggacaggtggaggtgtggggacccaggcagggcaccaccaatggccaacaaggtagaagtgtggggacccaggcagagcagctccatgggagccaggacaggtggaggtgtggggaccaaggcagagcagctccaggggaggcaggacaggtggaagggtggggacccaggcagagcagctccaggggagccaggacaggtggaagtgtggggacccaggcagagcagctccaggggagccaggacaggtggaagggtggggacccagacagagcagcaccaggagtgtcaggagaggtggaagttaagtagttataggggaacaggggcagaatagaatgagggatgcaggctgagaggatacaggggaaatgtggcaagtggaagggcaggaagagaggcagagtggctacagggaagttgaggcaggtaagactgtctgttccaggtcaaaaaacactgaagaccagtagaaaggaaactggtgcatgtggtagtgggggattcttagcttagcagtcacagggaaagtgagccaagtaggaatgcaggcatggggggcaggcacagctgagcaaacactaaagagctgtagctgaagggttataaggtaccaagctgagaagctgctgggaatctggagctaatggggtgtgggggagcaggctgagcaactacacaggatcagggataggtaactgtgtaaggaggcaggctgagcatctccatgacagctggagctactatgaatgttaagctccagactgagcatctgcagggaaacagaggcaagagggagtgtggggatccaggctgagtaggtccagggaagctgtagtaggtggaggtggaggcccaggctgaggagctacaggagagatgggacactagggagggcagggatcatggccaagcagatactcagtagctgagatagatgtggggaatcagcttaagcagcagacacaggggagcaggatctagtcagcttctagggatccaggctgtgtagacatggagggactgggggagctataagtaaatacactaggcataaaattacagggaaacggaggccagtgggaacgtgggcctcctactgaacaagtaacagagagccagaactgacgggttgaagaggaaccaggctgatgagctccaggaaatctgtggggactcggtcaatgggagaacagggtgagcagctatagaggatcagggataggcaaaaacgtatggagtcaggctgagcagttacatgagagctggagccctagttatgtggaggtccaggcagaggggctggagggtagctgagggaaatggtgctagagaatcaggctaggcagacacaggggagcaggttctagtctacatatgagtggggatccaggatgtgtagagaaaggatagcaaaggtcatggaggattccaggcttaggggtcactgggaaactaagactggtggaagtgggattgtcctaagtgaacaaattccatgaagctagagccagtgggtgtaaaggtagcagactgaaggactatagagtatctgggggtggatgggaatgtggggaatcgtgctgagccactacaaggacagtgtggctagcaggctgtaggagaccaagctgagtatctgaagggaaaccaagggaagtggaagtgtaggattccagaaatgagcaaatgcagggcacttgaggcaggtatcagtgtagggaacgagactgagcagttcacaggtcacccagggtaggtaagagttctggatcatcagagaagcctctggaagccctaagcacctacagtagacctaaggcaggtggggtgcagggaataagttgtgcagctcctgaggaggaggacaggttggagtagaggaggttctgactaaagagttgaatgggagcagggcaggtgggaatgtagaggaactagctagacagaagtccagatgagattgagggccacatgatgccctgagccgatgagctggccttagaaatcactctgctgggaccagggccaggggtttgaggaacaaggctgaggtgaaatggtagcatgacagggaggcaatggcagagaggaaggagaaggcatgcttaattcatggtggagtgcagggagggaaagagccaggaggtctaggctggagctgatccagctttctgcactgatgagaggggcgggactgagttcttttggctccaggagccagggcaacaagacaaaggcgcctagcatagcaaggacacatctggatctaagaccaggagaagagggcaagaccgaaagttcaggaggtcatgggagggagtgggaaatctacaagggactgtctttagaaaagagtaagtgcccagtggagggagtgcccaagcaacaagtccagtgttgggagagatcggggtgggcaaaggctgtatgtgcagtaggcaggcccaagtccccaggaaggaaagaagaagtgcataggaaaacgggtcaggtctagcaggagccaaccgaggtgctcaggactgagaggcagagcccaagacacaggaatcgctgagctcatgcaggtaccaagaataactgagagctaagagaaaaattatctagggaatagggggacatgaggaaggactgttggctgagaagggaaagggacagggagaatcctaagggttggcatagacaaaggaaacacacaggctttgggttgttagtccggggctctgcatatgatccaccgagattgtggaaacagaagagcaggaagatcaaatctgtcccaactatacagggacacacggtcaacctacaaaaggaaggagatgtgaggatcaggggctgagcagtgaggaggtgtgtggaggtgttagagctcaggtgcagcagagactagcatggccctggggatagagggaaggacccaagggacagtagggacaggagggcgaggtgaggtgatgaccagcattatacaaatggtggcgctgtccaacttctagggccctgtgctactgagaaaggaaagggacttccgaggtttggcaatacaagccccgtgcaaaggcagaacccagggcactgtgaagacaacactgcaagacaggagaagccaaggctgagttcaccgaggtcacattagtgagaatacactgcgaggagaggggaggcgctgagcacccagccacaccagacaggcccatgctgagtccctggacagtgggggaggggagcacctggtgacctgtaagaactgtgagactggaggagaaccaaggtaaaaggtgtgtcaaaggacacatgtttagcaggctgggccgacttaatgcaggacacacgtggtggcaaagccaagagggctgcgtatgagccacaagtgaatcctgacccaagaatagagagtgctaaacctacttacatcaaagccaactgaaaggacaaggccagcaaaacgaagctaaggccagagatcttggactatgaagagttcagagaacctaggatcaggaaccattagtgaacagacaaaggcaggtaaagcagcctaggagtggacaaagacaggagaatacagaagacggcagggatgacccgacttcagtttgggcttcactgttgtccaaactgtgtgcagattatggcccatgggtaagaggtttagcattagaacacagatacccacattggacaatggtgggggaacacagatacccatactgcaaggctcttcgggccctttcctaaaagtgtactaggagtgggactgggctcaaagggattaggtgtgatctggcctggtgaggctgacactgacaagcccaatggttgggtgttgcatcctccatttatacagccagggacttggggagggtacaaaatggaggacttgtaggagcttgggtccagacctgtcagacaaaatgatcacgcatactttttcttgtagctgaaacaacagccccatctgtctatccactggctcctggaactgctctcaaaagtaactccatggtgaccctgggatgcctggtcaagggctatttccctgagccagtcaccgtgacctggaactctggagccctgtccagcggtgtgcacaccttcccagctgtcctgcagtctgggctctacactctcaccagctcagtgactgtaccctccagcacctggcccagccagaccgtcacctgcaacgtagcccacccggccagcagcaccaaggtggacaagaaaattggtgagagaacaaccaggggacgaggggctcactagaggtgaggataaggcattagactgcctacaccaaccagggtgggcagacatcaccagggagggggcctcagcccgggagaccaaacattctcctttgtctcccttctggagatttctatgtcctttacacccatttattaatattctgggtaagatgcccttgcatcatgacatacagaggcagactagagtatcaacctgcaaaaggtcatacccaggaacaacctgccatgatcccacaccagaaccaacctggtgccttctaacctatagacaccaataacacacagccttctctctgcagtgcccagaaactgtggaggtgattgcaagccttgtatatgtacaggtaagttactaggccttaaattccagccccaggtccaacaaatgtcctctgaggcccatgttggaggatattggcatatttccacctttcttcttcatctacaggctcagaagtatcatctgtcttcatcttccccccaaagcccaaagatgtgctcaccatcactctgactcctaaggtcacgtgtgttgtggtagacattagccaggacgatcccgaggtccatttcagctggtttgtagatgacgtggaagtccacacagctcagactcgaccaccagaggagcagttcaacagcactttccgctcagtcagtgaactccccatcctgcaccaggactggctcaatggcaggacgttcagatgcaaggtcaccagtgcagctttcccatcccccatcgagaaaaccatctccaaacccgaaggtgggagctgcagggtgtgtggtgtagaagctgcagtaggccatagacagagcttgacttaactagacttctgccctcttactgacctccatgctgaccactctctgtatccacaggcagaacacaagttccgcatgtatacaccatgtcacctaccaaggaagagatgacccagaatgaagtcagtatcacctgcatggtaaaaggcttctatcccccagacatttatgtggagtggcagatgaacgggcagccacaggaaaactacaagaacactccacctacgatggacacagatgggagttacttcctctacagcaagctcaatgtgaagaaggaaaaatggcagcagggaaacacgttcacgtgttctgtgctgcatgaaggcctgcacaaccaccatactgagaagagtctctcccactctccgggtaaatgaccccagagtcagtggcccctcttggcctaaaggatgccaaaacctacctctaccacctttctctgtgtaaataaagcacccagctctgccttgggaccctgcaaaaatgtcctggttctttctgagatacagagtccagcgaggtcatgggctgaggggcgtccagggtttgaggcctgaggtttgactaaggaaaaagggtgatctacactgccagacacagcacttttgatttgctggcatgaacagaatttacctctcactgaaaagtggaggctttatcccgaggcaatccctcttgctttctcttcctctacctaatacatctatagtgggcacagaatatatcatgaaagtaaggacgacccaaactccacctccctagtccacctttacccctcttcctagccaaggatcccactgaaggcactcaatggacacatatggtcacagacagacccttgctattccaccactcaatgcaagaagcgttccagagactaagtctaatgtaacgatgcacatagctgtcactgctctctcactgcccatgagaatcaacatggacccattagacacaacctgatgagcaacactgagggcaaaaggcccatatgtatgcatgcacacacatcttcaaatgcacagcacagtgacacacacacacacacacacacacacacacacacacacacacactggaacctcacatgggcatcctgtgcagtactcccagatgaaaagaaaccaggtctacacacaggatcatcccaacattcacaagtgggccagctgagacagatacaacttttctctgccttggatgcccacagacatcttcatgcacacatgagtttcctggggtcaatctgtccctgaccctgggatggtgccccaacctcacacagttggcacccatccgaaactgtataacttactcacttcccactgtggatcttaactgcagtcctagcatcatggggaatcagctctgcaatccctctggccctcagttctcggtcatcagcagatacaggatcaggcagaccacacagacactacccatgagaggcacaggccctgactcagcctagccaggttcagaactcaaggctggagcacacacagaatgacctagtgtataggccaggccaccatcaggtccagggtgtctggtgagctcagggacaaaactacagcactttggggaactgaagtttctggtccagagagagatcagaaaggagagatggcctcagggagggtctgctggcccagtcaggctgtaactttctcctggaactccacacaacctcatctgacacagggaatggccctagtcacgccgtgttgggataaacaaacgctgacttccctctctgtccagggatggaagtggacgatgcctgtgctgaggcccaggacggggagctggacgggctctggacaaccatcaccatcttcatcagcctcttcctgctcagcgtgtgctacagtgcagctgtcacactcttcaaggtcagccacaccatctccacagtgtccacaccatcctcacactgttcctcatactgtctctgtgatcagctatgccccacactgtcccatgctattgacctgtcttacatgctgggcaatgccacctaaccttctctatgatacagtctcacagtgtcccatgcagtctccctaattccccaagatgtccgcactctattgctgtgttgcctcatgctgcccccacactgtccatccctccctggtatgctatcccaggctgttgtctctattttcatgctctcctcacactgtccctagtgtctcatactgccaatgttggctcccacattgtccccacactctgcacacaaccggacaataaaccctgctgtcccataatgttccctgtggtccccaactctatccctgcacatttgtctatgttccctgaattctcatgttgtttgcacactgttagtgtctaacgaactctctcccaggtgtaccttcttccatgctgtctcacctcatctcccattctgtccttgtactaaccccactctatcacgacactgtccctattcactgtccctatgaagtgcccatgctgtctgcattctgtcccatgttgtatcctcatcccggtctcatgcagttcagatctatctgacactattcccactctatgcacacatttccccctataccatccctgtctgatcaacatgcaatcctctagacacccatgtagcaggttagagactctagggatgggtacctgcctgactgagctacctctcttggtgggagaggaaacacaggtgagagtgcagtcctgatcttatcttattcaccctgtcccacaggtaaagtggatcttctcctcagtggtagggttgaagcagacgctggttcctgaatacaagaacatgattggacaagggccctaagccacctcctataatggcaaaggattccccacgccctagaggaccctgtccaatgtgccaagcagtctgactcagatcacactgtctgctcacttcactatcttctgtctatgagacccaacctccctcaattcttctctctctggaggactatgtggacattagatttccacaagccacagcctccaggacctaaaataccatcacagcagcagccaggacactagatagggtcagaaggaccatagtttcctgactagtttatccaatctgttgggacagaagaatcactgaaaaagtgacaagtgcccaagttgcctgtgttcagcttggaagggaccaaccttggaaccagtcctgtcagcatcatcttctaaaacacaagaattgagtatgtaaatggcagattttggatccccagggtaagacagacttcaaccaggccacgacctgggcaatcatggcccagctgaagttgactgaattattccagtggccttcacatcgtcttgccaggttccttcttaccacttccatgaaccctgggatacagaaaagaactgtgcttctcgggatcttgggacagaactgtctaattggtgggatccttaggtagatctttcttccagtcacgggtataatacaatacactagattctcacataaaggaaaaaattcacacacaactccggccagtcctgaggcctagacaccaccacctctctggaattctgagctctatgctggaggcacaagagaggaaggcctggacttcatggcctctgtgtagccctagtaggtgcagaggcccctaagccggggttgggtgaccagcaaggacctcctggagagggatctgatgagtagattccacctgggacagaaggaaaaagatgaaaagcaacagaggtggaagggcactggagagagccatggtatagcaggtttatcttgcagacctgacatctgtccatgactctgagacttagctaatgacagctggggcagcagtccaaggaattaccatgccccctaacaccaggctcctggagtgtggagtgggtctactccagagctccaatacctgtttctccatcacttctcagccaatgagaaatcggtttccagacaggaagaaaaatgaaggcaggaaggaaaagtgggcacctgttcttctgtgagtggcaggaagttctcaaaagactcaggactttggcttctaacttcctgtggatcattgatgtctctaaggtctctgtctgctttgttggttttgtttgtttttggtttggtttttttttttttttttttggtcaataaaacgttttttcaaacattccacaatctctgtgttcttcctatgtgaaccagccctggtacttagaaacagcactgttaagtagaccagtgagtcatgaagaacatactacctctcctggtcctgtgtcctaccagttctcctctaagggtcccttcacagctgtgtgccagctctgctatcctataccagataggtcctccgtctttcttccctatgggcagtttcttcccagccagaagctgcctttgtcctgtaggttgcccactcatggcctcccacaccagccacacaaactaagaagcaggtgtctcagtgacctcaggctcagtgataacatttctatggaaaagtgaaggaataagaaagagaagaaatactccagagtcagggaagagaaagattataagggatgtttgctttctcaagtatgtttggagaagttccagatcaggcgttgacaaggtcgggttctcagcagggctcttcttgcctggtaggtgccttctcctccttgtgacctcacaggctttccctctgtgtgtgtctctgtcttgatctcttctcataagtacacagtcaggctagaagaggtacaccctagccctaattataacttatcagtttatgaccctgtctgcaaacataggtcatggtggcttaaatgtcatttgctgaatcttctggggacagaatttagtccacatcagctctccctatggaccccaaaagttcatatccttcccacatataatgtccctcaccccatacaaacaccccaaagtctcacccttccaccatcagctctgtctcaattctcctccaagactgctagttaggtaagtgtgagatgtgggtgtgactcattcaggatcaagttcaagccatgactgtcaggaaagaggtttaggccgtcagcgcagagcagattccaggaccatctgagcagttgctgaggttcaaaggcagattatagactgattccttgctatagagaagatagcccattgtgatcctctcatactagttcagtgataacaattctatggaaagtgaaataataagaaagagaagaaatactcgagtcagggaagaaaaagaacctgcaggggctgccaattgtctcttgttctgctgggcgtgtctgtgccctactagagttggattctgtcttcccatggagacaaggagacaccggctccatggcctgagatagcaccgtagaggggcccagaatttgcttctggaatgtaggagtgttagcaccaatggagagctaaggtacacaaaggcctcctaagcaaagacccaaaaacaggagctaggtgctaagtgtgcagttgagttctcagatggtgtttagatgtcctcaggtatatccttgactgttagagactgttcaagccattatgacctctagtgatggctatatgagggaaatcaactgggctggactggtcaagagaagatcctgtcaccacagctacagtggtgaggggctgggtggggggcagaatccaaactggccaatgccattacagtttctggtatagggaaagacatgcttttcctcggacagagaagcagcagatccctgtgagtggtattgctgctggggaagccatagggagatggacctcggagggatttgttgctcatgtgcagacagctgcaaggagcctgggctttggccaagcacactgggcagccgctacaatgctacacactttgggagttaggacagtggaacctagactacaaagaggacagctgcactaaccctgagaaaagttacttaattcttcacaaacctctgtttaatgtgtgaccaaacatccctccctgcaaagcgagggaagaagaacatagaatagtgaatttaaagaacatttaggcctgggacagtttccttgctcagataagaggaaatgtttgttttatctcatagttcaagtgtacagtctgtcacagcaagagtcttagtttcatttctgttgcaatgataaagtaccctgaaaatagcaactttattcagcctgctgtttaaggttacagtctatcaccgtgaaaagtgagagcaggaacttgaggcagccagtcattcacacaatcaggaacagagagaggggtgtgcacgtgcccactacccagtgacacgtgacgttagaaaggaaatttggtggggataaaagaggaaatggaggagagggagtagggacggattttatatattacatgtattatgaaattccctaacaataaagagagctacaaacggctcattaggagaaggtacaatgtgtgaagctcttcagtgggttatgaagtagggatggtgaagcccaggtgcactgaaaatgaatttaccccagaagccgcccttcatatgtgcaccatgacatgtgcacgcacacacatgtacacaattatacatagacacattcaacataaacacaacatacatgtacatacaccacaacaccacacacacacacacacacacacacacacgaaacacatacataaacacacacaatcattcatggacacactcaacataaatacaacacaccacatgccctcatacataccacacatacacacacacatgcacacacacacacacaaaacacatcaatacatgcaccaccacacacataccacacacacaccttcatatacaccactcagcacacacagagacacaaaaaaaatacatatttacacaccacacacacatacataaacacacacaatcatgcatggacacactcaacataaatacaacacaccacatacactcatacataccacacacacacacacacacatacaaaacacataaatacatgcaccaccacacacacataccccccaacacacacacacacacacacacacacacacacactagaacacactaatataataatgtttaaggactgcatcatttttctatctttctgcaggcacttgtctgaggtgctgaatgttttcatgctcccatccttgccaaacagcactttatgaggagttataaccatgccacagcctcagtgtggtgctgacttaaaagttcctccaccaaataaactattccattccttccgaaaatagccagatactttcccagaatgtaatacaggtcatcaggtcttgatgagatcttgtctccccaccctgaaacctcatgagctggatccttgctgtccttaccccctttttaatgttccctgcactgggctttctcgtcccacagcatccatgtaagttatcctgaaagatgccacatcctttcctctgctgacaaatctgtccaccttactgtttaagttcctagagtaggtatattctgagaaagtacttatttatatccagagaatatatacatttcacatagttccttttgttctggttattgatgtcattgggtcctgaagttgtgtttggaccttacaatgacaaaaacccatctttccctttcttttaccaccaattctatctcatctatctccctgtttctctctgtccatatctctgtctttttctctgtgtgtgtgtttctgtgtgtgtgtttgtgtttctctctctctctctctctctctctctctctctctctctctctctctctgtgtgtgtgtgtgtgagagagagagagggggggggggagacatgtgtgtaggtgcgagtgaaggtcagaaaaggcatctgatccctgaaacgagaattacaggaggttgagaaccacctgaccagttacagagaaccaaaatcagggtcctgtacaagagcaatatgctctcttaactgccccgacatctctccagcaccccagctttcttctgaggtcttgtatgtcatacataatgaactcagatagggcacacccagtgtagctcagcgtagccagtacagccacagctagagatttgaagaactgggccatccttccagctgggcactgtggcctggtttctgctcaattagagcttcaatcctcaagatgaaggaatcgagtctgctgggccatggagcaggcctgagtgcttgctctctgtgggcaagcatgtgtcctgtttgttaccacagctagaaacagatgcttctgctgagaagctgcctgcgaggaggctgttgatgcagagtcgtgaagcgtggcgaccgcggcaacccacatgacaaggctgacttacagactgtggcttcagtgctggggcaaacaacaaccaagaggtcctacagacactccagagccacaaggtcaccacatgtctggagcagatggatttcagtcaacacttctaccacccaagaagcttttgtggtgctgggtatagatgaactcaagtagcaaggttcgggctgtgcttgggaatcccggcaacagaagggtttgctggagtggtaccacaagcattgctgtagtgcaatttccatcttctatgtggagaaaagcccaagtacagactgtcaggacaaaaccaggcagcttccatccccaaaactgcccatgagtctccagccttggtaccctatggcctccgaaaccgcccaggggtgtgtgtatgtggtctctaatgaaaaacatcaagccaaaaatccagaaaggaatctgggcacaacctcccagtggccacaatccttccaggaagattttcttcagtaggctgaggtaaacagtcttacggaaagtgccatccagtatctccagtggtctggaagaccctgagaaacacttgctgaccaacatggtcatttgtctactcattactgcaggcgtttgttttttaagtgtgcatccgcctgcgcgtgcccgtgagcctgagcgtacgcgtgtgcgtgcgtgaggtgcggtgcggtgcggtgcggtgcgtgcatgcgttgcttgcgtgcgtgtgggcgggcgtgcaggcgtgcgtgcatgtgagagagagaacacatgccgcaggacacaaagaaaccagaggacttgcaaaagtcagttctctcaacaggtcagtcctagatacggatcttcggcagccttacccgctgagccaccacactggcccattctttcagtcatttctccatccatctggctctcctgaggtgagaaaccttggccctccaatccttgcagtcagcattggaagcagattgacagtgatgggcacataggagagggagcagtgccagatgacagggcaccgggagacattgcccatatcttacaaagggtgaagatccaaggactggtttgggagccttaggggatcagccagggcctctggtgtagcagagacccagcactcctggtcaactgtacctacagaggtttaatcatttctctttggtaggctgctatgaccaatggatgctttgaaaggtctgtactgacctgtggggctcacgcagaactgggcctagcaggtggggtttgaagtttggcagcctccgtgggaaggatgtgaggaggtagacaatgctctggagagactggagccctgaaaggggggcactggatgtttgctgctcagattgggggtgatggccactcctgggtcacaaagaaaggcagggacttctcatgggatcactcaggaaagagatctggagaacctggaaagagagattatcaggaaagtactccaaagccctctgggagcttttgctgagtctctaggttggtaccctaaagcttgccagggccacaaacctctcttggtgggattaagctgctgcaagggtcccagattttttttctttcacatttgagttgttacttatgggtggcacataaaattactcttgttttcccatcaacgtcgtagggtaggaacccaagatcggagaactgatttcttccatatagtcccaaattcacacccaagtgacttgcttcctctcttagctcctcccccaccatcaccacctcccagtaacactgtcatgctctggatccatcaccaagggcttgacccgatggttagttcagagcactcacgatctcacagtctctggaaagtcctgcatagacagaagtcccatcacttaatccactcgaggggacaagcaaatgaaccgtctcatcggaggatgaagaatcttactaccgggtcccgacatcagcttccatcctgctgccttgtcccaggaatgtcagacttaacacccacgtttccaacccaactgcatggctagtcccttaaaactcttcattccctccccagtctctctgcatctgtgtccatatctgtctaaagaaccatccttccgcaattggagctgtggccataaattttgcgtgtgtcatttatcggttgtttatgtcaaccatctcccttctctgttcctgttgtctgcctatcacctccatcctcatcaccctctgtccctatcatatatatatatatgtatatatatgtaaatatatatatacagttgatatgcaggaaatatatattcagtttatatgcaggatatatatatgcagttgatattgatatgcaagatatatatacagttgataggtaggatatatatgtgtatatgtatatattgtatatatatacagttaatatgcagaatatatatacagtttatatgcagaatatatatgcagattttaagtggactagcaagccccgagccctcaagaaccgctaggatccctgcccagtcatgttactgtcattggaagtcatcttctgtttccactccaccaccacagaaaagatccacttcatctgttgggcagggtggttgaggagaaccaagaccagggccctttaattctgtggaggaaccaaagacagctcctgctacataggagcctgtccggtggtatggggaccagggagaagttagaggtgtggaatacagggatagaatggtgtacaacgagggatcatggtgtaagggagggtactgtgaggacagtgtgtgaacagagtgtagacagtgagaagaacttggaggacagcatccgcagcatgggagagcaaaggaaggtgtgacgacattatgaagatattgtgggaactgcacgtgagtgtgaaagacagcatggggtagcaagggaggagctgtgggacactaagtgtataggagggaagtagcatgagacgctctagagcagttgttctcgaccttcccagagctgtatcctttaatacagttctcatgttgcggtgacccccagccataaaattatttcattgctactttgtaactgtaagtttgctaccgctatggagtatattggaaatacttgttggtatgcaggatatctgatattcagagtggctacccatggcataagaaccactgtgctaagtgggtagaagggccaccatggaaatagcatggggacactagaaagacagcatgatgagagtattgtgatagcattgggatggtgtggggtcttgtgaggatagggtggggacagaagagtagacagcataggtcgtcacagggacagtataggaacagtgtgaggacagtgtggacactgtggagatgttgtggctgaccttgaagagtgtgacagctgcactgtagtacacactgagcaggaagaggctgatgtagatgatgatggccgtccagaccccgtccagctccctgtcctgggagtcagcacaggtcttgtccagttccagccctggacaaagagggtagtcagtctctgtcccaacaaggctgggacaattccctctatggcaggtgcatcagcaatgaggtacccactggactgggccagtagattgtttctggggccagccttctgccctctccagaccagcagactacactctcccaactgctccaacccaagtcccggactcagccagacacaagatggcaatctggactgtgtaagaacccttcccacctgctccactcctcagatttggggctgtctgggctgaatcagagcctgtgaccactgaccctctgcctatgaccaagcccagaaagccagtgtaatggtggaccccaggcctagtgatgcctggccttcagagttccacactgggaagtgaattgggccactcagctatgtgggaaggggactgtcatctctatgggatgaaagcatgggtctgaaggtccagaagcagaatggcatgagagagtgtgtattgtgggacaagttgcctttggaatcctttggcagtgctatctgtctcagctgagccagatgtgaggaagagcctcagagaaggcctggtgccttgatgggtctgagttctgtactgggagctcctatgaggtctcggagtgtaaggcttgtgtctgtgctcatgcacaccagtgtacaagtctgtgtaaatgtcatgtgggttgaccgatggtcatcagactgctaggcactggagtcatctgatggctctgaattctgcattctgtgtcttcaagataagagacataggtatctagcccagaaaactagtctcaaggaggagagagggtcatggcaaaggtagacagacagaaattccagtgctttgacctgagatcctctccctgggcacaactgttcatcctggttgatctagagaagaaaatgacataagcctgacctccaatgggccatacctctgctgagcatcctctcatcagttttcctgtccatcttggtactgctgaccagatgggtcacacacaggtaatagcctggctcgtccagaagctgccaggcatgatcactgagctcctgaaggaagacagcttgaactataagacagatgtcgagtttcacataccagtgaacaaagctccagacttccaagacatgattgctggctcagggaagtagcccttgaccaaacaacccatgttgccatgggaaccaggaaagagatggacagggccatggctcttgctgcaaaggggggaagagatgtgaacatactgtccagcctggagaagtctttttctccatgcagccctgggtcttctaagatgggatctgctcctactcttcacgaacctagccagtttctgttttctctgaccccagcccctactcttagtctcaggaccttgcttttcacccccatccttacactgtaccccagccctgccagcatcgaatctggtcccaatgggttctttccttccaatctatagggttaactcccctgagcattcccactctcccctgttcctgtgaggccccaggatcagaattgtggaccacaaccccagaaataaaacccatggaatcccagcccccagagaccctccctgtgcacggcctccctcagtttagcaaagagttacttctggacccctgcctagcttctctctgcagccatatgacccactgcttataaacacagccagaagcgccagttccctttctcctctccacctggcttcactctgcactctgtactctcactccagacttcactttcctcctggagccacagacacttctgggctctagagagattgcatcagctggagagggaatggcagaggctgccaagtaggctggttagaggtcagacctgagagaaggtcttctccaaaaaggtggtcaggagaatggacataatcactcagccccaagcaatccaggaacactgggtgacagctagtctctacatcttcttctaagggtctcaagaggaccacttcacctacccctacaggaggtaacccagaccatgtctggactccccctggtctccccctaccccaaacactgaaaccaacagaagaaagaggaacctcaggaagtgtcccgtgtcacccagtttcgatcctgttcttagtctgtactgggttgggagaagtgtgatgttcacacctctggggcaaggactgtgaatcctggaaggatgagacagatctcagagctgggctgttagcagcccagcaccaatgcaaaaagagcagcagtcacaaggttccacacgtgaatgtagtcagcagagaagctggagaaagccacagcctagggagagcagtgagcttttccagacctaatagacggcagaacacaggaggatgaggagttgacagatcagccccaacagaggggcctgtctgttgcaaagaaaaggtgcctacctgcaacctggtgccaaccaggcagacaccagactttccacggacagaagccaagaccactaaagccgtgcccacctacagacaaccagagtaagcctcaaggagttaatgggatagacccggaaacctgagggtctagccaggcctagaggccggtggacccaggacagctgaaccaacagagaaaagaaaacccagtggagcaagggcagaggcatacagaattgagagagttggtaaagaggggatggggaacgttcacctgggaggactgatacacctattagaaagagctagagtcagagtggatgcccttgtgactcccggcattggatagcagatcccaagaacaaagctgaaagaaggtaaatttctcaagagaaagtcttccagaggaactatgggtaccaggcaataagtagtacatccgtaggagggaaccagacagtagtacatctgtaggaggggaccaggcagtacagctgcaggtagggaccaggcagtatatctgtaggagaggaccaggcagtatatctgtaggaggggaccaggcagtagtatacctgtaggaggggaccaggcagtatatctgtaggagaggaccaggcagtagtatatctgtaggagaggaccaggcagtatatctgtaggagaggaccaggcagtagtatatctgtaggaggggacaaggcagtacagctgcaggtaagctaaggacagtaagagtagtagagagccatgatgactccaaaagctcagaagacctggcagagcagctacagggaatccggggctggtggagttgggaggaccaagccaaagagctataggtaagccgaggctggtgaaggcacaaaaacaagctaaggagctacagagggggcaagggctgtggcaggtgtggctaagagaggtccagggcacccccaggaaccagaaagagctttacaggagttctagaggaggaaggagttggggagacaggctgggcatctgtaaagataaggtagcagttgtcacagtttgggtctcagagctgcccaggggattaggggaaaattctgagaagctgtgggagagtaggggatggtaggaatgtggaggaccagtcctagcagctgtggggaagctggggatggtaggaatgtgggggatcagtcctagcagttttggggggagctggggatggtaggaatgtgggggaccagacctagcaattttggggggagctggggatggtaggaatgttggggaccagtcctagcagctatgggaaagctggggatggtaggaatgtgggggaccagtcctagcagctatggggggagctgggatggtaggaatgtgggggaccagacctagcagtttttgagagctgggaatggtagcaatgtggggtccagtcctagcagctatggagtagctgtagatggtaggaatgtgggggaccagtcctagcagctgtggggaagctggggatggtaggaatgtgggggacaagacctagcagctatgggtgagctgtagatggtagaaatgtgggggaccagtcctagcagctgtggggaagctggggaatggtagaaatgtgtgggattgttcctagcagctatgggggagctggggatggtaggaatgtggaggaccagtcccagcagctatgtggggggctgtggatggtaggagtatgggggaccagtcctagcagctatgggagagctggggatggtaggaatgtgggggaccagtcctagcagctatgggagagctggggatggtaggaatgtgggggaccagtcctagcagctatgggagagctggggatggtaggaatgtgggggaccagtcctagcagctatgggagagctggggatggtaggaatgtgggggaccagtcctagcagctatgggagagctggggatggtaggaatgtggaggaccagtcctcacagctgtggggaagctggggatggtaggaatgtggaggatcagtcctagcagctatgggtgagctggggatggtaggaatgtgggggaccagtcctagcagctatgggagagctagggatggtaggaatgtggaggaccagtcctagcagctatgggagagctggggatggtaggaatgtgagggaccagtcctagcagctatgggagagctgggaatggtaggaatgtgggggaccagtcctagcagctatgggagagctggggatggtaggaatgtgggaggcctgtcctagcagctatgggagagttgaggatagtaggaatgtgggggaccagacctagcagctatgggagagctggggatggtagtagtatgggggaccagtcctagcagctatgggagagctgggaatggtaggagtgtggaggaccagtcctctcagctgtggggaagctggggatggtaggaatgtggggggcctgttctagcagctatgggagagctgggaatggtaggaatgtgggggaccagtcctagcagctatgggagagctggggatggtaggaatgtggaggaccagtcctctcagctgtggggaagctggggatggtaggaatgtgggaggcctgtcctagcagctatgggagagttgaggatagtaggaatgtgggggaccagacctagcagctgtgggggagctgggaatggtaggaatgtgggggaccagtcctagcagctatgggagagctgggaatggtaggaatgtgggggaccagtcctagcagctatgggagagctggggatggtaggaatgtgggggaccagtcctcccagctgtggggaagctggggatggtaggaatgtggaggaccagtcctctcagctgtggggaagctggggatggtaggaatgtgggaggcctgtcctagcagctatgggagagttgaggatagtaggaatgtgggggaccagacctagcagctgtgggggagctgggaatggtaggaatgtgggggaccagtcctagcagctatgggagagctgggaatggtaggaatgtgggggaccagtcctagcagctatgggagagctggggatggtaggaatgtgggggaccagtcctcacagctgtggggaagctggggatggtaggaatgtggaggaccagtcctagcagctatgggtgagctggggatggtaggaatgtgggggaccagtcctagcagctatgggagagctagggatggtaggaatgtgggggaccagtcctaggagctatgggagagctggggatggtaggaatgtgggggaccagtcctagcagctatgggagagctggtaatggtaggaatgtgggggaccagtcctagcagctatgggagagctggggatgataggaatgtgggggacctgtcctagcagctatgggagagctggggatggtaggaatgtgggggaccagtcctagcagctatgggagagctggggatggtgggaatgtgggggaccagtcctagcagctgtgggggagctggggatgataggaatatgggggacctgtcctagcagctatgggagagctggggatggtaggaatgtggaagaccagtcctcacagctgtggggaagctggggatggtaggaatgtggaggatcagtcctagcagctatgggtgagctggggatggtaggaatgtgggggaccagtcctagcagctatgggagagctagggatggtaggaatgtggaggaccagtcctagcagctatgggagagctggggatggtgggaatgtgggggaccagtcctagcagctgtgggggagctggggatgataggaatatgggggacctgtcctagcagctatgggagagctggggatggtaggaatgtggaggaccagtcctcacagctgtggggaagctggggatggtaggaatgtggaggatcagtcctagcagctatgggtgagctggggatggtaggaatgtgggggaccagtcctagcagctatgggagagctagggatggtaggaatgtggaggaccagtcctagcagctatgggagagctggggatggtaggaatgtgagggaccagtcctagcagctatgggagagctgggaatggtaggaatgtgggggaccagtcctagcagctatgggagagctggggatggtaggaatgtgggaggcctgtcctagcagctatgggagagttgaggatagtaggaatgtgggggaccagacctagcagctatgggagagctggggatggtagtagtatgggggaccagtcctagcagctatgggagagctgggaatggtaggaacgtggaggaccagtcctaggagctatgggagagctggggatggtaggaatgtgggggaccagtcctagcagctatgggagagctggtaatggtaggaatgtgggggaccagtcctagcagctatgggagagctggggatggtgggaatgtgggggaccagtcctagcagctgtgggggagctggggatgataggaatgtgggggacctgtcctagcagctaagggagagctggggatggtgggaatgtgggggaccagtcctcgcagctgtggggagctggggcaggtgggaatgtgagaaaacaatccttgagctatggaggagctggggatggcaaggatgaaaaggggcaaatcctagcagctagagggaagctggggcaggtgagggcgggtgtaaggaaccagacctagaaactatgggggaagtggagcaggtaaaaatgtgataaaccagttatgcagtccagaggctggtaggagtgtaagggagcagacatagtggctatggggaactgggatatatgggagtgtaagggaccagattcagtagctatggtggaacttgggagtgtagatgagcacgctgaaaagctatggtgcaactgcaacaggttgtcagggtgtaaagaaccagacccagcagccatgggaaacctggggaaagtagcgatgtgggggaccagatttggcacctataagggagctggggcatgtggacatatgaggggccagaagcagcagttatagggaaactttgaaatataggcaagtgtaccaagaagccgtagtggagctgaaacagatcctaggtcctatggaggagctgaagaaggtgggagtgtgagggaccaggccgagcatctgtggaagggctgaggcagggctctgggtcggatgggagtggcaccccagagaagccctagaagctctggcgatggagctgagcagttacagtggacttggggctggtgggatcgtaggagaccatgtagctgcagaagagctggagaaaacaggagtatgaaagacccagccaagtagccactgaagagctggggtgttattggggtgtgtggggacacagtcccagcaggtttatagaggttggagccttggcagtatgtgcagtaccaaacccagcagcttggttcaggggcttgagtagaggcaggctaatggggtccacggtaaccctaggcacttaggggactggattgcgaatcttcaggggagctggaacaggcaaagttaaaaggaatcaagcacctggaagaaagcaaggaaagataggattgatggggatccaagaaactcccaggaagtaaccccagcagggacatctgggagctcagttcagacactgaatcaaaagcacagaggaaggagaggtggtaggtttccaagctatcctgtccaggccaatggagcagccaggaaggagggaaggagaccaacaggaatggggcagctgtagccagcagggtgtgagagacagggatgaggctaggtggctagcaagaagggcaacttagtgggagaggggtgaattaaccaccctgacctcatgctgacaggggctgagcaacagacaaaagaataagaaagccaagagctcatggctggaactattctggctgtctgctctgactgtgttgaaggggctaagcacctgttagctaatgaggctaaaacagttaaatgagcaaagtagagcaaaaagctcccacagcggagagcatgggagaacgggagactgtgagatcctcggggggtctaggagtttatctcagagtgaagaacagtgaaaagctctgcttgggagttctttggggaatggcgatcatcctgggaactcccttatagacctcatggcatggaggagagcaggagctcaggcagacagagtagctgtgtgtgagctggataagaaagaaaagagacaacagggagagaagagaaaagggatgggaaaggactcagggctctactgaattcaggcagaagagcttggcttcaggatgctgggggccaaggaaggtgtctgattgagcaggaacatagtcaggaaaagaccctggtgctcacattcccagacaaatcttacaggttaaagttctagtatcagaacccctcgctcagatcctaggggcttatgggaacataaggcaggaagtgaaacctcttaggacagcacgaagtagcctgtgttggcccacagaagaagagcaaggtaactctcagagtttgagcaggggattgaggaaggtagtgtacaggagaggcagaaagaccagaaaggtccccagagtaagaatgaatcaagaatttatgtgtggtttggttcgatgaaggcaaaggcagggaagatagatgagaaactgatcctctttcacaaccaagaactcattgttcagtgtgagttttgatatatagaaggggggggaatgtgctattaaaagtaaaaaagaatgaaccagattcaaaagggaaaggggactaaatgtcttcctgaataatgcagcatacattcctatttcaagagctaccggcaagagaaagggacacttctgggatgtgcccagtaacattagcactgtcagagagaacccagggcagtgcgaagggtgaggtgggggaggaaggtgtctgcactcatcagcgtctcatcagggggcactgagctgtgtagaacaagagtggccagctaggtcaagacagaaaggatgcccacacacagaaggtgtagggtagagggttggtagtaatccccaggaagcagggagcaaggtccaaggagagctaaagtcacggatagagacctagggcacagatttaggagccagagtttgtgtaatgttagtagattcagtaggggcttctgaagggcctcatcactgaaagatcaaggctcctagggctggagagttggctcagtggttgctgctcttccagaggacccaagtccagttcccaacaaccacatggcatcttacaactatctgtaagaaactccagtttctcgagattcaataccctcttctaacagcacaggcatcaggcacacacatagtacacatagtcatacatctaaaataaaatacctaaaaaaaaattaaggtcagagtgcagggtctagaagtggaagctgctgacaccacttaccccagagcaacttgagaagacacagtctttttagagcaaagctaaggccagagcctctccaaatatctgaggccacgcatgttggaaaagctcacactccctcctctcttgcagcccaaacaacagccccatctgtctatccactggctcctggatgtggtgatacaaccagctccacggtgactctgggatgcctggtcaagggctatttccctgagccagtcaccgtgacctggaactctggagccctgtccagcgatgtgcacacctttccagctgtcctgcagtctgggctctacactctcaccagctcagtgacctccagcacctggcccagccagaccgtcacctgcaacgtagcccacccggccagcagcaccaaggtggacaagaaagttggtgagaggacaaccaggggacgaggggctcactagacgtgaggataaggcattagattgcctacaccaaccagggtgggcagacatcaccagggagggggcctcagcccgggagacactgtctctgcctccctcctggaggcctcctggaggcctctgcctatggccacccaccccctaagacatgatcctctggtatagatgtctgtgtcatgcataggatcataccagggacaaactttcctctctggtttggtgccttctctccttgaaaacccagtaacatccagtcttctctctacagagcgcagaaatggcggcattggacacaaatgccctacatgccctacatgtcacaaatgcccaggtaagtcactagacctggaccccagctccacaatgatggcaagagctgtaagcatcccagcactgcaggataagccacgtactgacccatttctatctctcctcatcagttcctgaactcttgggtggaccatctgtcttcatcttcccgccaaagcccaaggacatcctcttgatctcccagaacgccaaggtcacgtgtgtggtggtggatgtgagcgaggaggagccggacgtccagttcagctggtttgtgaacaacgtagaagtacacacagctcagacacaaccccgtgaggagcagtacaacagcaccttcagagtggtcagtgccctccccatccagcaccaggactggatgagcggcaaggagttcaaatgcaaggtcaacaacaaagccctcccaagccccatcgagaaaaccatctcaaaacccaaaggtgagagctgcaggccgactgcctggggactgggataggtataagaatgaatgcccgtgtggacggccatgacctctgtgtctgtttctatccccacagggctagtcagaaaaccacaggtatacgtcatgggtccaccgacagagcagttgactgagcaaacggtcagtttgacctgcttgacctcaggcttcctccctaacgacatcggtgtggagtggaccagcaacgggcatatagaaaagaactacaagaacaccgagccagtgatggactctgacggttctttcttcatgtacagcaagctcaatgtggaaaggagcaggtgggatagcagagcgcccttcgtctgctccgtggtccacgagggtctgcacaatcaccacgtggagaagagcatctcccggcctccgggtaaatgagcacggcacccagaaagctctcaggtcctaagggacactgacacccatctccacccttcccttgtgtaaataaagcacccagcactgccctgggaccctgcaaaactgtcctggttctttccggggtatagagcctaggtcacgggctttaaggtctggctggggtttaaggccagagttgtcttcaggaagagagtgaggtttccacactgccagactcagagctcatgagtcatcagggcctggagtgttggggcttagctttaggaagtgcctattccttgacttcaaactaaccagcagctgccagacggagagatacacctaggaaacctccaagggaagaaacacacaaactccaccaccctctgcctgttcctatccccatgtcccactcctctgcctatgggtttctctgagtctattgcacacatggccatgggcgtgccagagacccttgctatccctacactcaactaaacccaggcagcttttcatgggctaggtctgcacacccatacagactgcccactcatgcctgtgccacgtgagactgaggcagatggctcttgccgcccaaagggagggtctgttagccacatgcatactgaatcctgacccattcaaatcagcctgccgaacatcatccagtccgtatagcacatgtatccacgtgcacatgtgcacacacatttaacacaccaggactccgcctgtgtgccctgcacagcacctacacccagcagtgtatcaggatacccacaaccaccacttgagtgcccacgtttctgccatcacaaccagacacacctttccccttctaaggtcactgcattctaggctcagcacaagtcctctgaagccagatccgtctctggtacctcagggtcacgcttcaaccccacatgaattatacaacccagagccataatggtctgagtcacttcacactctggaattttctcaagttcaggcaagaccaggcacaggctccgctggtgattgagggacaggtaaagggtcagaccagctgtatagccactgtccactggggtcacaggccctgctgacccttcaccttctcctgtactgcaaacagagagggcccttgcacaatccaggccgccatgaggtccactgtgtctggcaaaccccaaggccttatccaactcagccggagggaacttagactgatgtcccagagggaaaagaaaggaaagtagggagtagaaagtctcccagggagactctgctggcccagcccaaatggagctttctcctctgccacatggggaattgctcccagccccccactttattgggacaaattctgactgccctctctgtccagggctagaagtggatgatgattgtgctgaggctcaggacggggagctggacgggctctggacgaccatcaccatcttcatcagcctcttcctgctcagtgtgtgctacagtgcctccatcacactcttcaaggtcagccacaccatcccccaccatctgctgtgatgcctgtgtcaaccctgcgatgtcctcacactcctctcctgacgtagtaggatgttcccttgctgtccccactctgccccacacaccattcccaccgttccctgagccgtcccacattgctctgtgtggctacccatggcgtccatactgtctgacattctatctctcttgctgtcctatgtgatctccatactgtcttacgaaacctccttgcatgccacactacccttcatgacgtccctgctatctaccatgctacccctctgggtgtccccatcagcctcaccatgtattctttgagctatcctcataccatctcaacctcaactcccacgatgtctccacaccggctcctagtctatgtcaccctgaccccttgccatccccagtctcctgcctgtatgaaaggaactgcaggagggacgggcctctgtcttgcccacagggctgaagggcctaagcatgggtgtgttctctgacttactcccacctccccacaggtaaagtggatcttctcctcagtggtggagctgaagcagacaatctcccctgactacagaaacatgattggtcaaggagcctaggccacttcctctgggatgagcttcctgggccccgcacaaccccatccatcctactgtgcagcctaatgtggaggccacactgccgtctgacagtgccaccctctagccctgtgactctgatccagaactctagactgtcttccttttggaggatcatgtggacaatgagctataccccagacccaaacagcacctccacagcagttgccaggaaactaactggttgggaccagaagaaccatctctaggatgtttgcctcagaggagctgggagtccacggtgcctgagtcgagctccatgggaatcagccgtgtctgaaatgggtcttcccagaaagagcaatgttttcagatccttgaaaggaaacatctgctaggaagaccatggtcgccacagccccaaagagtcacttcactctggtagcctttgaaccagttatatctggacaccttctttcccggtacttctgtgaaccctgggctgagtaaggggtttatgtttctcaaactgttgggatgagcctccccgagatgaagctccttgtgcagtcttctcttcccgaaacccactcaacatgctggactcttgggttcaggatccgatccgaagacaccattgacgacgcaacctcaagacaaggccactgtcacctccatagagactccatccacactctgcagggacaggaggactgctttgtgtaacctccgcaaagccctagcagggacaagtgcacagaccactgagtattggtgaggtgaccaggcaggaaaacctccaggagagggccctgatgagaagattcatattgggctcaaaaaatgggatggggggaggggggcgggtgggaaagaacagtgggcagggtgtgaacagatgattagaagacagtcacagtgccgcagatctgccctgcaggcctgctttccagactggaccacttacagcagaaaacaacagttacagtaagcatctaggagagtggacctggaataccagggctgctgtggccagtggagagtagccctgcatctacttctccattacctctcatggccaataagaagccagagcatccaggcagaaagaaagagtgtgcgtttctgtgactggtaggaaatgcttagagaacttggatctttaaaacagcttttttctagactgtgaatgtctttaagcactctctttcctctccattccctccctctctctttctctctctctctctctctctctctctctctctctctctctctctctctctgtgtgtgtgtgtgtgtgtgtgtgtgtgtgtgtgtgtgtgtgtgcactcacacacactgttgttttggcattttaaacaataaaacattcttttaacattttgtatctcatggtgtcccttcttaatggattagccctaacaccaaggaacagggcacagttaacagatcaattagccatgcacatccctcctgaccctgtcctcccagggttccctcagtgggtccctcatggctgggttccagccctaccagagccacaaaaagcttgggcatattcctccacacacacagcttttttccccagctggagactgctctgctgccatgggcaggctgtggagcagggctgatgcccagggtagaccctaggctagccagacaaaggtcccatgacagcagagaagcatgtgcctctcactggccttgggctgctacagagtcagcaaaggacatggatccagctacctccacagctggtgctcattgtctcaagccatgtccagagaagttccagatcaggcattgacagggtggagagctctctccttggttggtaggtgtcttctcctccatgtgacctcagagccccccccctttctgtgtgtgtgtgtgtatgtgtgtgtgtgcgcgcgcgcgcgcgcgcgtcctagcctcttctcataagtgcacagtcaggccggaagaggtgcatcctagccctaatcataacttaccagtttatgatcctgtctgcaaacataggcatagtctgaggtcctggtgatttaaatgtcaattggtgagtcttctggggcttcctacatacaatgccccttccccatgccaacatcccaaagtctcacccatccagcattcagctctatcccaagtcacctccaaaggcctgctagtcaagtaaggatcagatcgtgtggggttcgtcctgagataggattcagccatggtttccaggaggaaggggcaggagagaggcacaggggagagacgtataccgtgatgaactggacagactgataatgtgctgtccagaagaaagctgagggcaaacaggggcccctcccacttacactgaggtgacagttcctaagggagagtgagggatttgtagagagaagtggaggttccacagagttggagaagcaaaagattactagaggtagcctggtgtttgcaatgtctgttttctgttatggttgacatcaggattccatgctactctgtagatcaagggatacaggttccacatctttgtgtggcactgtggtggaggggcttgggcccagatactcccgggacatggaaaatacagacatcggcaggggaagaaatgggatgattcacaaccaaaggcctcctcatccgatgcttactgatctccgagagcaggagtcgggtgctggctgggcagttatcatctcccagtatttcccaggtggcatttagtagctgagacatcttcagattgtggccttggctgttagacactctatctgtttgggtctgtgtaggtgatggtggaggctgaatgaaggactggacaagggacaaaaggatcaggtcaacaaagctgcagcagagacaggagccaacctgaccaacaccactgtggcttccatgggacagttctgttttagccaggacagaagggaacagagctgcgtgaatggcattactcctatgggagtcacacagacaggctaatcacccagacaacaccaactggccagtgagaccagtgagatcctgcccacgcttcctcttaggtctggctctgtttctctagttgtcttccctggagcaaatgttgggaattgagcccatatcctctgcaagaccagtaaatgttaactactgaggcatttctccagccctgcctcaacctcttactggaagatggtcccaaaccaaaactgacggcatggtctcagaaagtacagattcgccacctccaaacccttctctcatgtctgtctgtctgtctgtctgtctgtatgtatgtatgtatgtatggccctgcaccatcacccaccacctcctggtgtcctgcagcaggggcttcccacagcaggacgtaccatagctcccaccccttacacctccatcagcactataaacatatagacacaagtgccataaccctggacacaccttctgaccccgcccccatctctgagaccaactgatctcaggctgtgttttactgaatgtgtccattcggtaaaagctatctgagtcctgccctcctgacctctatagtgtgacatccatggtgtgtgtcctgtgtcataacacgtaggtatgtcataccgtgtgttaccacatatgatatgtgtgtgaaacatccccacatgatgcctgtggtggacatgtatatatatatcttttatgacttctataggggacatcaattgcagaatacctgtgctagccagtagccatgactgaccagacagctactgacacttgacccacttgcattctgtcacagtctgggaatcataacatgacacaaacgccgattgtagcaccaggtcatgggcctgcatgagacttgacatgtgtacacacatgacatgtgtacacacaaaccacacgaaaaagtgtctcggaaaacacacacagacacatccacatgagcatcatagtgtggtcacagacatgtccacatgggcatcacagtgtggtatcatgtagtagccacagcatacatgacacagtcacacaagttcttacaagaacatacatgtctgccagttcccagaactcctggcctcaggctcagcactggccaccctggcccagcacacttcccatgcttcaagctttgcacacacagatccactgtattcccttcctgtgtttaccccattaccttcagcacaccacccacctctcttccatgactgcccccatcccacctagcacggcgccccactactgtgctagctttgttcactcagtgaccatgtgtgtccatcttccagtgaagcttgagctctggggacaagaacgtccctccagattcatgttcctgcagttctatccaactgttcagcatctgtgatgaagtcacaccaagtccctcaccccctaactagtcttctaatctggcatagttatgtgctgggaactaagtagatggtcaaagtaggatatgatgctggccaatggtgcagaccagtaggtccatgtgctgacccttcaactctaaagtcttccccacgcctaccatgtagccataagatctttcccccaaggcagggtacagacaccacatagaggaagaagaccaagtggatgggccccccatagcaggtatgggagagtcaggctgacatagcaagtgtgggagagtcaggctgccatagcaagtgtgggagagtcaggctgccatagcaagtgtgggagagtcaggctgacatagcaagtgtgggagagtcaggctgacatagcaagtgtgggagagtcaggctgccatagcaagtgtgggagagtcaggctgacatagcaagtgtgggagagtcaggctgacatagcaagtgtgggagagtcaggctgacatagcaagtgtgggagagtcaggctgccgggcacaaaggatatgctggacttagggaagccatcctccctgttttctgcccaagcacatatgtatcctactatcagctctctcattgttcactccatactcaagcatctgcccataggaggaagacctcagcctcaagtcaggatgtacatgagagcagccacagagtgagtccatatagttctgttcttttgccccaaaatgtcatgttccagaactacttgttcctttgacctagaccccagaaaagagaccagacactatagtagacacggaagtaagaacaacacagtgctgttgtttctctgctggcaaaggttgttgccacacttatccctggcaaagatataaaacagatgtcatcaaaatgccagtcctggttgtaaatacatatttagaaatgtctgtgtgtgtgtgtgtgtgtgtgtgtgtgtgtgtgtgtgtgtgtgtgtgtgtgtggagacaacaggtaaaaaaataaagacgatgttagagggaggaaattaaagttggaaatgatataatcatatttttattggataatttatatttacatttcaaatgttattccttttccaggtttctcgtccataagccccctgtcccatctccctcccccttcttctataagggtgttccccctctccaaccacaccccattcccgcctccctgccctgacatttccctgcattggggtgggggggatggggttccagccttggcaggaccaaggacttctcctcccattggtacccaacaaggccatcctctgctacacatgcagctggagccatgggtctgttcatatgtacactttgggtagtggtttagtccctgggagctctggttggttagtattgtttgttcttatggggttgcaaaacccttcagctccttcaatcctttctctaactcttccaacagggaccccatgctcagttcaatggtttgctgctaacatccgcctctgtatttgacacactctggctaagcctctcaggagacggctatatcaggctcctgtcaacatgcacttattagcttaatcaataatgtctagttatggtgggtgtatatatatggactggatccccaggtggggcaggctctgaatgtccattccttcagtctctactcagaaatttgtctcaatatctcctcctgtgcatatttttgttcccccttttaagaaggactgaagcatctgcaccttggtcgtcattcttcttgagcttcatgtggtctgtggattgtatcttgggtacttcaagcttctgggctaatttccacttatcaatgagtgcataccatgtgtgtgtttctgtgattgggttaccacactcaggatgatattttctacttccatccatttgcctacagatttcatgaagttattgtttttgatagctaagcattcattgtatagatgtaccacattttctgtatccattcctctgttgaagggcatctgggttctttccagcttctggctattataaataaggctgcaatgaacatagtggagcacgtgtccttgttatatgtcggggcatcttttgggtatatgcccaagagaagtatatctgggtcctcaggtagttcaatgtccaattttctgaggaacctccagactgatttccagagtgtttgtaccagcttgcaatcccaccaacaatggaggagtgttcctctttctccacatcctcgccagcatctgctgtcacctgagttttttttttttttttttagagagacatggaagaagattgtttgttggtctatatttatggcttgctcagcctgtggttttgttttttattaacttgagtatttcttatatacatttcgagtgttattccctttcccagtttccgggcaaacattcccctcccccctctccttccttatgggtgttcccctccccatcctccccccattgccgccctccccccaacagtctagttcactgggggttcaatcttagcaggacccagggcttccccttccactggtgctcttactaggatattcattgctacctatgaggtcagagtccagggtcagtccatgtatagtctttaggtagtggcttagtccctggaagctctggttgcttgacattgttgtacttttggggtctcgagccccttcaagctcttccagttctttctctgattccttcaacgggggtcctattctcagttcagtggtttgctgctggcattcgcctctgtatttgctctattctggctgtgtctctcaggagcgatctacatccagctcctgtcggcctgcacttctttgcttcatccatcttgtctaattggatggctgtatatgtatgggccatatgtggggcaggctctgaatgggtgttccttctgtgtctgttttaatctttgcctctctcttccctgccaagggtattcttgttccccttttaaagaaggagtgaagcattcacattttgatcatccgtcttgagtttcatttgttctaggcatctagggtaattcaagcatttgggctaatagccacttatcaatgagtgcataccatgtgtgcttttctgtgattgggttacctcactcagtcacctgagtttttgatcttagctattctgactggtgtgaggtggaatctctgggttgttttgatttgcatttccctgatgactaaggatgttgagcatttctttgggtacttctgagccattcgatattcctcagctgagaattctttgattacctttgtaccccattttaataggattatttgactctctggagtctaatttcttcagttctttgtatatattggaaattagccctctatcagatgtatgattgataaaaaatcttttccgatctgttggttgccattttgtcctaatgacagtgtcctttgtcttacagaagctttgcagttttatgaggtcccatttgtcgattcttgatcttacaacataagccattggtgttttgttcaggaaattttccccagttcccatgtgttcgagggttcttcccactttttcttctattagtttgaatatatatgattgcatgtggaggtccttgatccacttggacttaagctttgtacatggtgataaaaatggatcaatttgcattcttctacatgctgacctccagttaaaccagcgccatttgttgaaaatgctaatttttgtccattgaatgattttagatcctttgtcaaagatcaagtgaccatacttgtgtgggttcatttctgggtactcaattctattccattgatcttcctgcctatctctgtacgaatatcacacagtttttatcactattgctctgtagtactgcttgaggtcatggatggtgattcccccagaagttcttttatggttgaggatagttttcgccatcctggattttttgttattccaaatgaatttgcaaattgctctttctaactctatgaaaaattgagttggaattttgatggggattccattgaatctgtagattgctttaggcaaaatggccatttttactatattaatccagcctatccatgagcatgggtgatctttccatcttctgagatcttcctcaatttctttcttcagaaactcgaagttcttatcatacagatctttcacttgcttggttaaagtcacaccaaggtattttatggtatatgtgactattgtgtcataatttctttctcagtcttttatccttggagtagaggaaggttactgattggtttgagttaattttatacccagccactttgctgaagttgtttgtcaggttaagtagtctcttgtggaacttttcgggtcacttaactatatactatcttatcacctgcaaatagaggtattttgacttcttcctttccaatttgtatctatttgacctccttttgttgtctgatttctctgggtaggactttgaatgctatattgaataagtaggaaaagagtaggcagccttgtctagttcaattttagtgggattattcaagtttctctcgatttagtttaatgttggctactggcttgctgtatattacttttacattttatattactttttttatgtttaggtataggctttgaattattgatctgtccatgacttttatcatgaaggggtgttgaattttgacaaatgctttctctgcatctaatgaaatgatcatgtggtttctatctttgagtttgtttatatagtggatcacgttgatggttttctgtatattaaaccatccctgcaaccctgggatgaagcctacttgatcatgatggatgattgttttgatgtattcttagatttggtttgtgagaattttattgagtatttttacgtccatattcgtaagggaagttggtctgaagttctctttctttgtcgagtcttgatgtggattaggtataagcataattgtggcttaatacaaggaattgggtagtgctccttctgtttctattttctggaatagtttgggcatagtttagtatgaggtcttctataaaggtctgatagaattctgaactaaacccatcctctcctgggcttttttttttttttagttggagacttttaataactgctcctatttctttagaagttatggtactgtttagatggtttatctgaccctgatttaactttggtacctggtatccatctagaaaattgtacatttcctccagattttccagttttgttgaacttaagtttttgtaatagaatctgatgatttttttaatttcctcggattctgttatttctcccttttcagttctgactttgttaatttggatacgttatctgtgccctctgattagtctggctgaggatttatctatcttgttgcttttctcaaagaagcagctcctggttctttgtatagtcctttttgttactacctggttgatttcagccctgagtttgaagggctcttcaaactcctctactcctcttgggtgtatttgcttctttttgttctagagcttttaggtgtgctgtcaacctactaatgtatgctctcccctgtttctttttggaggcactcagagctatgagttttcctcttagcactgctttcatttgtgttccataagtttgggtatgttgggccttcattttcactaaattctaaaaagtctttaatttctttctttatttcttccttgaccaagttatcattgagtagagcgttgttcaacttccatgtatatgtgggctttctgttgtttttgttgttattgaagaccagccttagtccatggtgatctgataggatgcatgggattactgcaatcttcttgtatctgttgaggcctgttttgtgacagattatatggtcaattttggagaagctaccatgaggtgctgagaagaaggtatattcttttgttttaggataaaatgttctataaatatctgttaaatccatttggttcataacttgttagtttctctatgtctctgtttggtttctgtttccattatctgtccattgatgagagtgggatgttgaaatctcctactattattgtgtgaggcgcaatgtgtgctttgggttttagtaaggcttcttttatgaatgtaagtacctttgcatttggagcatagatattcaggattgagagttcatcttggtggatttttcctttgatggatgtgaagtgtcctttcttatcttttttgatcacttttggttgaaagtcgattttattcaatattagaatggttactccagcttgcttcttcagaccatttgaggtagtgtctgtctttgtctctgaggtgtgttttctgtatgcagcaaaatgctgggtcctctttacatgtccagtctgttactctatgtctttttattgggaaattgagttcattgatgttaagagatattaaggaatagtgattgttctttcctgtttatatttgttagaggtagaattgtatttgtggggctttcttcttttgggtttgttgcaagaagattactttcttgctttttctagggcataatttcctttattgtgttggagttttccatgtattatcctttttaggactgtgtttgtggaaagatattgtgtaaatttggttttctcacggaatatcttggtttctctatctatgttaattgagagttttgctggatatagtagcctggcctggcatttgtgttctcttagggtctgtatgatatctgcccaggatcttctggcttttcatagtctctggtaagaagtctgctataattatgataggtcttcctttgtatgttacttgaccttttttccttactgcttttaatattctttctttgttttgtgcatttggtgttttgacttttatgtgatggaaggaatttcttttctagttcaatctatttggagttctgtaggcttcttatatgtttatgggcatctctttctttaggttagggaaattttcttctataatttttgttgaagatatttactggccctttaagttgagagtcctcactctcttctatacctattatccttaggcttgatcttctcattgtgtcctagatttcctggatgttttaggttaggaactttctgcattttacattatctttgatggttgttttctatggtatcttctgccctgagattctctcttctatttattgtattctgttggggattctttgcatctatgactcctgatctcttccctaggttttctatctccagggttgtctccctttgtgatttctttattgtttctgtttccgtttttagatcctggatggttttgttcaattccttcacctgtttgattgtgttttcctgtaattctttaaggggtttttgtattttctctttacaggcttctacttgtgtttcctctttaagggcttctacttgtttatctatgttgtcctgtatttctttaaggaagttacttatgtccttcttaaagtcctctatcaccatcatgagatgtgatttttaaatccaaatcttgcttttcctgtgtgtttggatccagtatttgctttggtgtgagaactgggctctaatgatgccaagtgtccttagtttctctttcttaggtgctgcgcttgcctcttgccatcaggttgtctctggtgttagattgtcttgctgtctctgacactggcttgaccctcctgtaagcctgtgtgtcagcactcctgtagacctgttttctttcagctggatctgggaacagagagctgctcctgggtttgtgtgtcctgaggccaccaggcaggtcgcttggagcagaagtgttggtcttacctctgctctcaggtgtgtcagcacttctggcaactggctttcagctctggacacaggcagaaaccagaagatttctgcccctgactgctcctagcttcctatgtccagagggcacagagggcactaggtgggttcctcttggtccatgaatgtcagcagaagtagttgtctcctctgagctctcaggactgtccacacttttgagagtccatctctctcccccacaggatttgggaacagagagctgtgggagcggttcagctccgggtgcaggtagaaaccaaaagtatcctgtactagacttctactgcctttattgatataaccatattttaatcccaaaagcaaaaataaatgctttatttctggtcttgagctaagggtatagttcaattgttagagtacttgtctgtaatgcaggagccctggatctgatctccattacagaataaaccaaatgtggtaatgcatgcctgcaatcccaaatcccaaatctccaaaggcgtacacaggaggatgagactttcgaagtcattcttgtctacatagcaaattagagaccaaccttatctttaaaaatagtaataatcctgatcttccacttgaagtaaatgtatccagtaactgtacctgataccattctatgttagattttgtttcagggtttcgaagataagttctccagagaagcacaagtagtgggagatggcggagagagggctggtagatgaacccataaacaacaaacaacagagctggaggacaattaggatgatatgtagttagaaacagagggacagcatataagagacaacagggagataacacataagagacaacacagggataacacacaaaagacagaagagagataatacataagagacaacagagggacagcgcataagagacaacagggagataacacgtaagagacaacagagggataacacataaagacttagagttttatggttcgccttgactagattaaggaatgaatgcctgtggaggtgtctatgaaggactttccagaagtgttaggtcttagggggctctgacttagccctttggtggagtgagaatgtggtggcattatagaaaaatgctgaacagtaagaagtccaggtggaggaagcagattactgggggtgtgcatgggccattacatctgaccctggacactacattccctttatctctacttcccatcagtcaagaaataaatagcctcttccacacaaccccactgtcattatggccctaagcacataagccccccaccctttaagtttctttgaggtatctggtcatcctggctcccagctccaagtcacccaaagggttcatataggcaagcatttccacctctaccgtgttccatcacaaaccactggctatttgagaaatttcagacagctaaagaatggttctcttagcactgatggccttgcattcaagagacttgcctgctggtttgcaaacctagaggctatggcactgaacttggacacccggtggcgtgctgcttttggcatagagaaagctgacatccagcagctaagtgactgctcctgagctttggaactcgttctcctgtatcaccctctacatccaactcttctcagcttgtcttctcaatatttccactgtccctcatcaccttagattcttgtagacgctgccctcaatggcttactggctcctcaactacttcctgccactgtcgccctcagggctggaaacctggagccttgtctgctcttggcacagccacacagcttactctacccatgacaaataaggagacttggagaccatttggggaaagcctttatcagggcctaatgggtgcacacttggatcaggagtcatccattggagagaagcctcaaggaatagtggggaacatactgtatctagagacagtatagggtcatgatggcgtggattatactccccacaaagacagccctgcatgtgctctgcttccagtctcaccaatcacaaccctcccgtatgaacccatcacagcccttgcacagattgcaggtctcaaatatgttcacctttctttctgacataaccaggattttttttaatttgcttgcgtgtttattatttctatttattttattcattttttatttattattttacatcccactcactacccctctccccatcatcccctcccaagatccttcccccatcccctctccctttcacctctgagccagtggtgccccctccgtgtatctcccaaccctaataatcaggtggtttgagccaccagggaagatgctcttcttcctttctgaccttgagagctgctattccaaggtcctctggagctgtgtgtgtgaagtcacctggaggtcataggtggagtggagttttaaggccatggtagaggctggagccatagtagttggaacaaggctgtggtttcagcagcagccatgattgttgtatactttgcagctcaaatatggtctcctcagggctctgtgaggtattcaaagcacctagaatcccatgatgacacttccaccagtctctaaaagagacctaagactactagatatagaaaaaggccaacttaagtacatcaaaaggtcaagccttctggcccctaatggctcattttacatgaagaaaaggtgaccattacactatgcccaataaagacatgttacatttacactacggtccttggcatcccttagcagatgatcctagggagagctgagcaatctcgtccatctcacctccacccagtcaccaaaataacactgttctaaggcacacttctgagacttacagagctactagagagttgggggtagcagtaagacctttccctggccctcaagatacgttcacacccacatcacatatatgagttcgcatacactaacacacacagcacatcttggacatggcccattcaggaacagatctgtcatgatcgcttgagttaaggaaccactcaagggaatgactaaaggaggatcccactggagtcctggcccacaggaggaggtggaataaaggttaggtagggcaagacaagggcactaaagccactatgctgctggggccactgtggacactgatggccagaaatggaatgatcagcctgtaggcaggaggggggagggaggatgattcctgaaaaccagaagagtcaccgtggagtctgaaccaggaaggagagagagctcccagtgtaaccctaaggcttaagtagttgcaactgcctcctctccttccagaggaccacccactgccacctagcatagcactctgaggactcagaaccagcagcccagcataagctgagtgtcaaagaagaatcaggcccaagcaggctggacacaaagtttcttggtcctcaggctatgagggagatggagtccttcccactattcggggcacaccacagacagcagcacctgatccagttggagcaaaggctcctcacccctgtgttttccctcagaaccacaagtctttccaggaaactctgtatttacccctcagattcccacccaggtctgttaggctaaaggccaagcctgtcacctcagactatctgaaagagataaaaccaggcaagacccccaattccctcagatctcacaccccgtgttcccaaagtccctaactaactttcctggggccagcccggggcctacctggttcttccactgtcagttagctctctgatgtcttccaaatacaattaaacacccttctgtgggaagtcagacttggcaaagcctaagtcccccagtcccttgcatcccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggaagctgctgggcccacacaccatctttaccctctccccttccctcagtgcagacgtagaccacaggcctggaagagacgttagctgtttctatggtgttccatgagacccagttactccccagatgtgctctgtccttgccagagtagcaagtagaggaccccaagccgaagggcggccacttgtgagtgattaccagggaagcccactgtctctagcatgccagctccaaagctgagacaggaaccagggggcctctatcagaggccctgcgtgtcatatcgtgcccacaggctgttcctctttgtgtatcgttaataacttacaacgtgactgccacactgccccgaaggactgccaagggaacagaaaaggcaatggcttgagtccagtcccttttcagggcagtagcactccaaaggggcaggcatcgtgactgcaggaacatgcaagtttctaacgtgagagctgtgcagaacaccagacaacgaaaagtgccctgaccagagcgtgcaggtgtgtctcctagaaagaggcctcacctgagacgccactgtcccttagtcaacttcccaagaacagaataaaaaagggaacttccaaggctgctaaggccgggggttcccaccccacttttagctgagggcactgaggcagagcggcccctaggtactaccatctgggcacgaatgcaataatggttactaaagattcacaacgtctgggagcctgcacagggacaggagatggctgcagatgagaagagcctggctagccacagccacttaccagcggacctcaggtatcatagcctgtgggaccctgagccaaagggtttgcccaaggagaatgggcaaacaggttacagggtcctggatggggaagggggcacctgggctgccttctaacaaggacagagtctcttggtcattgcctgtccttcagctgtcactcctctgcattaaggcacacagttattagacactactaccgctatccacaaagacaggggactgtggatctcaaccagacatggctgaaccaagagaaactgaagatgtcgtgagaagctcagaaaacgccaggagaagctgaataggaatctgcctgcaaaccatcagggcaaggaggcaataacaagtgacagagccaacgagtgacagcaaggaattgccctgtgatgaactaacaacaaagctgggctgacctgggctaagctaggagtgggatctgtgctgcactgggctggaaggagccgggatgagccaagcaaagtgggttggactgagttgaattggcctggactagtttgtgttgggctgggctggcctggaataggtaggctaaaccagcttaaactagggtaggctgggcttaactgaatcagactaggctagactaagcagaactgggctgggttgaactgggctacactagcctggtctgatctaggataggctgggctaagctgagctggactggctggactgggctgagctaagttgcactggacagagctgggctggagtggactggactgggttggattgggctggactgggctgggctaggctgagctaaattgcactggacagagctgggctagagtggactggacagagctgggctagagtggactggactgggctgggctgggctgggctgggctgggctgggctgggctgggctgggctgagctgggctgggctgggctgggctggactgggctgggctggactgggctggactgggctggactgggctgggctgggctgggctgggctgggctgggctgggctgggctgggctgggctgggctgggctgggctcagcaggcctaagtaggcctagctgggtttagctaggtttggctaggtaaggctgagctagattggactggactgaaccaggtggggtatattcagctgacattgtttggtctggtctggactgaactggactgagccgggctagcctaagctagatggggggtatactcagctgagatgggctggtctggctagattgaactggactggactaggctgagccaggctgacctgagatgtcctgatctgggctgaactgggcagggctggtctcagctggactacactgagttaacctgggctgaaccagactgggctaaactaggttgtactggctggattagacttggctaaactgggcttggctaaactgagtcaggatggtctaggttgatttttagttgggctaaactaagctgaactacactgaactaggcaagactgggctggaaaggtctgagttaaattaggagggacttggctgggctgggctgggctgggccaggctgggctgagctgggccaggctgggctgagctgggctgagctgggctgagctggattgagccgggctgaactggactgagctgggatgagctggactgagctggactgggttgagctgaacaaaactaaactggaatgggctaaattggcctaaaattggctaggctaagctaagtaaggctgccctgagctgagaaggactggattggcctggactgagtttggatgagcatcattggactatgctaagctaacttgggtgaagtgggctaagcaggactaatctggcctgatctgagctagaccaagctaggccaagctcagctaagtttagcttagctgaattaggctgggctggactgtattgagctacactaaatttaacaggctgagctgagctgagctgagctgagctgagctgagctgagctgagctaagctgagctggttttgtctaaggtggattgacctgggctggactgaactcaattggactacactgaacttatctggacctcactgagctgtgctgcactgggccaaccctggatcactctagatctagcttagctggactgggctgagctagattgggtggactgatctaggctgaactagactattcttgcctgaggaaggctgggctatgctgagttgaactaaactgaactcagctaaggaaggctaagctagactgagctgagctacgttgggttgggctaaactgggctgagctatctcgggtagactaggctgagctagactaaattgggctgagctggagttggttggactggactgggttgggctaagctgagctgatttggtgtaatctgggatcaggtggcttgagctggactggactgtctgagctaaactgggttgagtggagctgagtgggtctgagtgaggctaggctggaatgagctaggctaaactgggctgaactggtttaggttgaatttagctgagatgagctgggctagacttctataagatggctgaactctgctagggtgaactgagctgtgctgagctgaacttggattaactataattagttgagctgggctgaactaggctgagtttagctggaataagagtcaactgggcccaactgagctaggctaagctaggctgaactgggatgagctagaattactgttctagtctgatctggactaaggtagactgggctggggttgagctctgttgggctaagcaaagttgagctatgagatgaactaggctgaattgggtacttctagatcattccaggctgttctgggttgacctgaactgggtgggattgagctaagtggggtaggctatgctgagctctgccaggctgcatgagtttattgatctgaactgggacaggctggaatggactggcctgagctacaccaactgggctaagctgggataggtcaggctaggaggagtcaagctggactaggccaaactattataggtcttttggtctagttgaactttctggtgcttaactgaactgtgtttaagatcgattgctcaaaccagagggaggagaagcccttggccctgccaaggctggaccccacacacacaccagtgtaggggaatgtcaggacagagaggtggaaaggggtgggtggttgggtgggggaaaagtgataacatttgaaatgtaagtttaaaaaaaatccaaaaaataaattaatttaaaaaaaaatagattgctcgaaattttttatggatgtttttaactgttctccaagaagattgtcctgatatagtagccagactatatcagggtaggtagagacaatcaggtttatcagaaatatcctatgctttctgggggcctggcacagagctgaactgggccccaggctcaggagaatgtcacgggcatgcgggcactccagaataatttaggcagccatcaaggtggcttctgaagtggttgtattctctaactgtgtgctgtctaggatctgcagaggtcactaggaggcagaacactttgcaggttagcctgtggtaaagccaagagccccatgaatctgaaaggctgagaccaatagccctaggaaacaagggtctcacagttctgtcattaatgtgtcccaaaacagatttaatgtgtctcgccaaggaactggtgctcctgggaaagctctgaatccccaggtcccaaaagtggggacggaagatacaaaagtaattcactggatctctgggttcccaagccctttggggtacctgtgtcttggatttaaagtatagcctggtccctctggcaatatcatacagcctaccttaaagctactccattcaccctgagaacctaatggcttccagtctgccacccagttctcctgcttcatttatgggcatatcagagataataccactgtcaccctgcttaaaggacagacaggaaataactaacacacacatccccaaaagttctcagtcaagaaagagagcaaagttgcctcttcctccaaagctcatacccagccctcctggaagcccctgtgctaagccagctaggggcagtgagcaaagcttggcagagcatcaataatcaggggcctccctgggtttgtgcttgggtttagagaatgaagacaagacccagaaggagactgtctcctagactggaagagaatccccagaaccctgctcctgtcacagctgccctaatcagtcccctatgctgcaggcatgcagtgatctaaacaaatctaacctaggtccttcctgtcccacagtttctgtcaaggccccttcactctatcccttgaagccctgtagcagcgaaaacacggcttcggtgacattgggctgcctggtaaaggactacttccctgatccggtgactgtgacctggtattcagactccctgaacacgagcaccatgaacttcccgtctatcggttctgatcttaagaccaccaccagccaaatgaccagctggggcaagtcagccaagaacttcacttgccacgtgacacatgccccatccacattcgtcagtgacttgactatccggggtaagcagggttgagctggttacagttaccacaagagggaacatggtcagagcagaaaggaccgctcatatatacctataacagggggccaggggacccaacatactcaggggcctggtttgaggcttgaggggacataaggttagggagatactcacagctcactgcctctgccctagctcgacctgtcaacatcaccaagcccactgtagatctactccattcatcctgcgaccccaacgcattccactccaccatccagctgtactgctttgtttacggccacatccaaaatgatgtctctatccactggctaatggacgatcggaagatatatgaaacacatgcacaaaatgtcctaatcaaggaggaaggcaaactagcctctacctacagtagactcaacatcacccagcagcaatggatgtctgaaagcaccttcacctgcaaggtcacctcccaaggcgagaactattgggcccacactcggagatgctcaggtaggcccacactcgcctgatgctgagacctcagagttctgaagggaaggcaggctcttacgcagcccttcctctcttacagatgatgagccccggggtgtgattacctacctgatcccacccagtcccctcgacctgtatgaaaatgggactcccaaacttacctgtctggttttggacctggaaagtgaggagaatatcaccgtgacgtgggtccgagagcgtaagaagtctataggttcggcatcccagaggagtaccaagcaccataatgccacaaccagtatcacctccatcttgccagtggatgccaaggactggatcgaaggtgaaggctaccagtgcagagtggaccaccctcactttcccaagcccattgtgcgttccatcaccaaggccccaggtgagcacaggagatggagagtgggccggcccttctctgtgttcagatggcacggttaactggttaactcgtgtctgcccacaggcaagcgctcagccccagaggtatatgtgttcctgccaccggaggaggaggagaaggacaaacgaacactcacctgcttgatccagaatttcttccccgaggatatctctgtgcagtggctgcaggatagcaagctgatccccaaaagccaacatagtaccacgacacctctgaaatacaatggctccaaccaacgcttcttcatctttagccgcctggaggtcaccaaggcactctggacacagacaaaacagttcacctgccgagtgatccatgaggcacttcgggaacccaggaagctggagagaacaatatccaagagccttggtaacacttccctccgtccctcccaggcctccatgtagctgtgatggggaaggtgaatggcagacatctgcccactgttgtaacactgggaagccaccccaataaacactcagtgcctgattagagccctgggtgcccttcttcggggaaggtgggttgtgggcagaagtatcttggcctgaaagaagggaaaccccaagagagggacaggagtgaagcatggctcacccatctgtctatgtgttgggtatttgacaaataggacatcacagggcttcagcatagataaccctggtccttcctgcccttcactgtatcatgcacctgaaagggatccaaagagccagagaggtggtctctagagatgtaggtaaaatgaaccaacctgagaggcctcggcacccacccctcagtcttgcaagctcctgctcccaggtattcctggatgctggaactccttaaggtagagaaacagccaaagtcaacatctggaaaggcagaagtcagcatggccctgctccttccctctgtactcagcagccattgaggctgagcctacggccctgacctcctgtgtgccatgtgatcataccagacccggatcagaacctggtgctcctcatctttcaacccaaagtcatcccaaggcccagaatgggaagccagcttcacacagttgggttctcccatctatgccatgttctcacacacacacacacacacacacacacacacagagccacaaacactcaggccaccaagtcttaaagagactccaccaacagcacacacttgcagccacctgacacaacaacacacctcacccatgttcacatgtggcctgcgctaggcttcagtctgtttccagtcctttaccttttacacttgagtccaaaataaaaacagaagacttacgccctgagggagagaccagtgtcttcttcctgtggcctcagctcccagaacactcttccctaccttctacaacactaagacagtaagatacacccacacgaacataaatacatacacacacacacacacacacacacacacacacacacacacaccccaagtaggcttcatcatgctctttggtttagcaatagcccaaagcaagctatgcatccatctcaggcccagagggatgaggagaccagaatcaagacatacccacgcccatcccacgcccaaccaccaaccaccagcacatacggttcacacacctgagaccagtggctcccatcacacacacacacacacacacacacacacacacacacacacacacacacaagcccgtacacatccaccatatccagagacaagtgtctgagtctgagatacctctgaggatcaccaatggcagagtcggccagcacctcagcctccaggccaatccttatactttggcccactgcaggccatgagagatggaggaggtggaggcctgagctgtggaaaaccagagacaggaagatggtctgtatggagagagtagtaaaccagattatagggagactgaggcaggagtagagctcctacaaggccagtagtctaccttagagtcctataagtctgggctgggagtccatgtgtcctgacttgctcctcagatatcacaaccaagattcctggagccagagtgtgcatgcaggccttagaaatggagcttagagcccttcctggagggccctgggcactctgaacaaaaggcaattctgtaggctgtatagaggcatcctgtcagatacacacacacatgcacacacatacacacacagagacacagacacacacacatgcccacacacatgcatacacacatgcacacacatacacacacagagacacagacacacacacatgcccacacacatgcatacacacatgcatgcacacacacacacatacacacacacacacacacacacacacacacacacacacacacacaccccgcaggtagccttcatcatgctgtctagcgatagcccttttgagggtgggagatactgggtcatggtgggcactggagtagaaagagggaatgagcagtcagggtcaggggaaaaggacatctgcctccagggctgaacagagacttggagcagtcccagagcaagtgggatggggagctctgccactccagtttcaccaggactgcctgagaccagtgagggatccaccctgccacactgtcacttggagtctggggacgctaactggctggtccccccatcccagagctagacatccaggacctatgtaccgaagaggtggagggcgaggagctggaagagctgtggaccagcacttatatcttcatcagcctgttcctgctcagtgtgagctatggggccactgtcactgttctcaaggtgggatcctgcacctcggtgggtgggtcagggaggtctaggccaagctgcagcgccatcctcacatacacctttcccccaggtgaagtgggtcttctccacactgatgcacgatacaccccagaccttccaagactatgccaacatcctccagaccagggcatagatgcgatgccagcacccgtgcaggcctgcagccatgtgtgtctgagcctcctgaggtgcctgtttgccttggatggtaggtgggagcagagacccctaaaggcaccagagttggtgagatgtcaacatgtagaaggtgcggcttggggcagcaatgtgggctgtcccgcatggatactttgagacaggactttgaagagcctcaatttgacctatcaaatgctggtcacccaggtctttcagcatcagggtcactccatattgactgaataaccacaaaagcacaagaacccagagcctagagtccccactaggccccacctagagcacagagtcaaagctgggacactcagaatcaacccaaagtccagacccttgctcctcagaaggaatcctgccccactgcttccagacagacctctggcctaggcagatcgtcctactgccagataaggagcctcccacagggcagcagcagactcaagctctgaggccccatcaaccccagccccagcctggcagtcctactttgtctctggtctctttagtaaagttcttttccataactcctgagagtgctttgagaaggtatttaaggctaccattatggtgatgacaggtcccaagaacatggacaaggaccagatggtaagagcctggggattaaacatccacctctatgccatcctcctcaaaccacagagttctgccccagtctccatccggtccatcattcctgctgaccagactcacctcccaggggaattgaggtggaatcagggctgggcccccgggaacctggctgcaggtcactcttcaagaccacaatctgcccacccagtaagtgcagactgacaggccagtcccctgacccaagctgggacactagagggactaggtaacagcacgcaagtgtacaagaaccatccaaaatgggttgtgccatcctcaagacatgatctcacatgacaaaagacaggcttctctcatatataatgattgctcagggactaagaagaaagacctcttcatgggacggaaaaaccagcagtcactgtttttttcctgaagaaaatgcttcaatggtgagaacacttctagaaagaaggatgttagggtgagtgtggccctgctgggccctgggtaaagaaaggcatgagaactacttagaccattttgagggtcagttggccaaacactcttgtcatcacaagtgacagtctcacaaagaggtccacactggggtgtcaagctcagcaccaggggactttgggggaactaagatagggataaaccagccgggatcaggccatagtccacaggcatctgagccctctgctgctgagtccggcttctacgggccttggagtagggcccagatggcaaagacacagaaagctacccctcctgggtgcagaagacccaggactgggagaatgactgttctgatgagaaaagaggctctgtttaggatgtgtcccaagccattagtgtggccagcttactaatgtgcattcatgctgcaaaccattgctcacaatcaaatgtataccacgcacacagtcacgtagtttgcgcagacccactcatgtggcacatgcctgtgggcacatgggaccacacatacacgtgatgctttaaaacacagatctgcacggtcttgtacttagacacacattgtctcaggaagcccaggtgtggaccaccctgtcctcctgccacattctcctaagccatatcccctgccaagctgaggcctaggtgcctcttcctcaaccagctcctagaccaacatccctgaggcatagctcagtgtcttcttctaatcactatccctccaagccacgagaccccatagacactggacacgggcagcaagggttcagctcaaagaacacggtgtggcaggaactcctaccaaatcccaactagaaggaaggaaagtcccacagagagctagactcactctagacaacccagacagtgaccctggcttctacataccatgaatgaatgaccttctgagactaagaggtcgctttcttctctattcctacattatcagtccaccatggagggctacatggaaaaccccaaaagacataatcacattttggaacccataaatgtagcctcttgggaatagttcttcatcaatgtgaccaaggtaactatctcaagacgaggtcatcaaggactagctagtggactttaacctggtgacaagagtcataagagacagaagcaggacctagggggtaaacagggcctgcattctccaaaatcaaagtgtcaaaacagaaatatggcagcaaaacagaagtaccgtgcccaacactggtcaagaccaatgggggaggctcatgaggggttgcctaacaagagcaggcacaagtgcttagataaaaccacaacctacactcggccaccgtaaccctacatagaaaatgtacctatgggacgtcagctcaacgtcagtcccacctcgttgctgtgcgcagacagctgcagcctgaataacctgtccaagtgtgcatgtcacatccttgatgacacactgtaaccagtgatgccatgttagcacgatgtcctgtgagggtgtcttctgactcgggatggcaaaccctaagaccaaaaggaggtgcttggttcacgagagcggcctcgtggctggacacatggcgttaaatgagcctctgtggactaggaagcagctttaaccagaaagactataccagcaccctgcttcacgtttccacctttgagcctctactgactaagccactggcagccactcagcctgtggtattctctaacggcaacagaaatgactaagacaggcaaccacaatgtcccccactgctgatggctccagggcattcttggcctgatgacaggacctccagagcctccttgagacaggcagatctctggagggcaggaccaagctttctcctctctacctccccaacatctttgactagcttcacagataaaaggctagggggacatcagtttattccacactttctaagtctgatgcaggagcccttcctctgcgaagtatctatccaagaacccagaaaaggctaacttccccaactcaacacttagcaccactgacacacctgaccatacccactgatttacaacctttctcccagacagggccattcctgggcaaagactgtggtgtgagggcccagagtcctattgttgtataaatgaggcacagtggcagaggcaagctacaaagagtgacattgtggagagaggacactggggacagtcggatgtgtagaggatcatatgaagggtggagccctaccctgacaatctacaaagagtgacattgtggagagaggacactggggacagtcggatgtgtagaggatcatatgaagggtggagccctaccctgacaatcttcaagaggctccataggtcaaaggcccatcctgagaaagctgtgataggaaattgactcagggcagatgggatccaaatgagggtagcacctaactgtgacctacagacctccatgttggtcctcaagttggggcacccactttctcatggacgtagccatggaggtagccacagctcgtgacaagccattccagacacttgcctcaccccgttgtcaaccctgtgacctcaaagctcttctctgaggcccccctcagcttagggacccctctggagtagccctgttactttggctccttgacaacaagctctcaggtctcccttctacccctaattgtcctctccctctccatctctgccttggagtctctgagaaactagatgttcatttcattccctcctgcatctcctgcccaacctacccctgtggccatgcatgtggagtcctggccccatccaggcccgtgtggtcagacacacctgtctccaccacagccagaccacaggccagacatgacgtggaggtaagcggccacaatgtggaggtggaacaggaagtgggtgagggaccccatccaggggccagacacacagtcgtgcagccccctcaccgctcagtctgacccatccacaggcaaccacacacagagaaaaccagtttccagccaaggcttcacccagtcctaagctctctccggtagggcagacggcctttagccatgagaatggaccttcagggtgggaccacctggccatgggaggcctggctgttcccctatgaatgacactcaacaaccttgagcaggtgggtcccggtaccatctggactgctctgctccttggtgcactggggaatctcaaccaggccagacctgagaacataaggcagagaagcattagcaaggagaaggtgattcggagagcaagaaccagaggaatacaggacatgaacacaggcacgaggcggggtcatggtctgagctgcagagaagagagaaaaatggatgaaactcagcttcctggaaagcagcaacaagagactcccaggctagactgaggcaaggataaggaggcatcaacaaagaatgggggtgactcgggctgccatggctcagctgagctggatttagccaggctgagctgaactaagcttagctgaggtgaatgagactgagctgagctgagctgggacaaggtaggccaagttgggctgactgagctagtctagactggtctgggctagtctgatctggactggtctgagctgaactgagctaagttgagctgggataaactgggctgaggtgggataagatggcctgacttgggtaactaagccagtctagaattggataaactgaactagactggtccaaactggactagactgagctggactgagttagaatgaggtggactgggctaaactgggctgagctaggttaagctagggtggactagaatgctgatttaagatggcctggggtgggaacgctagctaagccagaccaagctgggctaggctgggttaagttgagttgagctacagtaaactagcctgggctgtgctgaccttactacaccaggctgggtttggttggcatgaatggagctgatttgagctgggctagaccaggttagtatgagctatgctgtcctggtctaagtagactgggtgaggctgagaaaattcgagatggaaactggactgagatggaaaaagataggcttagtgttggcttactgaaccagtctagaatgagctgaactggacttggaatggcctgaactgggcttagcttatctagcctgggcttggctaggctggcctaacctaggctgagttgatctgaactggtgtaggctgggataggcttgctgaaatggactaggtcaagctgggctggagtggggttagctaaaataggtggactaggctgagatgagttaggatgacctgagctatatttaggggatggatgggatgggatgggctatcccaagctaagctgggctagaatgggctagtgtaagctaaactggctgggttggaatgtgctgggctgtgctaagctagaataaactagagtggactggccaaaatcggctgggacggtctgtactgaaccaggctgggctgggctaactgagctagaccggtctgaggtgagctaatctgggatggggcggactgagctgggataggctagattaagctgggatgagctaggctaggctcactgagctaggctggaatagaccggtctaagataggctgcctgagctaaactagactgagatgaactgtaatgagctgggatgagctaagctaatctgggatgatctgggctaggctggaatggactgagccgagctggtctcagctgggctgggttgtgctgaatgggggtaaaccagactaggctacccagactaagctgggctgtgctgggccaagctgggctgagctagggtgggttgggctcgatggctgggctaatccaagctaggctgagctgagctggactgagctgggctggacggagctaggatgggattgactgagctgagctggactgaaatgggctgagctgagctaggctgagattcgctgagctgggctgagctggactgagctggactgagctggactgagctggactgagctgggctgagctgagctaggctgagattcgctgagctgggctgagctgggctgagctgggctgagctgggctgagctggactgaaatgggctgagcagacctggacaatgcaaggctgcactgaactgtccggctaggctatactgggatgagctgagctgggctggtctcagctaggcttggctgtgctgcatggaggtaaaccagactaggctacccaagctaaactgggctggaccaggctgggctggactgagctgtgctgagctggactgagctgggctgggctgggctgagctgagccaggcttggtttggctgagctgagctgagctgagctggactgagctagactgagctgggctgagctgagctaggctggactgagctggactgagctgggctgagctgagctaggctgggtttggctgagctgagctgagctggactgagctgggtgagctaaggtagactggaattggctgagctaagctgagctggactaaactggactaagctggactgagctgggctgagctgagctaggttaggattggctgagctgagctggactgagctgggctgagctggactgagctggactgaaatgggctgagaagccctggacaaagcaaggctgcactgaactgtctggctaggctatactgggatgagctgagctgggctgggctaagttgacttgggctaggataaactaaactgggatgagccggggtgagctgcatgaggtaggctggaatggctgagctagactaggccaggctgagctggaatgagccgagttgagctgagctgagctgagataaacttagtaaggctagaatgaattgagctgagctaggctgggccgacctaaagttgctctgaggtaggttagacatggttgtctgagctgggctgagttaggctagctataccgtctgggctgacctaatatgcccatattagttgtaatgacgtgacctaggttgaaacgggcttgctgatctgggctggactgggccaaactggagttagtctagcctgggctgacttagtgtagcctgggcagagttagactggaatgggctacactgagctgaactaggatgggatgggaagggataggctgaactgactgagctgggttcagttggccttgctgggctgagctgggctggatagtctagctgggctggccagaatgaggcagagctaggctggaattaggctaaacttggtttggctggttaagatgagctaacataaattaggctggctgaactacactggactgtaagctagcctgggtgagttcgcatggctggacgtcttcacagctctagtctgagttttactggtttgttctcctcagtgctgaggtaatagaaagactttggagtaaatgtgaaccaactcttgtttcatgggtccagactgtggcctcagtttgtcttatatgaacggagccacgccactcagtgtccaattctcatgccctcttctccttccctgattacctggtggaaactcacatgtacctgtagatagtgcctacatggacagaaccactgctcagatttagtcctctggccttttggtccactgcttgctgggtggatgggcaggtggctggagtggtgggtctgaagccaggacaaggcaagtataaagtaaaaacacaacaaaatggcccccaccccccagtgtaacctccaagccagctgttccccaaccattcctgccctgtgctggctgaggttggccgtccctgctcaggcccaccagttctggacctcctaacctgggactgagaacacggctctacccactgcccaagcaggagtggggctcagaaatctggggcgctagactgctcaggagcatagccatgtttacaaagacactcacagtgcgtacaagccctgctggaggcatctagccagatccttgaaaaagacaacctgcaggtcacgttcaaaatctatgcagccagtcggtcagctccaactgcgggtacatgatgcaacccctatgtgatactgggcctaggttctccggtataaagaagaaaaaggcatggtcctttctccagagattgtctcaagatgggcagtgtgaggactactatctcactcatgttttatgttccagagtccgcgaaagatcccaccatctacccactgagacccccaccatctccgtcaagcgacccagtgacaatcggctgcctaattcagaattacttcccatccggaactatgaatgtgacctggggcaagagtggaaaggatataagcgtcataaacttcccacctgccccagcctctgggccatacaccatgtgcagccagttgacattgccagctgcagagtgcccaaaaggaacatctgtgaaatactatgttcaatataacacaagccccgtcagagaattgagtgtggaatgccctggtaaagaaggttgggggggtctggggtgggctaagtcctaccttaacctggtatctggacccatatacccctctgaagcacacatcccactcagaaacctcccatgggggatggggggagggggtgtgaacaggcagagggagcagaggcctcagaacatccagaaaaggggacagcaaaggagaaaaggagactattctgatttgctaaaacttctatgttacaggtccaaaaccctccttagtctgccgccctcgcctgtcactgcaacggccagcccttgaggacctgctcctgggttcagaggccagcctcacatgtactctgagaggcctgaaagagcctacgggagccgtcttcacctggcagcccaccactgggaaggatgcagtgcagaaggaagctgtgcaggactcctgtggctgctacactgtgtccagcgtcctgcctggctgtgccgagcgctggaacaatggagagaccttcacatgcacagctacccaccctgaatttgagacccccttaaccggcgaaattgccaaagtcacaggtgggcccagatgcatacctgggacattgtatgatgttccctgcttgcgtacctgctttcttcctctaatacagatgctcagctgctcaggcccttgtgtcacagagggaaactggagctatccaaagaactgcccagaagggaagggcagagaggtctctgctctccttgtctgagccataactcttctttctaccttccagaaaacaccttcccaccccaggtccacctgctaccgccgccgtcggaggagctggccctgaatgagctcgtgtccctgacatgcctggtgcgaggattcaaccctaaagatgtgctggtgcgttggctacaagggaatgaggagctgccctctgaaagctacctagtgtttgagcccctgagggagccaggcgaaggagccatcacctacctggtgacaagcgtgctgcgtgtgtcagctgaaacctggaagcagggtgcccagtactcctgcatggtgggccacgaggccttgcccatgagcttcacccagaagaccatcgaccgtctgtcgggtaaacccaccaacgtcaacgtgtctgtgatcatgtcagagggagatggcatttgctactgagccaccttgcctgcccctactccttaaataaactctgtgctcatccaaagtatccctgcacttccatccagtgcctgtccatcatccttagggtctacaaaacactgggaggggtcagggcccagggaaggaggaacccccaccacctgagcttgtaaggcctcagagactctgaaggacctacatgcctagagtatatgtgtatgcatgtatacgtattagtgagtgcctttgcgtgtgtacctgtgtgtaacaagagaggagtgagtttgtgcgtgcctacgggtttatataggtatgtatatgggcataagtgcatacgcctttaagtgtgagcatatctgtgtccccgtgagcacatgtgtgtctgtgtatgcctatgagtgtgcacgtatctgtgtatgctcatgttggtggaaacatgtgtgcctatagtgtgtgtacctgccaggtggatgtgcaatgaaagggaggtgagaatgggggtgaagtccgagatgagcagattcagccaagacaggcaaacctcaggggagagtcccaagagcagtgggttgctgcagaggtactctgaatggtacttctgaatggtggtgtggctgtctgagtataagattacagcttttgtcccaaacaagaaagggatagatggagcaagagagtagcaagaccaaggctggtactgcctgggagtcacaataggaacggtagaggagtgaggagatgaatccaaggggcactgggaagaagatgccacccaccctcagtgggccagccctgaatggagacgtgcatagccactcagggtgaccactgactcatgagaaagagacataacatggcacagacagccctcagcagcaccctgctctgcatatatgcacatgggcatacaccctggtctgcatacaggtacatgggcatacacgcacatacatttgcacactcacacagacccgaaccctggaggaggacgaagttcacagcccacacgcagcttctggaaagcaatgggagtcccctcccaagcccaaccatgacaactcatggacaagtctataagctcctccaggtggcccctttctaacctaagtctcccttcccatcctgagcccaagtataacaaaccagaaacagggtatgtggcaagctgggaaaagacaggagcaggccatagagaccactctcacacaggccttggcctcctccatgggcacccctagaacacaaagttctacaaccaggtacacttggcacccagatgcccacaagagggcagtggggcccctgctcctgtctcacgggccttcagaacctctccaggggcctggtttctagcaacttccctctgctgtcagagcaaggcccatgcacaccctggataccctccagcttgaaagtccacttccccgaggatagcaaaagcgacaggccagctttggaaacctgacccagaaaagcacgatagccacccatggaacccaaggcctggtccaaaacagaattctagtaaggaggagccaataggtgaaagactgaacacacacagggagagaagacagaggagcacgatagtcgagagaggggggctggtgggtgaggcgatgagtgagtgactggaacaaggttgggtggatatgcagatgaatgatgggaatggtggatggactgatggatggctgcagtgacagaaatatgagtgactgagtatcggcacacagtccctacctccacttaaaatcaaagttctatgcgcggagactctgagggcagtggggttgtctctaccgggagactttagtgttggttaacccccccccaagttctttataatgcaacagaatcctctgaccacatgtccaccccttggtattccaacctcggcccagaaatcaccttggcctgtatctgtttgagagtgtccgatcttaccgaaccctagtacccaggccaagttcaacctaagaactggggcttttgtgaggtgttgctaaatgtctagagaggtctgagacaagtggccttgggctcaaactcttctcagagcctcaaagacagaaacaactctcttaccatgatagttctctaattaagatcccctgagggaaagagagagagtcaggtcttggggggcatctcaagaacttcaaggattccagccccttacctgggaccctgccttctcattatcccagaacaagtcccttctcagagataaggaacccctgccaccaccgtccccaaagcccaagggggcatagaaacagaggccttaagcctgagcccccatccccatgggtttggatctagaaggtcatctatgtcttacagaatgccaagagccaccttcctacgtgatactggaccagtcacaagacatcctggaggaagagaccccgggtgccagtctgtggcccaccgctgtgaccttcctcaccctcttcctactgagcttgttctacagcacagcactcaccgtcacaactgtacgaggcccatttggcagcaaagaggtcccccagtactgaccaggagccagccacaggtggctgtcatggagacggtggggtacagggtgggggcaggggccttgaggatttactcagcccctccacatgtggccttgcaacccttcacagacatcaaggaagtggaaggaagtagaaggaaattatggcagcacttcctgggtttaacccagtcttccagaagccaggctgagacctcagcaaaagcaaagacataacccaactccaggatcctcccctctggctgaccacttgtgtctttgcacggatgaagcttggagaaagtcctctatgtttcagagactgatgtgacagcttcccacccgactcccatactttgctgagcaataaactggtgcaaaagcacagtttcttactctcaaaaacaaaagttaacaaaggattgggtgagggggtcagagatagtgtggtggtgccatgctaaactgttgcttacggtatagaatgtggcagcattgggcagggcagacacagggtgaccactgtctagtatccgagacaaccgtgtgtagctgtagccaagatgaacactgactgacttcaacaagtatttgtggcctcttcagacccaataccaggccattagcttgatctctggacctgacttctaaacatttggcctctgtgaacacccttgccaaacactggtcctggttgtgaaccttggtcctgaatactgagccttatcttggtaactgaaccataatcctgatccctgacctcagtcacgatcatgaaaccctggtcctggccactcgttccaataactggtccctagtcctgagccctgagtcctggtccaggtcactgaatcctggtcatgatcaatgggtttggtcctcattcctgagcctagtcttgatcactgatcactggttctgatcattaacaactaacctgatcactagtccccattcctaatcactgggccgcgatactgatcactgaaccctgtttctaaacaatgtgtagtgaaatgtatggtaaaacctttgcatctggctttgagtgaaatgtttcggcagacctttgctatgttttgggttagtcaggaaaggctgagaaatggttttgaggctgtttgaaccttgaagaaatgttgtctccctggacaatctgcacttggtactacattaaggtttgcagttgcacacaccttggtcctaaacactcctggcagacttagaactcttacgtttgattatggctagccatagttgaaaagggctgagagttgtatgggtggtctgctctctctcgcagcaagggcaagatgactttggtagttgaaaactttcccagccccaactaactctgtataatgtttgaataaagtaacggcagtaggctagttgtggttaatttttattccaagaagaatgaacccctctgctccttcagaaaaggaaggcttagcattttggtgagcttctctctactgaggcacctatgaccaactcagtgttctttgattcctgtcaccacatccagtcttgatcactaagtgccagtcctcatcactaaaccctggtctccaccagtctgcttgggttctgataatcagactcacattctgataactgggccctgattctggtcactagctctttgccctggtcatggacatttgaccctagtccacggcactgagttctgggcatggaccctgggccctagtcctaggtactgggttctggttctaacaactaggtcctgtactgatcaatgggccctgacctagacattgggccctggtcctcaacatcaacttctaagcctgaactctagccccaaattctgcttatcaacactggtcctggaccttggtcctcatcacacatccattctctgagacccaaggaatcagtggtattttgcaagaagtccctttgatattccaagcctcattctcattaggaagatctcttcaggggattcctgcagaaggttccagaatccccaccacactgttcacatactgggctgcaactgggacagtgaccccttttgctcatggaaacaaagcaggcccaggccctgtgagctggagcctctggcctggggtctacagatgtggggtcagcattgtggagaaggtttgcagggcaggtgtgggggtagggcagggatggtcacattagcatcttgtttttctttcttctgaagtctctgttttctatcacctgctgaaacattcaaagtagctccaagctgaggccagctgagtcatcctgagcctatctcagcccaggtgcctcaaaacagagctactgttctgagaatcacaccaccctggaccaggccaggtgggtctggggctggatgaggggtcagagccaggggagccctgacagggactgagaaggccccaacccccatcactcaaggttctccacaaccatccacagtcatgccttagtgaggccatgttctgtcccaatgagaacaagtccaattaagattaagtctggtcttcccagggtcattcagtgtcaaggagtgtcaaccaaggccagccaaggccagcctgaggtcagccagcatcacccaaggacacacaactattctagtagacaactagaatagtcagctcaacagggccctggtgatgcaaaatggagagtgtattcctgccagacagggctccacagataggctccctcactgcatatgacctccctgaatgtttcccacactgcagttggttctagactacttcttgataagcatgcagaaagataacaggataagaaattttatgcagagaacagaagtatctacggaatagaatagaagatagatagtagaagtctgctacaggccccagtggagtctctttgtagagtcaagagatcaaacctaaactgagtctcaggattgagtccagtacagaagcaaccttcaggatgctaaagaccatacaggcaatggacagaatggagtccagacagaccaatgagtggacagtccaatctcacataatgaaccatgtcaagagcagatagtgagccaaagaaggctctgggacactcggagattctcggcctctggatctcctgatgtatataccaggtgatcaagtgacagtctagtggagccattgccatcacagtgtcaggtgtcctccccttcatgggttccggtgaggatgtggcacctccctttagttggacgtgtacaataaattctcaggcctggtatgatttttaatgatccatgtgtttctatagtcttaattatctttaataaaattatagggtgacaccaaatttagggataagttatttatcaggctgtgcctttggaaggtgacgttatttacatagccaccaaggtgcccagtcatcggcccatcttccaaacggagtcaagggccatttgaaacagtgaaatccctcagggcaagggacacaacatggaggaatttaaaacagagtacagcttgatcttaacacacacacacacacaaacgtaagagatggaaaaggggatcaagggacacagaagtacagagaaaacaagacagtaagggatgtagagatgagaggtaaccacagggaaaggtgagacacaaagacgagaggagaaagacacagggacagaaagacccatgcaagcaagagagacagacataaggaagaaaaggcgagaagagacagacaaaggtgcagcaatgtggcccacctggtactcacaagaaggccctggcacacactccgatgagagccatgcacctacaaacacgtagacacagctccacacagacacacacggcatctgcacaactgtctgaacctcaaacaggtctgcccactccctctcctccaggcctttgtccttaggaaggcacgctgagggtaactcagtcgggatacttctgattggggctcactgaacagcctgaggctgggtccacagttgctctcactgtctggccctgtaccccaggtcatgcttcagagggaattaactgaatgcagtaaacaccgtctgtggtcagcatgtactaagggatagaaccctatcaggatttgtccaactaaggtccaaatacagagtgaagaagacgatgggggagatcagatggcagatgggagcactctggatagagctcagggatatggtggctgaggaacattacagctgccaggcttggcctttcatctcagctctaggtcaaggggaactacccaggtctctgctttgttgctggtaactatacctaagtctaagaacctcagtaagacacagaaccagtaagacgacagcctccatcgataagaaagaaaggagaaaggcagaatggataagtctctggacagatgagagcctacacccaaaaacagttcgttcagccagttaatagggtgtagccctagcacacgagagaaaacagttccacaggtgtaagggagtaaatctgtgcgaaggggtactgcttgagctcctcatggcctggtccagaagcagaagctgggcaggggcaaaggacagggtaaggcagggagacaggggcatgaaggagcctttgggactgtgtggtgagaactaggctgtgcttttactgagcctgagtttgtggcagttgcctcatggggaaggcacccagaggtaaggcagaggaaaggagtaactagggctgagggcaccacagggtctgaggaattagaggcagctatgacccatttgtcatggtatttggacatgtacttcatggacacagatctgagaaccaggcctggctctcactaaccagcaggaggtgtcccacttgtggctgtaggtctttcagcacaccatgccatgggcctctcacactggacgatctgtctgaaaggctgatgttgggaggtgggagcccaggcctggggtctgggacactgggtgacagaggtgtccagaatgtagagtgctcagagtgtgggtggggacaagctgtagagtgtccccatgaggggacaggctgagatagggactgaagtccatctacaggcttaccacactccatgctctggatgagagcactgagctctgccaccctacaacagcaggcagagcggcctccatgctaggaaagccaggcagcagggacagagttcctggatggggcaggtggaattgtctctgctcggcatcaaactaagtggaccttcagcagtaaggtcttactgtctagtcatggtggacagccaggaacatagtcaatgaacagcctgctttgtttggattcctctggagacttcctgatcaataacttgtaggcctccatgtttcatgtgacaacttacatctctctatgtataacatgggctttctgtgtagtcctgggtatcctagaacaccctgtgtagaccaggctggcttcaaacttgggacatcctcctgtctctgccttctaataaatgctgggattaaaggctgtgccaccacacacaatctaacccatttcttctgggaataacactgttcacccagccatacactgagttaaaattccttaataaatgttagttcatttacaaaatagtggatttccataaggcttcttcatggatcctaatccaacttttaccttctcttttccccaatcctccaatccccctattcccacttaaatctgaaatccccctccctccattttcaagctgcctgtgttctatgtcccctcatattgtttttttcttgtgtggaggtttgcagatttgaatgcaggaacccttcactggggctaagcctcctgccacccagcacttcccatccccacacctcctcacgcttgatttagcccatgtcccctcatgtgtatgggtgtttctcttcagtctgaggcattactccccgtgtcctctggagagctgcctactgtcacagatacctttcttctgtttctgctagggaaagcttttatttccccttgaattttaatcattgtctgggtgtaataccctgggttgagagctgtgttctttcagaacttggactacgtctatccaggcatctggctttaaagtttctactgtggggctgcagagatggctcagtggttaaccacacatttcttcttgcagaggacttgggcttgattcctagtacctccgtggcagctaagaaccatctgtgactccaactgcacaggattcgatgcccttttctggaggtcatctggagtagtcagctcaacagggccccgggatgcagcatggagagtccatgctgacaggcagggctccacagagagagaaagacagaaacacaggccactgaaagagacagtaatggactgaggggacagagagaaacacacggacagacagacagagataacaaaacaccgacactcatagacacagagaagagaggggacagggaagttttgagagcaatgggtaggaggtgagagagacacagaggcaatacatacagagagtgactccagaagacagagtctgagaggagacactgcaagagacagagaccccaaaagggttgagagcactggatgctttcacagagaatccagattcgattcccagcaggctcatggcagctcatactgcaatcccagttccagagtgccctgaaggatccttcatgcatgtggagcacagaagcgctctctctctctctctctctctctctctctctctctctctctctctctctcagatgaaagccatgaaccagaagacagagacatgagtgaacactcctcagagacatagccacagcactcacacccagttccacacagacacatacagcacctgcctgcctgatccaaaccccaaacccattgacccactccctctcctccaggtctttgttctcagagtagcacactgagggtagctcagcctggatacttcccaaggggcctggacacacagcatgcatctctggtccacagcccccatcccttgttggccctgtaatccatgtgatgtctcaggagaagatgttgtctgagagcagggcctggtacagtgtccctggtacagtgtccctggtacagtgtccctggtacagtctctctagtaaagtctctctggtacagtttccctggtacagtcttcctggtacagtgtccctggtacagtctctctggtaaagtctctctggcacaggatgcctagtatagtctttctggtacaatctgcctggtacagtctgcctagtacagtcttcctggcacagtctatccctggtgcaggcttcaggtcaggcccaagtgtgaagagtgcagaagacagtgggcagagctgagagagcgctagtcagttttgttcagagaacagtgatggccgctccaggctactggacatcccaggtgtgcttcttacacttctcaaagctgtgggaacacaaccgaccctctactcacttcagtgtaattgcctatagcagggcatgcctctgggcatcagggagtcacacagaggcaggtaagactctagacctggggactgagaggggaaggcatgtacaagagggcctcatccttaggacacagggattcgaggcctctggatagccagtgagcaacatatgcagagtgatgaggccccaggagtctaatggacgccaggaggtcacagagctagaggcctggagggctagagtctgtgggaagggggactgcttaggttcttcccacccatgtccaggagcagaggctgggcagggccacaggacagggtaaggcagggagacaggggcatgaaggagcctttgggactgtgtggtgagaactaggctgtgcttttactgagcctgagtttgtggcagctgcctcatggggaaggcacccagaggtaaggcagaggaaaggagtaactagggctgagggcaccacagggtctgaggaattagaggcagctatgacccatttgtcatggtatttggacatgtacttcatggacacagatctgagaactaggcctggctctcactaaccagcaggaggtgtcccacttgtggctgtaggtctttcagcacaccatgccatgggcctctcacactggacgatctgtctgaaaggctgatgttgggaggtgggagcccaggcctggggtctgggacactgggtgacagaggtgtccagaatgtagagtgctcagagtgcgggtgggaacaagctgtagagtgtccccatgaggggacaggctgaggtagggactgaagtccacccaaggctcaccacactccatgctctggatgagagcactgagctctgccaccctacaacagcaggcagagcggcctccatgctaggaaagccaggcagcagggacagagttcctggatgggacaggtggaattgtctctgctctgcatcaaactaagtggaccttcagcagtaaggtcttactgtctagtcatggtggacagccaggaacatagtcaatgaacagcctgctttgtttggattcctctggagacttcctgatcaataacttgtaggcctccatgtttcatgtgacaacttacatctctctatgtataacatgggctttctgtgtagtcctgggtatcctagaacaccctgtgtagaccaggctggcttcaaacttgggacatcctcctgtctctgccttctaataaatgctgggattaaaggctgtgccaccacacacaatctaacccatttcttctggaaacaacactgttcacccagccatacactgagttaaaattccttaataaatgttagttcatttacaaaatagtggatttccataaggcttcttcatggatcctaatccaacttttaccttctcttttccccaatcctccaatccccctattcccacttaaatctgaaatccccctccctccattttcaagctgcctgtgttctatgtcccctcatattgtttttttcttgtgtggaggtttgcagatttgaatgcaggaacccttcactggggctaagcctcctgccacccagcacttcccatccccacacctcctcacgcttgatttagcccatgtcccctcatgtgtatgggtgtttctcttcagtctgaggcattactccccgtgtcctctggagagctgcctactgtcacagatacctttcttctgtttctgctaggggaagcttttatttccccttgaattttaatcattgtctggctgtaataccctgggttgagagctgtggtctttcagaacttggactttgtctatccaggcatctggccttaaagtttctactgtggggctgcagagatggctcagtggttaaccacacatttcttcttgcagaggacttgggcttgattcttagtacctccgtggcagctaagaaccatctgtaactccagctgcacaggattcgatgcccttttctggaggtcatctggagtagtcagctcagcagggccccgggatgcagcatggagagtccatgctgacaggcagggctccacagagagagaaagacagaaacacaggccactgaaagagacagtaatggactgaggggacagagagaaacacacggacagacagacagacagacagacagacagacagacagacagacagagatagataacaaaacaccgacactcatagacacagagaacagaggggacagggaagttttgagagcaatgggtaggaggtgagagagacacagaggcaatacatacagagagtgactccagaagacagagtctgagaggagacactgcaagagacagagaccccaaaagggttgagagcactggatgctttcacagagaatccagattcaattcccagcaggctcatggcagctcatactgcaatcccagttccagggtgccctgaaggatccttcatgcatgtggagcacagaagctctctctctctctctctctctctctctctctctctctacactgtccccatgaagggacacgctgacgtacggactgaagtccacccaaagctcaccacactccatgctctggatgagagcactgagctctgccaccctacaacagcaggcacagcggcctccatgctaggaaagccaggcagcacggacagagttcctggatggggcaggtggaattgtctctgctcggcatcaaactaagtggaccttcagcagtaaggtcttactgtctagtcatggtggacagccaggaacatagtcaatgaacagcctgctttgtttggattcctctggagacttcctgatcaataacttgtaagcctccatgtttcatgtgacaacttacatctctctatgtataacacgggctttctgtgtagtcctgggtatcctagaacaccctgtgtagaccaggctggcttcaaacttgggacatcctcctgtctctgccttctaatccatgctgggattaaagcctgtgccaccacacacaatctaacccatttcttctggaaacnnnnnnnnnnnnnnnnnnnnnnnnnnnnnnnnnnnnnnnnnnnnnnnnnncagtggcacacacacatacacacacacacacacacacacacacacacacacacacacatacactctaatgaaggcagtggcgcacacacacactctcagatgaaagccatgaaccagaagacagagacatgtgtgaacactcctcagagacatagccacagcactcacacccagctccacacagacacatacagcacctgcctgcctgatccaaaccccaaacccattgacccactccctctcctccaggtctttgttctcagagtagcacactgagggtagctcagcctggacacttcccaaggggcctggacacacagcatgcatctctggtccacagcccccatcccttgttggccctgtaatccatgtgatgtctcaggagaagatgttgtctgagagcagggcctggtacagtgtccctggtacagtgtccctggtacagtgtccctgggacagtgtccctggtacagtctccctggtacagtctccctggtacagtctctctagtaaagtctctctggtacagtttccctggtacagtcttcctggtacagtgtccctggtacagtctctctggtaaagtctctctggcacaggatgcctagtatagtctttctggtacaatctgcctggtacagtctgcctagtacagtctccctggtaaagtctgtccctggttcaggcttcaggtcaggcccaagtgtgaagggtgcagaagacagtgggcagagctgagagagcgctagtcagttttgttcagagaacagtgatggccgctccaggctactggacatcccaggtgtgcttcttacacttctcaaagctgtgggaacacaaccgaccctctactcacttcagtgtaattgcgtatagcagggcatgcctctggacatcaggaagtcacacagaggcaggtaagactctagacctggggactgagaggggaaggcatgtacaagagggcctcatccttaggacacagggatttgaggcctctggagagccagtgagcaacatatgcagagtgatgaggccccaggagactgatgggcaccaggaggtcacagagctagaggccgggagggctagagtctgtgggaagggggactgcttaggttcttcccacccatgtccaggagcagaggctgagcagggccacaggacagggtaaggcagggagacaggggcatgaaggagcctttgggactgtgtgatgagaactaggctgtgcttttactgagcctgagtttgtggcagctgcctcatggggaaggcacccagaggtaaggcagaggaaaggagtaactagggctgagggcaccacaggatctgaggatttagaggcagctatgacccatttgtcattgtatttggacatgtacttcatggacacagatctgagaaccaggcctggctctcactaaccggcaggaggtgtcccacttgtggctgtaggtctttcagcacaccatgccatgggcctctcacactggacgatctgtctgaaaggctgatgttgggaggtgggagcccaggcctggggtctgggacactgggtgacagaggtgtccagaatgtagagtgctcagggtgcgggtggggacaagctgtacagtgtccccatgaggggacaggctgaggtagggactgaagtccacccaaggctcaccacactccatgctctggatgagagcactgagctctgccaccctacaacagcaggcacagcggcctccatgctaggaaagccaggcagcagggacagagttcctggatggggcaggtggaattgtctctgctcggcatcaaactaagtggaccttcagcagtaaggtcttactgtctagtcatggtggacagccaggaacatagtcaatgaacagcctgctttgtttggattcctctggagacttcctgatcaataacttgtaggcctccatgtttcatgtgacaacttacatctctctatgtataacacgggctttctgtgtagtcctgggtatcctagaacaccctgtgtagaccaggctggcttcaaacttgggacatcctcctgtctctgccttctaatccatgctgggattaaagcctgtgccaccacacacaatctaacccatttcttctggaaacaacactgttcacccagccatacactgagttaaaattccttaataaatgttagttcatttacaaaatagtggatttccataaggcttcttcatggatcctaatccaacttttaccttctcttttccccaatcctccaatccccctattcccacttaaatctgaaatccccctccctccattttcaagctgcctgtgttctatgtcccctcatattgtttttttcttgtgtggaggtttgcagatttgaatgcaggaacccttcactggggctaagcctcctgccacccagcacttcccatccccacacctcctcacgcttgatttagcccatgtcccctcatgtgtatgggtgtttctcttcagtctgaggcattactccccatgtcctctggagagctgcctactgtcacagatacctttcttctgtttctgctaggggaagcttttatttccccttgaattttaatcattgtctgggtgtaataccctgggttgagagatgtggtctttcagaacttggactttgtctatccaggcatctggccttaaagtttctactgtggggctgcagagatggctcagtggttaaccacacacgttgttcttgcagaggacttgggcttgattcttagtacctccgtggcagctaagaaccatctgtaactccagctgcacaggattcgatgcccttttctggaggtcatctggagtagtcagctcagcagggccccgggatgcagcatggagagtccatgctgacaggcagggctccacagagagagaaagacagaaacacaggccactgaaagagacagtaatggactgaggggacagagagaaacacacggacagacagacagacagacagacagacagacagacagacagacagacagacagacagacagacagacagagataacaaaacaccgacactcatagacacagagaacagaggggacagggaagttttgagagcaatgggtaggaggtgagagagacacagaggcaatacatacagagagtgactccagaagacagagtctgagaggagacactgcaagagacagagaccccaaaagggttgagagcactggatgctttcacagagaatccagattcaattcccagcaggctcatggcagctcatactgcaatcccagttccagggtgccctgaaggatccttcatgcatgtggagcacagaagctcgctctctctctctctctctctctctctctctctctctctctctctctctctcagacacacacacacacacatacacacacacacatacactctcaaatgaaagccatgaaccagaagacagagacatgtgtgaacattcctcagagacatagccacaacactcacacccagttccccgcagacacacaaatcacctgcctccctgttccaaatcccaaacccattaactcactccctctccttcaggcctttgatttcagagtagcacaccgagggtagctcagcctagacacttcccatgggacctggttacatagcgtgcacagggccacctcttgttggccctataacccatgtgatgattcaggaaaagatgttgtctgagagcagggcctggtacagtccccctggtacagtccccctggtacagtctctctggtacagtctccttggtacaggcttcctgatacagtctctctggtacagtctctctggtacaatctgcctcgtacagtctccctgatacagtctgcctggtacagtctctctggtacagtctgcctggtacagtctccctggtacagtctccctgatacagtctgcctggtacagtctctctggtacagcctctctggtacagtcggcctggtacagtctccctggtacagtctccttggtacagtctccctgatacagtctgcctggtacagtctgcctggtacagtctctctagtacagtctgcctggtacagtctgcctgatacagtctgcctgatacagtctgcctggtacagtctccttggtacagtctgcctggtacagtctgcctgatacagtctgcctggtacagtctctctggtacagtctccttggtacagtctccctgatacagtctccttggtgcagtctccctgatacagtctctctggtacagtctgcctggtacagtctccctggtacagtctccttggtacagtctccctgatacagtctgcctggtacagtctccctggtacagtctccctggtacagtctgcctggcacattctatccctggtgcaggcttcaggtcaggcccaagtgtgaagggtgcagaagacagtgggcagagctgagagagcgctagtcagttttgttcagagaacagtgatggctgctccaggctactggacatcccaggtgtgcttcttacacttctcaaagctgtgggaacacaaccaaccctctacccaattcattgtaattgtctatagcagggcatgcctctgggcatcagggagtcacacagaggcaggtaagactctagtcctggggactgtagaaggtatgtaagtacaacagggcctcatccttggaacactggtgtctcaggcttcaatacagccagtgagaaacacatgcagagtgatgtggccccaggagactgatgggcaccaggaggtcacagagctagaggcctggagggctagggtctgtgggaagggggactgcattcactcttcctatgcttgcccaggaacaactgtctatgcagggccacaggacagggtaaggcagggagacaggggcatgaaggagcctttgggactgtatgatgagagtctaggctgtgctctgactgagcctgagtttgtgacagctgtctcatgaggaagacacccagaggccagacagaggaaaagagtaatcagggctgagcggaccacagggtctggggacgtggaggtggctggcctggctcccacaggccctcagatggagctgcacatcatcccatagcatatcactctggagggcttatcaaaatggttgtgctgtgggactgggtttcaggactgaggcctgagatactgggtagcagaacatgttcagtatacagggtgctcagagtacgggggggggggggacaagctctgcagtgttcctccatgttgggacaagcagaaagaggtcttgaagctgtttgtccatccataggcctaacccatactggccctgctcatggccctagcttgggccacatatctagtgcccactgaatcatcaccatgaagactgttggaaaaccagagcctctgatgtcttcctgccttgcttgctctccctgactctcatagctcacacaggctctgccctggtccaccactgtcctcaactgtaaaccatgccaggcacagagagcaaggaatgtggtggtctcagactgtcacacacaacaatcttgtgcctttcacatccacacgcacaagcatgctcatacccctctgtcaggggtcagtggggtcttccttgggctcactcccatttctagctgctccttggtattggtgactgcggctgctgtgtcggtggctgccagagatgcttgatcggcatgacctcagatataggaatggcctggggtcaacagagtgcacacacttagggcactggccagagttctatgtagaccaaggcctctcttcctagtgtgttatttcacaaaaccttatgcaacaacatcttctattccttttattcctctttgtctgctaatggggaattttctagaaagagtgtcccctctctgtcttcctgctgtgtagacagatcttgtaggtgtgatcacagagtggtgtttcccttcttggccattttcaggccaggaactcagggccagagacagaaagtcaggaaggtaggaaagacagggagacataataaaggtgagatggagacagagaaagacaaagggagaaaagcacaggattgcagggagagacaaggagacgcccgacggaaacagacatcagggaaaagacatgattgttcctttagtaaattgctttccggagaaaagagacagcagagagacatggataggcacacaaagatacaaggagagagacaggaaacagagaaagagagaaacagagatggagaaacaacgagggagagagaagagtagagagaaagacacggagaaaaaaaatcaagaaacagaaaagacaaaagataggaagacagagaaataggccagaaatacagacagacagagagatgcctgaagatgttctctctcacctagagaaagaaagcacaggcagagataatacagagagagagagagagagagagagagagagagagagagagagagagagagagagagagaggagagaaagaggagagacacggtgttagaggagaaagcattatgttttgatagagacagagatacagcaactgaggaacagactgagcagaaagaatcccactcagagagagacagaggctaagctgggagaggcaggggtggccagagagggagacagaggagagcctgtgggacaggtcagacaccatcttggaagacccagtgacaagccagggaggtgacaggttagtgcagtttctaccccacagtccacaggctggagccacaggcctgtgtccatgtggccacaggctagctcccagcctgccaagcctgtctgtggagggattgcggagtggggctgggctgaggcaggccaggatttttccagtggagcagccagtgactgggctgagggtcactgcccaccatccccgtgattctgggtagacccaggacctggagcacacacagccttcctgtctctcccacttccctggggtgtttggaccttgcctatctcctgtcattccctcctagggtcagattccagcagtgtcgataaatgggaaaacactgaattcaatgtcaccgttaggggtcatggaacccccagccccatccccaaagctggtcaacctggccagggtggggtgaacctgcagctgcaggtgggggaatcattgatgctatttttggctcagagaatgagaaacatgtttttctgcatggaacaaacatccatttgcatgtgccccgagggccaaccctgcacagagtgagtcactcggcaggtgtgtgtgtgtgtgtgtgtgtgtgtgtgagagagagagagagagagagagagagagagagagagacagagacagagacagagacagacagagagacagagagacagagagagagacagagagagacacacacagagacagagagacagagagagacagagacagagagagacacacacacagagacagagagacagagagagagatgttgtgagcaagccctgtttcaggtactgatatctgtgcccccgtgccccagcccatgtggaaaaactacccttaggggcccattaactcatcacagtccaggccatcatggtgagccctagctgacctaagcaggttccaccctaaacatgaaggaaaataataaaggccatctgttacccagaatcctagggatggtgggcagtgaccctcagcccactcctggccgctccactggaagaatcctggcctgcctcagcccagccccactccgcaatccctccacagacaggcttggcaggctgggagctagcctgtggccacatggacacaggcctgtggctccagcctgtggactgtggggtagaaactgcactaacctgtcacctccctggcttgtcactgggtcttccaagatggtgtctgacctgtcccacaggctctcctctgtctccctctctggccacccctgcctctcccagcttagcctctgtctctctctgagtgggattctctctgctcagtctgtcagccatagttggagagagtccatctatgtttgcctctgtctctgccaattccatcagaggtctctctactaacacttgcctctgcatgtgtctcttggtccttctcctgtcttcccatctctctatctcctcatctctctgtctttctgttactccctgtctctgtctctctgtcttttctctcactgtctttatctctctgcctgtttcatggacttttctctgtctctctgtctctgtctctctgtctctctctctgtctctctctgtctctgtctctctctgcccctatctcttggtctctatctctatcttcaactccctatctttgttcctcatactcacatttacctctttcccaagcccccagtctccaggtctgcctgtttctgtctctcccttgccatgtttccctgttttattctctctcctcctgaatgctctggcttgaaactggccaagaagggaaacaccactctgtgatcacacctacaggatctgtctacacagcaggaagacagagaggcgaccctctttcaccctacagtgtctggacttggttgattccaggttactcctatactcaagtccgggactatggtggtcaagcatctctggcagccactgggacagcagctatagccaccaacatcgagccctgttagctaccaacattagctcctcaaagaggttgggtctataggcctctggtgtgaggagatgttgacagtgagaattagttcccaaggaggacaccactgtttcctgttagatggagaactacagtgggtacgaacatgcttgaacacatgagtgtcaaatgcacaagactgttgggtgtgtcacccttcccctctctgttcatggcatgactgcacactgaacacaatggtggattgggacagagtctgtgtgagttgagaatcatgaagagtgtagacacttcaaggatagtgtagacccttctagttcgtggtgatggctcacttggcactgagtttctgaccccacagggaccatggacaagggcagtatgggctgtgcctatggatacaaaagagacttcgaagcctgtattagcctgtcccctcatggaggaacacagcacagcttgtctctacccacactctgagtactctacgtcctggacacctctgtcacccagtgtcctaggtcccatccttggctcccacatcacatctgcctttcagacagatcttccagtgtgacagacccatttcatggtgctgaacaacataaacccatttcctgagggttggtgagagccggcctggttctcagatctgtgtccatgaagtacatgaccaaataccatgacaaatgggtcatagctgcctctaattcctcagaccctatgggccctcagccctggttactcctttcctcggcctggcctctgggtgccttccccatgaggcagctgccacaaacccaggctcagtcagaacatagcctagttcctaccatacagtcccaaaggttgcttcatgcccctgtctccctgccttagcctgtctgtgctcctgcacagacaagagttcctgggcaagcataggaagagtgaatgcagtccctcttccaacagaccctagccctccaggcctctagctctgtgacctcctggtgtccattagactcctggggcctcatcactctgcatgtgttgctcttgtacatgccttcccctctcagtccccaggtctagagtcttacctgcctctgtgtgacttcctgatgtccagaggcatgccctgctatagacaattacactgaagtgagtagagggtcggttgtgttcccacagctttgagaagtgtaggaagcacacctgggatgtccagtaacctggagcggccatcactgttctctgaacaaaactgactagcattctctcatctctgcccactatcttctgcacccttcacacttgggcctgacctgaagcctgcaccagggacagactttaccaggcagactgtaccaggaagactgtaccagggagattgtaccaggcagagtgtgccaggcagactgtacaaggcacactatatcagagagactttaccatgcagactgcaccagggagactgtaccagggagactgtaccagggagactgcaccagggagactgtaccaggccctgatctcagacaacatcttttactgagacatcacatggattacagggccagcaagaggtgggggctgtggaccagaggctcatactgtgttaccaggtcccatgggaagtgtccaggctgagctaccctcagtgtgctactctgagaacaaaggcctggaggagagggagtgggtcaatgggtttggggtttggatcaggcaggcaggtgctgcgtgtgtctgtgtggaggctgggtgtgagtgctttggctatgtctctgaggagcgttcactcatgtctctgtctctggttcatggctttcatctgagagagagagagagagagaaagagagagagagagagagagagagagagagagagagagagagagcgcttctgtgctccacatgcatgaaggatccttcagggcaccctggaactgggatttcagtatgaactgccatgaacctgctgggaattgaatctggattctctgtgaaagcatccagtgctctcaacccttttggggtctctgtctcttgcagtgtctcctctcagactctgtcttctggagtcactctctgtatgtattgcctctgtgtctctctcacctcctacccattgctctcaaaacttccctgtcccctctgttctctgtgtctatgagtgtcggtgttttgttatctctgtctgtctgtctgtctgtctgtccgtgtgtttctctctgtcccctcagtccattactgtctctttcagtggcctgtgtttctgtctttctctctctgtggagccctgcctgtcagcatggactctccatgctgcatcccggggccctgctgagctgactactccagatgacctccagaaaagggcatcgaatcctgtgcagctggagttacagatggttcttagctgccacggaggtactaggaatcaagcccaagtcctctgcaagaacaacgtgtgtggttaaccactgagtcatctctgcagccccacagtagaaactttaaggtcagatgcctggatagacaaagtccaagttctgaaagaccacatctctcaacccagggtattacacccagacaatgattaaaattcaaggggaaataaaagcttcccctagcagaaacagaagaaaggtatctgtgacagtaggcagctcttcagaggacacggggagtaatgcctcagactgaagagaaacacccattcacatgaggggacaggggctaaatcaagcgtgaggaggtgtggggatggaaagtaatgggtggcaggaggcttagccccagtgaagggttcctgcattcaaatctgcaaacctccacacaagaaaaaaataatatgaggggacgtagaacacaggcagcttgaaaatggaggatgcttttagcattaaagatttacagtgtagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcattcctctttttttggcggccgatggcggttatattccttgcgtctcccgtatccagaaataataatcattcaaaacggtgttctcctcagccagtgtatgccttttggattttgcttccagcagcaccgagtggagaggagaggagaggagaggagaggagaggagaggagagatgttcagttatccaaaactaaggatccatgaagaagccttatggaaatccactattttgtaaatgaactaacatttattaaggaattttaactcagtgtatggctgggtgaacagtgttgttcccagaagaaatgggttagattgtgtgtggtggcacaggctttactcccagcatttattagaaggcagagacaggaggatgtcccaagtttgaagccagcctggtctacacagggtgttctaggatacccaggactacacagaaagcccgtgttatacatagagagatgtaagttgtcacatgaaacatggaggcctacaagttattgatcaggaagtctccagaggaatccaaacaaagcaggctgttcattgactatgttcctggctgtccaccatgactagacagtaagaccttactgctgaaggtccacttagtttgatgccgagcagagacaattccacctgccccatccaggaactctgtccctgctgcctggctttcctagcatggaggccgctgtgcctgctgttgtagggtggcagagctcagtgctctcatccagagcatggagtgtggtgggcctgtggatggacttcagtccctatctcagcctgtcccctcatggggacactgtacagcttgtccccacccgcaccctgagcactctacattctggacacctctgtcacccagtgtcccagaccccaggcctgggctcccacctcccaacatcagcctttcagacagatcgtccagtgtgagaggcccatggcatggtgtgctgaaagacctacagccacaagtgggacacctcctgccggttagtgagagccaggcctggttctcagatctgtgtccatgaagtacatgtccaaataccatgacaaatgggtcatagctgcctctaaatcctcagatcctgtggtgccctcagccctggttactcctttcctctgccttacctctgggtgccttccccatgaggcagctgccacaaactcaggctcagtaaaagcacagcctagttctcatcacacagtcccaaaggctccttcatgcccctgtctccctgccttaccctgtcctgtggccctgcccagcctctgctcctggacatgggtgggaagaacctaagcagtcccccttcccacagactctagccctcccggcctctagctctgtgacctcctggtgcccatcagtctcctggggccacatcactctgcatatgttgctcactggctatccagaggcctcgaatccctgtgtcctaaggatgaggccctcttgtacatgccttcccctctcagtccccaggtctatagtcttacctgcctctgtgtgactccctgatgcccagaggcatgccctgctataggcaattacactgaagtgagtagagggtcggttgtgttcccacagctttgagaagtgtaagaagcacacctgggatgtccagtagcctggagcggccatcactgttctctgaacaaaactgactagcgctctctcagctctgcccactgtcttctgcactcttcatacttgggcctgacctgaagcctgcaccagggatagactgtgccaggcagactgtaccagagagactgtaccaggcagactgtatcagggagactgtaccaggcagactgtatcagggagactgtaccaggcagactgtatcagggagactgtaccaggcagactgtaccacacagactatactaggcatcttgtaccagagagactttaccaggcagactgcaccagggacactctaccagggacactgtaccagggacactgtaccagggacactgtaccaggccctgctctcagacaacatcttctcctgagacatcacatggattacagggccaacaagggatgggggctgtggaccagagatgcttgctgtgtctccaggccccttgggaagtgtccaggctgagctaccctcagtgtgctactctgagaacaaagacctggaggagagggagtgggttcatgggtttggggtttggatcaggcaggcaggtgctgtgtgtgtctgtgtggagctgggtgtgagtgctgtggctatgtctctgaggagtgttcacacatgtctctttcttctggtgcatggctttcatctgagagagagagaaagagagagagagagagagagagagagagagagagagagagtgtgttgctgccttcatttgagtgcttggtgggctccatgctgtacctctgccttccctgtgtgtctgtccttttgcctctcccttcctttggcctgtctctcttgtctgcatctgtctctcttgtctctccctctctgtgtctcttttctctcctgtctctgtgtctcttctttcctgtggtctctcctcatccccatgtctgcatcagtgtctatcagtctttaactctgtgtcctcttgttcccatttctgtccctctggatatttctgtctttctgtgtgtctgtcctcatctctcccagcgtccatgtctttgtgtccctttgtccccacacagtatcttctcaaatactctgtgtgcctggtcccctgtctctcattccttttctcactgctcccatcagtgtttctctgtgtctctgcttctgtgtctctgtgtgtctgtctcatgctatctctttctctctcattatctctgtctccctcagacttctctgtctttcttggtctctgtctccctctgtgtctctgtctttctgcatgtctaatgtctctgtgtctcccttagctcatctctgtctctctcaatattcccacaatcccctttattctttgtgtctctgtctctgtggtgtctctttctcagtctctctgtatttcgctctgtctctcagaatctctgtgtccctcatattatttttcgaagtgtctccctatctctttcagtaacactatttctgtttttctcagtctctctctctctctctctctctctctctctnnnnnnnnctctctctctcagaaagtctatggcacctcttctatgtgtgtcccactctggacctggatcaatcttccttcttggacctcagtttcatcagttgtgagacgataccttgccagaagtccagaggactgtctgtcctccatagtctagaccacctgtgatctgagagatattgggacaacggatgtgcagtgagggacctgcctttctgtggagccctgtctggctggaatacactctccattctgcatcaccagagccttgttgagctggctattctagttgtctactagaatagttgtgtgaccttgggtgatgctggctgacctcaggctggccttggctggccttggttgacactgaatgaccctgggaagaccagacttaatcttaattggacttgttctcattgggacagaacatggcctcactaaggcatgactgtggatggttgtggagaaccttgagtgatgggggttggggccttctcagtccctgtcagggctcccctggctctgacccctcatccagccccagacccacctggcctggtccagggtggtgtgattctcagaacagtagctctgttttggggcacctgggctgagataggctcaggatgactcagctggcctcagagtggagttattttgaatgtttcagcaggtgatagaaaacagagacttcagaagaaagaaaaacaagatgctaatgtgaccatccctgccctacccccacacctgccccgcaaaccttccccacaatgctgaccccacatctgtagaccccaggccagaggctccagctcacagggcctgggcctgctttgtttccattcagtgcctctgggaaaggcagatgagtaaaggggtcactctcccagttgcagcccagtgtgtgaacagtgtggtggggattctggaatcttctgcaggaatcccctgaagagatcttcctaatgagaatgaggcttggaatatcaaaggtacttcttgtaaaataccactgattccttgggcctcagagaatggatgtgtgatgaggaccaaggtccaggaccagtgttgataagcagaatttggggctagagttcaggcttagaagttgatgttgaggacctgggcccattgatcagtacagaacctagttgttagaatcagaacccagtgtctatgaccagagctcagtgatagggaccaagtcccaaggccaaatgatcaagaccaggacccagttgccaggaccaagatccaggtttcacaaccaaacctagttacgcagaccagaaaccattcgttggaatctggatctgaatcagagcccaatcacactactctaaaccagagttcagtgttgaggaccagggtacgtgatgagcccaagattcagagatcaagaggtggattcagtaattaagaccaggattcagagatcaggatcagggctcagttagcaggatcagggctcagtcatgtggtcatgggctcacggtccaatgtccatgcccaaaacacaactaaggacccagtggtcagaaccaaggcctgatgatcagagacaatacacactgctcagagctgaatttcagtggcaaggatgaagacataatgataaagactagggatcagtgagcagaaccagcgatgaggacccagacgcatctctgaagactagagtcagtgaccatgaccagttcaacgatcatgagtaggacttaattctgatcatacgagttcagtgatcacgaacaaggctcagtgatcatgacaagggctcagggaacaagagtgaggctcagcgatgaaaactggacctcagttatgagcccagtgatgagtaaccaggtctcggtcattagggccaggattcagtgataagaaccaagggtctctgcagggctcagtgcatcctctccccctgagactggacaaagccgcccagccacagggatggattctccagacaggcaacagcttcagggacagcccccccgtgatgcgccagagtaggggatacccaggggacttccacactctcaaagaagaaggggagaatggaacatgaagaagggactgtgaggggggaccgggaagtgggggacacagtgactgggatataaagtgaataaataaattaatggaaaatatcacatgggtgtagggaattttgaaagaataaataaaatgttaaaaatgaaaagaaaaaaagaccaagggtcaatgatcagggtgataataaataaataaataaataaataaataaataaataaataaataaataagaaaggaaagagagaaagaaaggaaggaagaaagaaagaaagaaagaaagaaagaaagaaagaaagaaagaacaaacgaactgaatgtcagaatttagggtaagatctcagtgatgaggatcagggatcagtggtttgaacgcagacacactgcccagggccattgttcaatgacgagagtcagggatcagctatcagaaccagggccagtaacgaaagccagggcccagtgaccccaaccaaaaaccagtgactaaaaccaaataaaatagaaactaggcagccacgatggtgcacacctttaatcccagaactcaggagtcaggggcagggggagttcaagacaaccctggtctacacagtgagttccaagacagccagggctacccagagaaaccctgtctagataacaaagactagaaaccatgagctcagtgatcagtggcagttcttgatgactaagaccatggtcaagaggactgatcagcaggactcagtggttagactcaggacatggtgatgatagcctctgttccagggatcagaaccaaggccaagggccaaggccatgactgagtcatcagaacagggcctctccatgagcactagtcaggcgcagccaggcctagcatgtcaatcaggcaaaattgggtatgtgtgtggtggtatgactgactatacatcgtcttagtatctgtctgaccccaccaccatcttccctgcctccgtccactcacagatctctgacgcgtcaccgcagggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcctgcaggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaagaaaccgaaatcaaaaaaaagaataaaaaaaaaatgatgaattgaattgaaaagcgtggtgcactctcagtacaatctgctctgatgccgcatagttaagccagccccgacacccgccaacacccgctgacgcgaaccccttgcggcc

The invention claimed is:

1. A transgenic rodent, the rodent comprising in its germline a heavy chain immunoglobulin locus comprising human unrearranged heavy chain variable region gene segments linked to DNA encoding a rodent heavy chain constant region and a rat 3' enhancer comprising the sequence set forth as SEQ ID NO:1, wherein the heavy chain immunoglobulin locus does not comprise a human immunoglobulin constant region gene, and wherein the rodent is a mouse or a rat.

2. The rodent of claim 1, wherein the human heavy chain variable region gene segments are contained on a DNA fragment that is larger than 170 kb.

3. The rodent of claim 1, wherein the human heavy chain variable region gene segments are contained on a DNA fragment that is larger than 180 kb.

4. The rodent of claim 1, wherein the human heavy chain variable region gene segments are contained on a DNA fragment that is larger than 350 kb.

5. The rodent of claim 1, wherein the human unrearranged heavy chain variable region gene segments are capable of rearranging to form a functional heavy chain variable region gene.

6. The rodent of claim 5, wherein following rearrangement the rodent expresses a functional antigen-binding molecule encoded by the human gene segments.

7. The rodent of claim 1, wherein the rodent produces an antibody that comprises a human variable region and a rodent constant region.

8. The rodent of claim 1, wherein the rodent is a rat.

9. The rodent of claim 1, wherein the rodent heavy chain constant region is a rodent Fc region.

10. A method of producing an antibody having a human variable region and a rodent constant region comprising exposing a transgenic rodent to an antigen, the rodent comprising in its germline a heavy chain immunoglobulin locus comprising human unrearranged heavy chain variable region gene segments linked to DNA encoding a rodent heavy chain constant region and a rat 3' enhancer comprising the sequence set forth as SEQ ID NO:1, wherein the heavy chain immunoglobulin locus does not comprise a human immunoglobulin constant region gene, wherein the exposure to the antigen is such that the transgenic rodent produces an antibody to the antigen, the antibody having a human heavy chain variable region and a rodent heavy chain constant region, and wherein the rodent is a mouse or a rat.

11. The method of claim 10, wherein the human heavy chain variable region gene segments are contained on a DNA fragment that is larger than 170 kb.

12. The method of claim 10, wherein the human heavy chain variable region gene segments are contained on a DNA fragment that is larger than 180 kb.

13. The method of claim 10, wherein the human heavy chain variable region gene segments are contained on a DNA fragment that is larger than 350 kb.

14. The method of claim 10, wherein the rodent is a rat.

15. The method of claim 10, wherein the rodent heavy chain constant region is a rodent Fc region.

16. The method of claim 10, further comprising the step of making a hybridoma from the transgenic rodent, the hybridoma comprising DNA encoding the antibody.

17. The method of claim 16, wherein the hybridoma is made from the spleen of the transgenic rodent.

* * * * *